United States Patent 10,407,724 (METHODS AND COMPOSITIONS FOR SCREENING AND TREATING DEVELOPMENTAL DISORDERS) - sequence listing, part 9

SEQ ID NO: 142 - DNA, 4300040 bp, Homo sapiens (residues 2,150,021-4,300,040 of 4,300,040)
gtggagggtcagtgtggcagccttttgcacccacacttgaggcacccgagttctcgtctggcatacaggaggaatgacgttgcacaaatgaattgaattgaaggtggtaaatgcggggaattttattgccaatgaaagtggctctcagtgggtaggggagctgaaaaggagacaaagtgggaaggtaatcttccattgaagtccagctgtccttggctggactcctctctgaagctacactgtcaagctgtccctctgaagtcaagctgcttctctctgacttccagctgtagtctctgacattcaactgcttctcctctctctactggctgagcctggagtttttatgtgcacaggatgggggacagtgtgggccatgggtggtttttgaaaaggcaatattcaagcaggaaaacagggatgtaagttttcattttgggctgcaggttcaggcagaatttctctgcctcctgtcgctatcaatatctttgctttgtagagaatctctgctcttcttcacagttgtcttaattatctgtgaatttctattcttccctatgtatttcagaatattttaagttgctaaaaccttttgatataaattgtactaaatgtatagatgattttgaaagacaattaacgtctttgtgatgttaaaattttccattcttttttttttttttgagatggagtcttgttctgttgcccaggctggagtgcagtggcgtgatctcggctcactgcaacctccgcctcccaggttcaagtgattctcctgcctcagcctcccaagtagctgggactacaggtgtgtgccaccacacctggctaatttttgtatttttagtagagacagggtttcaccaagttggccaggatggtcttgatctcctgaccttgtgatctgcccacctcagcctcccaaagtgctgggattacaggcataaaccaccatgcctggcccattcttagttttttttgagatggagtcttgctctgtcacccaggctggagtgcaatggcgcgatctcggctcattgcaacctccgcctcctgggttcaagcaattctcatgctttggcctcccaagtaggactacaggtgcctgctaccacacccagctaatttttgtatttttagtagagatagtgtttcactatattggccaggctggtcactcctgacctcaagtgatctgcccccgttcagcttcccaaagtgctgggattacaggcgtgagccaccgtgcccaccccaaatgttccattctctaacatgacatgtctttccattttttctagtctttatgtattttattagagttttaaaacttttcttgtatattctttgataggcttatttatattgttaaaatagataattgggatgtcattaggatgagaccctctaatgcatgaggttcttaccagagaaaccaaaccccaactcactgtaaactgtaaaatgaaacttaggctaaaccaatcagaaactgttagctaaacttctaacggactttccaactttaaccaattaaatattttctttgtcttgctttcatgagcaccttataaaatttctcctttgtatcttctcagtagagcactgacctgcttatagtctggtgttgactgatgaatcgcagaatgctcaaataaactcattaagattttaaggtgtctaagtttatcttttcttttcttttatttatttatttatttattttttgagacagagtcttgctctgttaccctggctggagtgcaatggcatgatcttggctcactgcaaactctgcctcccaggctcatgtgattctcatgcctcagtctcccgagtagctgggacctgcaggcttgtgccaccacacctggctaatttttgtacttttagtagagatggggttttaccatgttggccaggctggtcttgaactcctgacctcaagtgatccccccacctcagcctcccaatgtgctgggattacaggcatgagccactgcacctggtggtcgtgcctatgtttatctttcaatgctatatagtatagatgggatttttttttttgctgctgcgaatggtatctcagtttatattatattttctacttggtaatatctgatgtagaggaatgctacttattttcaaatattttaaaagattgcaactgtgcttattttttttaaatgatgttctgttgagttttctatgcatatgatcacatctgtcacctgaatataatgacagctttgtctcttcttttcaaatcttaaatcttcatttcttattgtcttacttcagtgtccacattgactaggggtggggatattgtccatccttgcctcatctgtaactttcaaggctttgtgccttcatcaagcatggcattttttattgaggtataagttccatgcagtgaaattcatagatcttcagtaaactctgtactcagtttggtggacacagagcatcttctttacctcagaaagtccccagtgctcctttacagttaatctttctgccctccagaagcaaccaccaccctcatttctatcattattacgttagttttgcctttctagagtttcatgtaaatggaattacagcagaatgtactttgatgtgcctggttgttttccatcagcatagtatttttgagaaccatccctgttgttacttgcatcagcagtttgttccttttcatcgcttagtagtatttcattgtatgaatacaccactgtttgttccttctcctttggatgagcatctggattgtttctacttcagtactattatgaataaagctgctatgaacattattatacaaagcttttttgtggacatatgctcttatctctctaggaatggaaatgttgggtcatagtgtagatgtatatttaactttttttctttctttctttttgttttttttttttttttttttgagatggactcttgccatgttaccaggctggagagcagtggtgcagtcttggcttgctgcaacctctgcctccagggttcaaacaattctcctgcctcgggttcccaagtagctggaattacaggcacatgccaccatgcccagctaattttcatgtttttagtacagaaggggtttcaccacattggccaggttggtctcggactcctgaccccaggtgatccgcctgcctcagcctcccaatgtgctgggattacaggcatggccaccacggcctggccaactttttaagaaaccattagttttgatgtagtgtgggcaaagcctcaaattggggcttagcccaggagggtttgaggcttcgcccaggaaagaattcaaggttgagctggtggtattcgcaacttttattgaagcagcagtgcacagcagcggcagaggtactgcttcttgcagatcagggctaccccacaggcagtgtgcccagagtagcagctcagaggccgttctgtggtcatatttagacccacttttaattacatgcaaattaaggggcagagtatgcagaaatttctagaaaaagggtggtaacttctgggtcgttgggtagttgtcatggcaatggtaagctgacatggcacactggtgcgcatgtcttatggaaagctgcttccattctcttttagctactcctcaatttgggctggtgtctgagctctgccttcggagttgagtcccacctcctacctcagttttccaaagcaattatttcatctcacactcctaccagcaatgtatgagagttctaattgctctacatcttctccagcatttagtgttataaatctttttcattttaaccattctatcaagtatgtagtggtgcctaattgttgttttatttgcatttccttgatgaataatgattttaagcactttttccatctacctattggccatttgtatatcttcttttataaaatgtctgagtttttgcccatttaaaaattgtggtttttttttttaaattactgggttgcaagaattctttatattttatggatgcaagaatcttcattagatatatgtgttgtgaatattttctcttggcagctttcttgtttattttcttgatggtggtttctgatgaagagaagttttaaattttgatgaagtctaacttattaatcttttcttttatgatttatgctttctggatcctccttaagaattaactgcttactctgagatcacaaagatattcttctagcagttctagtagcttcattattattttagctcttatgtttaggtctgtgatccatcaagttggattttgtgtatagtgtgagacaacggttgatgtcctttatttcctatacggatattcaattctctaagcaccattggttaaggatattttcctttccccatcgaattgttttgatacttttattaaaaatcatttgattttatgtgtataagtctgtttctgtgactctctatttgattccagtagtttatttgactatcctttcactaatagcccattatctttattgcagttttgtttgtctgaaagtatcttcattttgccctcatattttgaagggtatttttgctagatatagaatatttgcagtttttttctttgagcatcttaaagatgtcattcaatatccttccagcttctaaagtttttgatgcaaaatcatcaaatcttactttttcttctttgaaagtcatgtgtctttattctctagttgcttttaagatttgccttttagctttggtgtttggcttattgacaaggaagtgcttaggtgtggttttctttgtaattatcttgcttgggtttgacccagcatcttgaatctgtacattgatgtcttcgatcagtttgggagggttcttgatcattagctcttccacttttgctgctgtcttattctttctctcctctgtttgggactccatttacacatatattcaaacttttgattgtttcttgtatgtctgatgtgctctgttatttccatcctttttttctctgtgggcttcagtttgcataatttatattcaagcatgaacttttgagttcactaatcctgtctaatgttaaatccatccaaagaatttttattttcagatactgtattttgcagttccagaaagtccatttgctatatttatagattacaattctctgacaaagttttctttttaactattttgttgcattttcaattatcatatttaaacatatttgtaatagttatttaaaatgttttttctgccctacaatatctgagtcatctgtgggtctttattatcttttcatctcctgagaaagtgaggttatatttttctgccttttcacacaacttatacattttttttttttttttgagatggagtctcgctctgtcgcccaggctggagtgcagtgacacgatctcagctcactgcaacctctgcctcctgggttcaagcgattctcctgcctcagcctcccaagtagctggggttacaggcacatgccaccacgcctggctaattttttgtgtttttggtagagacggggtttcactgtgttagccaggatggtctcgatctcctgacctggtgatctacccacctcggcctcccaaagtgctgggattacaggcataagccactgtgcccggcacgttttacccttttcttattaggcaggtaaggtaagaggccaatcacaacaatatgatcagagaataaactagattgaggttgaattgtagttctgctagactcagtctctggtttgatggagagcttgtcaagtctacctcctcagacatatcacacgacggaacattcatttatgcctcttagaggtttgagcttggctctttagcttcccacttaacacgacttcaattttggcaaataggagagcgggaccagctgtgcgtttgacacaagtcccccttcctctacagattgttgtctcctaattactgtgagggtggaaattttcactttgttattctgtgtccctcccacagccttccatgcccctcaggcactcggcaaatgttccatgggaaaagctggccatgcttcaagggctctgttcaatctgagaccctacatctttaattatgagaaataattggacattgtgtcttaaaatatttttctggttatttctttttctgagactcctgttaaatggatgtaggcccttatacttttatcatccatataacttttcttttttttttttgagacagagtcttgctctgtcacccaggctggactgcagtggcacagtctcagctcactgcagcctctgcctcccgggttcaagtccccctgagtagctgggactacaggtgtacgccaccatgcccagctaatttttatattcttagtagagatggggttttaccatgttgtccaggctggtcttgaactcctgacctcaggtgatccacccgcctcagcctcccaaagtgctgggattacaggtgtgagccaccacaacgcctggcccacttttctttatattttctatttttagaccttttctgttttttgttttgttttgttttgttttgttttgtttttgagatggagtcttgctctgttgccaggctggagtgtagtggcacaatctcggctcacttcaaactccgtttcccgggttcaagtgattcccctgcctctgcaggctcccaagtagctggggctacaggcacgtgccaccacgcctggctaatttttgtatttttagtagatgggttttcaccatgttggccaggatggtctcgatctcctgatcgcgtgatccacccgcctcagcctcccaaagtgctgggattacaggcatgagtcacctggccccaatatttttgattttggtgattgtcttctgcctgatcttccaactctctaatttattttttggctgaatacattctgctatttactccatctactgagttatttgttgtaacggttattaaatgttgtcattgccaacatttctagttatttttaaatcattgcttatcttgcttgatatttacagtgtcctcccttatgtcttggaggatgtatattgtccttatggtaaatccctcttctgcctagtctgttcatacgactttttaaaattttttatttttttgagacagagtcttgctttgtcacccaggctggagtgcagtggtgctacctcggctcactgcaagctccacctcccaggttcatgccattctcctgcctcagcctcccaagtaactgggactacaggcgcctgccaccacgccccactaattttttgtattcttttagtagagacggggtttcaccgtattagccaggatggtctgaatctcctgacctcgtgatccgcctgcctcggcctcccaaagtgctggaattacaggcgtgagccaccacacccggcccatactaccccttttgctagtcattcatttggtggttgttttggctctgagttcatcttcccttaaaagtgtcagctatcttggtgaataatgtatactccgtgggaaggagtgaggttaaagacggggctccagctttggctcctctaggcaaaggtatgaggggagtgcctcagggtgcagagcctctggcagctattcgccatttgccacctgtccacagacaagccagagtgaagtgcctcaccttccagagaccctctgccctagtcgctgctcttttccaagagctgcctcactctgctttgtcttttatcccaaccaagggtagaagaggaaggagaggctgctccatggctcctggccagccttcatctattgaatctgttttccaccagccagttcagctggccccagaattgccttgaggttaccttgctattttcggctggtgctgtgttgatattttctgcccacagaggtgaaagggcaggctaccctccacccagagaagtatgggggacagaaaagcaataagaaagccctctcccagatttatatcgacccatgacctctggctgtcaccactctaggctgcagtgctcagccgactgggacccatctaccttttgtttctcagggtcagattctgggtacatcatccctctctcccttatacaatatctctagggccaagtcttggggagggaatctgcagtccactccatccagcaccaagataaaaatctgaagccccatctactttctgtcttctaaaaattctccaatatttctggtttgctaatggttcttcattttgttttctagccctgttatgttttgattgtttttaaaactatttgtttcttttctgccattttcaaatatgagagcatgttctgagaccctcccttttcttcttaagaagaatccccttggccaggtgtggttgctcacgcctgtaatcccagcactttgggaggccaagatgcgtggatcacctgaggtcaggagtttgagaccagcctggccaacatggtgaaaccccgtctctactaaaaatacaaaaaattagctgggcgtggtggcaggcaactgtaatcccagctactcgggaggctgaggcaggagaatctcatgaacctgggaggcggaggttgcagtgagccgagatcacgccattgcactccagcctgggcaacaagagaaaaactccgtctcaaaaaaaaaaaaaaaaaaaaaaaaagaagacaaagaagaagaaagaatctcctacttagtagaggcagtgattcttgtgcaactttgtaactttcattcatcccattcactctttcctgttttcttgtctgtaaaatgggaatagaggagtaggtgatgtttgagggcctttcaccctccccgtgctgtggctccaaggatcaggcccaactgttgtttggctcattttctgctgtacattctgcattagttcagaaacgtgagtggtggcaccgctttctttctaatttcattctggtcattggtattcagagagcaaaatgtagagctgaaaaatgaagattgtttcttcttagaaaaacaaaaagcacaaaccatctacagaaacctgttcctataatgagcagctgaggcaggtggacagaagattgtcctgagaaatgtgaatgaacttgcctccacggaatggggtatctagagtgggggatggtgcgagggttttttattccttcccaaagcaaaagcagacttctaatcatttttatcttgcactctggcctctttcaaatcccatgaagccccccaaagttgccaatgactaatgtgagactataactctctaggaaatagggatatctctgcctctgatgccagaaaacaaggcaatagacagaatgacctccaagaaccttgcctatcaaatacagcatccagtcatgtctctttgtagaggcagaaaccattcatgcttctgggaagagctaaaaaccattttgagaaaggttggaggagttgaaaggaacactgggatgctggcttcctcttcaccttccaccatgattgtaagtttcttgaggtctcctcagaagctgagcagatgccagcttcatgcttcctgtacagcctgctgaaccgtgaaccaattaaacctcttttcttgataaattacccagtctcaggtatttctttatagcaatttgagaacagcccaatatgccatccatgattttaggtactataaagccatagactattgggcaaggacttcagctcgaccctcatatacagacagggaaatagcctgaaagagctcagagacttccctgatatcaccatagtgagtcagtagctgaactaggagtagaacccaaggcctcttactgctgtgtaggagtctgatacctgtacctggatgcctcaagtaagttcctgaagcttctaagccccccactgcttttgaaggaaacgctaggtcaggcatagaataagggctaattaaatgttcagtactgtggcagatgctgtggatccccattgtggttgaaggacctagccctccaggtgctagaaagactgcaggaagacagctcacggctgtaaatcctctttgggaattgcatctgctgaagaaagcaacctggatcaaaataacttccccctttctagaagatccacatccaatgactgatctgtgcttgagtattaaaggccagatctgtccctgacacaggacaactcgaaagaggttgttccagcttcagagtgccccatgcggttggccaaggtctttgctgagtctatactgtggcctaacttctcccctgcccaattctatttttctcccttttcttccccaggtgttgagccacagagcactccctattctaatctcagagtctgcttcctgaagaacccatcctgccacacttggattgaattacagtcatgagaaagcctgaacttgggaaggagccagggtctggtggcttcagtcgtggtgggggagcagctgaagagagatgggtcatgaggtggggcatagaccctggacctggaggcctggattcccgcctctccacagcagctcacctgcccaattatgattttgcctgcaaccctccaagcagagctgggagaggctgtgtgattattgctgttccaatcactgcttaaaatcaatgttatgtgtcccagaagatcaatctcccccatttcttagagccattcccctaaatcttcacccctcttctcgggctctgctcactctcacctccctcactctcagcagatgatcttgcctcgtactgtcctttacagaaaaaacgaaaatgaagccattgggaagctttcatcagtttcacatctcatatccttgttaccctatcctcacctcctcccatccagcccaagaaagggtggtctccccaggctctgggccctgcccctttctgcttccttagagatctctgcatgtcaattatcataccccttctccctcatgggacttacctgtttcctctctcctgctaccttcccatgggtacataaatatgtttaggtctctcatctggaaaaaagcaccaaccacagatagaagaaaatatttgcaaattatatgtttaacaaaggacttgtatccaaaaatatacaaagaagtcttaaaactcaacaagaaaacaaacaaccttattaaaaaatgggccaaagaccttaacaaatacctcaccaaggaagacatttaggtggcaagtaagcgtatgaaaatatgttccacatcaagtgtcactggagaatacaaattaaaacaataagacatgactacacacctatcgaaatggccaaaatccagaacactaacaacactaaaagctggtaaggatgcagaggcacaggaactctcattcattgatggtgggaatgcaaaatggtacagcctctttaaaagactgtttttggcagtttcttacaaaactaaacatacctttaccatagaatccaacttcctttgttaaataccgaggagcaatcatgcttcttggtatttaacaaaggaagttgaaaagttacaccccaacaaaaaactctgcacgtgaatatttatagcaacttcattcacaattgccaaggacatcctcttgtccttcagtaggtgaacagataaataaactgtggtacatccagaccacagaatattattcagtgctaaaaaggaatgagctagcaaaccatggaaggacttgaggagactttaaatgcctatcactaagtgaaagaagttaatcagaaaagcctagatactgtatgattctagctatgtgccattctggaaaaggcgaaactatgaaaacagtaaaaaggtcagtggttttcaggagttgaggggaagagatgaatgaataagtagaacacaggatgtttagggcagtgaaactaccctatatgatactgtaatggtgggaacatgtcattatgtatttgtcaaaacccataatttgtataacactgagaatgaaccttcatgtaaactacagattttgggtgatgatgatgtgtcaaggtaggttcattgatggtaacaaatgtaccccataaattgattatgggggaggctgtacctgtgtgggaccagggggtatatgggaaatctctgtatcttctgctcaattttgctgtgaactaaaactgctctaaaaaataaaatctattttttaaaacaacaccacaacattttctatccatgtacttgtcaacttctggtcttttcatttagccacactcatgccacaagcagttattaagcaatattctaggtgcagaaatacagcagtggacaacaaagtcatgattcaaattctatggagggagatagacaataaatgcataaccaagtaatatataatattatcagagggtaaataagtgctaaggaaaaaaaatcaagcagagtaaagaagttggggatgaccaaggctggggatagtgggcaccactttatatagggtggtcagggaaggccttcctggaaaggtaacacttgaacagagacctggagaaagtagggaatgaactctgtggacatctggggaaacagtgtcccagtgagagggaagggcaagagcaaaggcccaaaggcaagcatgactggtgtatttaaggagcagtaaaggaagcgaacgcagagtagaggaagcaagtgggggagagatgagatcagaaggaaagcacagagccagatcatgtaggatcatatagaacaattgaaggatttaatttttaccctagagaattctgagcagaggaatgacttgatttgcttgcatttaaagaggtcactgtagctgctgtgtagaaagtaaactatagagagaagtggaaggaaagagactaatcagaaagccactgcaatacaggtaaatgaggatggcttggattagggtggtagcagtggagaccagaaaggtggttctggttctggatatatttcgaaggtaggagccagtaggattgttggtgtgggttttgcaagaaacagaaaaatcagctgggtatggtggctcatgcctgtaatgccagcactttgggaggccaaggcgggtggatcacctgaggtcaggagttcgagagcagcctggccaacctggtgaaaccccatctctactaaaatacaaaaaattagctgggcctggtggcaggtgcctgtagccccaggtactcaggaggctgaggcatgagaatcccttgagccctggaggcggaggttgcagtgagccgagattgctccactgcactccagtttgggctacagagtgagaccccatctcaaaaaaaaaaaaaaaaaaaaaaaaaaggaaaagaaaaaaagaaacagaaaaatcaaggatgaccgcaaggtttttggcctgagccaaaagaagaatgaagttgccatcgcctgagatggggaagactgcaggataaatggtttgttgtttgttttagtggcagtgggtaggcaggaggatgaaaatcatgagtttgattcaagacaagttagtgaagatgttgagtaggcagtcgggtatacagaattaaaagatacagtccaagctggaaacttgaattagagcgttctcagcacatagatagtattaaagccgtcagactggatgagatgaccgagggaatgggtctagacccagaagaaaagagtgtgagtactaagtcctggagttcctgtacattaaggggttggggagaggagaaggatccagcataggagactagaaggaacaaccagcaaggtgagaagaaaagcaagaactttctgttctagaggcagaaagtgtttcaagaaaggtagtgaatgatttggagacagtgaaaagattgatgatgcaggagaggagaatttctggcgtgatgtccttgagtaggcaagttgcgcaaaaggagggctgacctgaatggtagcacaaggagggaaggcagagggtgtggcccaggtgctcttttctctgctcccagacctgctcttcttgaggtggccttccccttctgccccctgcacttgacccatttcctggtgccagactctgcaagcagcactaccagggtaattagatcgatgtcttcccaagtgtgtgttgtcttagagaaggtcagacctgggcaggtccctgatgcctttcacttattgagttcttcccatccttcaaggtcagctataacccagctcctctgcgaacccttccctgacctccacagcctcagtccacacagctttcccctctccttccatcccatttccttcttcaagctgggcattgaggagcatccttggagacctaggacaggtgaggacaggagcccatttcagctgcatttccacttatcaccaggaggtggctcagagtagcaagtgcctatgtcaaccatgatggaaagaacttggaaaaggagtagggaagttggagactgttagttcctttctggctctgcaggccgcttgtccatggcgctagcctgcttcattagtcctgtctgctgcagggccgaggaggaaattctgatgctctcagtgagaaatggtggctcagggctgcagaggagctttaggaggactctgagaggaaaaggcccagaacggttaagctacctcctcccgccacatggttagtttgtggcagggatgagaggtgagtcctggtgtcctggttttcagcctgctgtactgtcaatgccccttcccgccagccagggtcaagcattcactccagagttcaagccttcattcagctatagcatcccaggtgggagtgagggagcatgagtgaggagcctggaggagaatgagccagagttcctgccctaagggagccctcaaagtgcctggggagatatgacatgtggcttgggccaagtggagaacactgtgggcagcacacatcagaacagaccaaggctgaagctggcacctgctccttggaggaggcttagggaagtaagtggattggtccagtttgagaggacaacctctgatagactccctcctcttaagctgggaggaactggactacatgaatatttatggaggggtggagggtgatggagacgggccacattttgacagcaatgctgaccctaaagaataatgaagggctggtcaaggaactactagggtgaggggagaaactccagctggagtcactcctcagaagccacacatctggctgcacatctccctgagtggacggcatcagtgctgctgctcaagttcctgtttggaaacccagagcccatccctgtttgcctgtgaaggtgccaggttcctgcagaaagtctgcttataaaggatttcttttgaagttatgtttgtgatggtctcatcaagaaaactgaggaaggaacaggagccacacatgtcatttagctgaaagtcctgttttaagaaaacaaacgcaaggttgtattcatgagcaactgctaaccacaataatggaagaagcagttaagctaataagatataataccccatacttcatgtagtaaccttgggagaggtaggccagtgggcaggaagccccatgtctggtggcagaagcagggtgggaaggaaactgcaagagaactgagccttggtcactgactgaggatgttgcgattcacacatcctgcttcgtggcctggattgtctcgaactgggttcttccctagcaccagtaacccaagtggagacctagcagcagccaagacatgttcccaagaagggtcactttcactgcaaaatgcctatctccaggagaagagggggagtggactgagagaagccagggagagagaaagggcagggatttgcagtcagttgtcctgcctcagggattagggttgacatgaagaactgcaggttaagagtgctccattaaggaagattagataaactgttctcaccactggggcagttaaaccttcccttgagtccctttggtaaggtgccctgaagatgcctaggcataatgtcacaaacccagctgaaaacgaataccacaaagagaccctgtgactctgaaaacagcaatatttgcacttaagattcagcacctggcttactcctgtagtcctagctactagggaggctgaggaaggaggatttcttgtgcccaggggtgaattcaaggctacagtgagctacaattgcactacggcactctagcctgagtgacagaacaagatcccgtctcttaaaaaataaaaataaaataaaaaaggattaaactcctggattgaaattcagatttctggattccatatggtttatccactatcttccttaagagggccatcaccactggcttgtgaggcagggccccttgttctccaagccaggggcactcgatcttattcatctagcaggaacccttagttgttctggtcagtgcctgcttctctgagcctgtcttggggcaagcctaggagcagggccaggacgagcatgaggtacctgcacctatgatgcaaaactgaaggaggtgctcactttcaggtcagcgcaagggtggagcctgttcaattatttgcatgtgagagctattagaaaaaaacaactcccaatgagatagaagagttcccctggtagcatggtgctgtttttagtttgttctgttgttttgttgttttgttttttaaactctgtacaaccctcctatttggaggacctgccaccttccttccgactcaccagcagcaggacacaaactctgaaatggcttcccggtattgggagtgttgtcagccaagattatagtaaagaaattggaaagggaaaggggattgaatggttcagtttcaccggggatggggaggaagacagataatggaaagggtgaacagggaagaagagcagaggctggtgagtcagatagaagcagctagttagaaaagactgcttagaagctctttcgttatgttgttgtgtgtgtattagggccttagggttacggagtgttcccaggcgatcctccctggaggacctgctcctctttcattaggctgctcctgttattttgcttgccagatgcttccagctggcagtagttggttctagacatttgaagcctattccaagactcaattcccaggactaagaaactaggaagccggaacctgcagtggttgctatgcaccatattcagttttacaccggattcagtcatttgagagaaatgtggttgccttaagtctaggctggatggaatggttcctgatggcaccctatgagtcctaagtgagtgggcagagtggagtgcgggtgggtggcttttgccaagacatcaaggatttgaggcctaaaaatgcaaacaacttgggaagtaatatgcaccaaccagcctgagggaagggaggccagtgccaaggtattggcttagtgtcgcagggatcctcgataaaatccccaatcgccacttgggccttaaatccctgacactgccaagaattgatttttgtttcttatggaagcagtcaaaatgaatacattttcagtatcattcttaggagaggcatctcaatgtttctgagccgctttctatgagatggactgcttagctgctctaaaaagacagaaatatctccatagcttacactgtacagtttgcattatctaagtgtatttaaatagatgagagagacactttcccttttgcatgtcaaaggaggcaaaaggaagttttctcctaatttcagtcataatttctgccctgaggaaagttataatgttctactgtatggatacaccacattttgcctatccattcatctggagatgtagacacttgcgttgcttccacattttgcctattgtgagtaatgccactaagaatatgagtgtacaaatatctctctgagaccctgctttcaattctttggaggtatgcccataagtggaattgctgaatcatatagtagttctatttttatttctattttttgagacagagtctcactttgtcacccatgctgaagtgcagtggcatgatctcagttcactgcaacctccgcctcctgggttcaagtgattcttctacctcagcctcccaagtagctgggactacaggtgagcgccaccatgcctggctaatttttgtattattattatttttttagtaaagatggggtttcaccatattggccaggctggtcttgaactcctgacttcaggtgatcctcccgccttggcctcccagagtgttgggattagaggtgtgagccaccttgcctggcctatttttaattttttgaggaactaccagactggtttccatagctcaaggctgctcctttaacaagctttccccaaagcctcaatcagtgagtttcatttccatctcatttgccacactgggtcacgtgactgcctctagctgcaagggggtctgagaacccacgtattttcaactaggcatagaacttcttagaacaaatgctacactctgttggtaaggaagaagtagagaattaattttagtggacaactagcagcctaagggcaaatgagaacactgaagggcttcaggtaagcaagagacattgtgggaggatttgcgctttagaaggctctctctggcagctatggactgaggagtcacagtcagcagaattagttaagaggcttcaacaacaatccagtgaggagtgatgggggttcagatgaggatggtgtggcagtagggtattcaggaaagggagggattcctaacatattctagggcaccccttcaagcctgcctggatattggcagtgggaagtggggggaagtgggagggaacgagggatgagtccaggttttgagcatagtccttcctgtatatctagaaggggaaacaggttttggggacatgtgataattcaattttgcacatgttgaatttgaggaacctgcaggatggtaggtagataaaaagtgggataaggcttgtcccaatctgggtcttttgggattggtttgtgacctccttggggaacttgaagcaaaactggagatagcacattctgagtcatctactactgtgctgacctaggaagcaggttgtggggaggtggggggtgggagggatagaggtgagaggggtagggctgctgtccagaaagaatgcatgaagacaaccttccatcctgagtttttctggttctgacgggaatctctgtgtagcacctccattcctgagttcccagggacaatcaggcaaacattctctgaaccaaggagacccctgcatgatgggatggtcattctagctatctgtgtccagatccaagtgtctgagtctcagatgagctggtcctacacatgtgctatctgtgccctgcccaagctgtttccccctcctaggggatcagagccctctcaatctgctgcttccaggaatgagagccaatacacatttccttccctcctgacctctgctcttgaatgattattttaaaatctccccccatagacacactataaactgctctgtgatgttccttcactgtccaccatggctgagtcatgccagattataaatcccttaggacaggaccagcgtcaccaccgcaaggcacaaggcacaggactgactctttgtgaagggaaggaaagtaagtttctctagatctgttcaatgccacctccagggtcctgcagcagggctcctagctccctcagcccaaggacacctctccatgtgatgctacttccccaggttgctgggccaactggaggctactcatcctgagacctgtaaggccagacccaggctggacgaggctggtcagggcctggcagggcagtggggagcagcgtggaatggtccagagttcctggaggtggtcagggacaagacagctgggcctctctgctgtcatccctaggagcagtcagcaattacacagacacagctgctgtgtgattcaaagacacatatgcacgtagactcaaatacagagttgcttgaatgtgttcacaaatatacacacccggccgggcgcggtggctcacgtttgtaatcccagcccttttggaggccaaggcgggtggatcacaaggtcaagagatcgagaccatcctggccaaaatagtggtgcgcacctgtaatcccagctactctggaggctgaggcaggagaatcgcttgaactcaggaggcggaggttgcagtgagccgagattgagccactgcactccagagccagactctgtctcaaaaaaaaaaaaaagacaaaaaccccccacaaatatacacacccatgcaccaccacccctacccatacaccacacgcacacttaaattcagagggcaaatcccggttcctcccttcatagctatgtgtccccaagttacttaatctctttgtatcttaatttccttatttccgatctgtaaaaatgagaataatggtattcacctcaatgagttgttgtgaagattaaatgagataaaatggtaaagagcttacaacagtggcaacacatgcagagagacgcacatgttttcatactcatttcccaagccctgcccagtactgccactggcactggtggtgagcctggcagcagtacaaggttggagtcccttcatccctttgagccttggttttctcatctgtgaaatgggaataataatatctagccggcggggctgtttggaggaactaaagaggcccagcatggaaagctcctaacctaactctggcccacaaaagtctccctacgttttagctgtcactgtccctgtgaggaagaacagatccaagaacaggtgcagggatgggctgcaccacagcaaaatctggacaggcccgacccccatctcctcccaggctggagcggggccctgtaaggacagagcccaaggccactaggtgtcaggcctgttggagccaagtccggccagcagtctggggtggggctgggggcagggctggtcggatggccgtgggtggaaggaaaagaggaaaaccagctcagtggaaattgtcctgcggttggctcaggcgcccacgacactgtatttatagagagctccttgcagctcttaattcctcgcagtcgagttaaccctttctgggctgtggtgccagcatggtgtggaggaagaacccaagactggggttggacagcaggattccagccctgttctgccgccagtcgatgaccagtcagtcacctatcccctctcgcagaaaggaagattcggctcttggaagtgtgggaacggggtgggggatgggcagcgccctgctccgggagccgagggttttccccgccagggtcaggcctgggggcggggcggggcgggggcgggggccaggccgtgtgctctgcccagcgggctggctcaggcctcggtcagcagccgccaccgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggtgagtgctggcgtggcgcgggcggcgcggggtggggcggcctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagcagggcgaaggtgtgggcgactggtgcacttccacaggcagccgtgggcagcatgaggggtcagattccgggaaggacaggtagagacggctggcaggggccacggggtgaataggtgttgggggtggggagggaattgggatgggcagtttgggcttgggaagcctcagggaggtggggggtgaggtgggatggagaggagatgcgggcgacggtggagggaggtggggaccccgagtgggggcacactagaagggaggggattgaattccagcgcccagggccctccctgcgaccgtttagctagcgaattggcaggtttggcagcctaaggcaggggatttatttctaagccaaacctgctctaatgagaaaagcgtgatagatgactcagatatgggatctatcactgagggaaaacattaagcaaatagtaaagcaaaaaagatttgtgtgtgtgtgtgtgtgtgtgtgtgtgtgtgtgtgtgtgtggcgggtgggggggtgttagttgtcttaatttagaaaaacgatttaccttcaaattggatgtggataattgtaaatgagtctgatctcttcattaaagcccggggtccttttcttataagcatgtcttcagcagttagtttctatattagaaagtaatgaagctgctttgtctttaagagagttctttatttagtgcggcctcctctagttccctctggcctcccagaagtccctaggaaatctgatgctgtgcagccttccttgtagtgtgggggactgcaaataggtgggacagtttgaggctgaggggaactgaagtctaaacttgaagtctaaacctgtccgatgggttgagctgatctgagtgcagggcaggatggagggctatggggctgtagggtatgaagtggctcatttcaagggagtattttgggtgagtacattttcctgatatctggagttcttgagattaagcactaacacttagggtaactgttgaccgtggaaatttacatacgtcaccgtcagcttactggagtatcctgatgtgaatgaaattttccttcatgactttgggtcagccctgtggacctcagtttttgttctgaggggttgtatggcaaggggacgctggcgggagagagcttcgttcctgcattaagtggcctcagtgatgcagtcagggtcccatgactgacctttggagttcttccatgtccttatggcattactggtggtttctcctgcctgcagtaagctttccagcttactctagactcctgtgctgtgagacatgagcttgtcagaggtaaggagcctgtgttaatgcaagtctcaggtgagaaggggtgttggaatctgaggaccctgttttccttcctgtcccctcttcagctctgtccaggcaccacccgatggagggttggctgaatgtctcatgttcatatacctgacagctggcttcggtgctttaatatttatggaaaggacagttatagaagtgtggtcccttcaaagtagtcctctggggtgtctgtgtccttattaggttgacttctgaaacttcctgtgagaattccatcattaaactttggctttctctggaggggtaaatctttgttctttggagtaggatttgagtttgacaaggagctggacaatgctgtttggagtcagagatgcagtgtgataagagagctgtgagttggaattccacagcacctaaagagactcctagaaaatgttgtagaacaagtggctggatggtacttggttgcacatacggggtttggggtctgtgcagaaaaatgaccaaatccaagcagcctctgagattatgaccacatgggggctgttaagctgtggatctgagtcatagggtcagggaaagaggaaaaatggcaaggaggatgacgttactgcccatgagcttatcctctgagtgggtggcgacttctcattgtccttttcccacatccccagggcaggagtgttagggaagtccaccagcaaaagggggagggcacacccagggcctaggggagggggagaggggtgaggactggtccacatgatttttgagaaattgcctttggtcttgttggctcagaatggaccccacacctggaagggggccacgtgtacagttatgcaacccttgcctgccacccccagttctaccgcccttgcagtgtgccagataggagcattgggttttcaggtttgggagtgggtagggttgtgctggaggctaaatagacattatctcatgtaatcctcatagtaatcctatgaggtagggtatcattaacaccattgtacagttggggaaactgaggcccagaaagggtaagtcacatgcccaaagacacacagccggcaaatggtggagctgggctgttgtctgcttccagaactggctttttctgctgctctggaggtaggcacaggttttacccctctttctggagcccggtaagatgtgccaagggtctccttagtaagtcagggaagactcatctggggaaccagagaaggggcaggcctgacctgggtgacccagtgactagtggccttcacagcatagtcagggcctttgctgagagttcttctcttccagagccctggactttatcatgctggggcttccaggagttccccctccaccctccagttctgaccagtgctcccagccagctgccccctttctccctttctttctctttgtggtccagagaatgaatgcctgctccacacaccttatgccattgggaatctgaccttctctaggcatagggagcttaatctgcgggaagtggagtgagaagcatttcttgctgggagccttggagcagggagagatactgtctctgggaggcaggggtcccaagttaccctagaggcaatgcaggctcctaggaactggggctgccttgtgggagacattggaatgtgtccctgtgggaatgctctgtgctaggggctatggcagcaggacggtaggagctcatggtacttggaactgtgaccaagcatctgcgaagaggaaggggcccaggaccactagaatgagtcagagccagagatggagtcgagttgtgcatttgctactttggagctggggcactgatagggctctaggtgaaaagtagggatacagaaggagtaatggtcccagaggcccagatgtgtggcctgacagaggaggtcttggccagggagagtggggtaggggcaaagtgttcgctcagtgcagaggccccatctaggaggccttgtccccatgcttgcggcaataataacagcaataataataattattactgcagttttggtactgggcactttcctaagtcctctctctctattgtcttattttattctcacagcagccctgtggggtagggattgttacccccattttagagatttggaattgggtctcaaataggttaagtcatttaaacttggtcatgtgttcagcaaggcatcggtgtcaggattgaaacccaaggctgctggcttctgagctcatgctgtaccctgggcaggcaaggcagcctggtgattccattcaataagtgaggaagagagataggagcatcagctggctcttagtcacttctgctggtggctgataattgagtgtgggcccttggccagccggccaccactctgggtccagatttccatctgtacaatgggcctggagctaggcgctggaccaggtgtaccgtaagaggccttctagctctgaggactggtggagattgctacactccgagaggggtctggtgcttagatggagaggggtcggcagagttgttctgctaagctgagcctctttcagggtagaaaccaaaggaatttggaggcaaggaggcatttaggcagatcacatctggagaaaatgcacccttccttgagtgcagtctggaaaggcttctggaaaggataggatttccagatatgtttaggtgggcacctagcaggactcagcagatattgagtgaatgcagatgtgtgtgccctgggcctgccagtgtctgacccgaaatctgcgctctgatgtggtctcatgtgctctcatccctttccttcctctccctattctccttgttgccatcccttcttttggctggacctcctctgggcccaatgtagctttcacttttttcagggctctgtgcctcctgtgtgtgtgtgtgtgtgtgtgtgtgtgtgtgtgtgtgtgtacacatttccacatgcatgtataggtcagttttgcagcccctgcacatgcctctagttccagggagaccttagccctgctttgctggccagccctgatgacatactactgtcctgactcacacagaaatcgcttggagaggaagaactgattcctgctcttgggtgggatcacgggactggggagtggtgcccagtggacagccttgaacataaaaggcccaaactgactcagattatcaggaaaaaggaaggcaaacagggaggctgttcccagggaactctagggaccctcccatctcttttctgaggctgctgcccatttatagagcacctagtattaactaggtcagttttgataattttgctcattgagtcctataatcatcctatgagggtaaggtttataatccccattttacaaatgagcaaactgaggctcagagaggatattttcataaagtttcattactaggaagtgacagagtctggatttgaacctgtctctccaactccaaagtcatcttcttaaacactagtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaagtgagtgacagagcctggtctaaagtccaggatatctctgttgttgctgttttccttttttcgttaattgcaaaagaatttacatgttcatagttaaaaacagagaagtgtatcaagtagaaaacagtagcaaactctcacccttattctgacactccagagttgcattcactctcaggcatccagatcctttccccatatacaaacatccatccatccatatatctatccatctctctatctaaacacacatgcattcattcgttcactcattgaatcgtgcattgagaacccattatgtgccaagccattgctagaattaaggatgcaatagttaaataaagcagatgtggttccttctcagggaggttctcatatatcatgaagaaaacagactgggtgcaatgaatgacagggtccttcttagagtggcagatctcttacctggcttttctgtcaaggtgaccctcagaatatggaggtgttaccttttatcttagtccatgttttactgctataacagaataccacagcctgggtaatatataaagaaaaaaaggttatttggcttgtagttctggagactgggaagtccaagggcatggtgctggcatctggcgagggccttcttgctgcattatcctattgtggaagggcatgtgagcgtgcagtacagacagtatgggggcagcacttacgcttttatcaggagcccacttttcctgtgataacagcattaatctcttcacttcttacaggccccacctcttaatactgttacagtggcaattaaatttcaacatgagtcttaaagcacccatgtcatctaggaagaagaaactgtatttgcagcaacactgtgaggtaggaaagggagtcctatgttgtaggaactggaagcagcccactgtggtgaggggcaagtaggaagaggtgaggctgggcaggtgggcagggccagggcagatggggctctgtaggctatggaggagctgcgatcttatcacaaggaaagtgaacagccctatgattaactattgaaggcagtgatataatttatgcttttatattaatagcaattattctggctgttgtatagagtatagattggagaacagaattgggtgggggaactagagaaggtgaacagactggtgaagaggcttttatagttatccaggcaagagatgatggtgacttggaagaccaggaagagaagcaggggtagagagaaatggagatagtgaagatatagcagacatatttgaggagtccttcagttacagataatagaaaactagctcaagcacatttaagaaaaaaaaaaaagacttgtttaagtacctaggcagtctatgtgtgcagcttgcttcaggaataggggcttaaatgatggttttagggctctatatccttctagcttccatctctgcctctgttcatttgtttggatcaattctttagattgttggtagcagacacatttattgctaacagtcccagaccgtatccttcttagtaatctcaacaagaaagagtcttttttgatggctgcagcagcaaggctctggggaagtctctgattgggtgtggcttggcttacagctcattctcgaactaatcactgagtgggggcagggcaggtttctccatgagccaggtcttgtaacatgcccaggccctaggctgggaggacagctccaccagtacagcatggactgggctccctgcaggagtgcggagccttgctaccagaaggggccagcatagaccaagagaagggcactgtagaataaaggacatggagcaaaataactgtgttaagactagctaccaaagacggagacgatctgctcggcattgaatttgcctctttgtcaaggaaagaaggagcagaagatgttaagaaggaattgaagtttaggccatacggggaggtgctcatctgttttaactgtatttgtcttctggcccctgggattgcctgtcctggtgtggggtgaacttggagacagaatctctgagaagctgtcagggatatttcaggccagtctagggtagaagagggttggacacgtgggtcacagtattccacagtttcctgctgtgcacagattcaatccgagtccccatctacgtccctcactacctcccttgcctcctctcctgagtctcagcctctcctggagtcccatcttcccagaatatgctgtggacatctcctcttctgtgacttttcatgctgtcccctccgccagatagccgagatgtctcctcctctgtgcagtccttactgagcctccccagcccccagtgaatggcttgaccctttcatccaggtttaagcctactgcctcgtccattcccacaataccttgtataaatgtgtaccaaaaaactggtcatattctattttaatgatatatttgtttcctaaaccttttttctatttttaatatgaaaatgtgggattttaaatatgccatttagcagctctgtaatcttgagcaagttattaaatctctccatccctgaatttactcctcggtgaaataggataataatagtacctacttcacagaattgttgggaagcttaaatgagttaatatgtgtaaaagcatttagaacagagcctggtgcatggctttcaacaaaactggcctatgttattattatttgataaaagcaaaataatatatataacatgggtaacttttgaagcataataataaacatacctcccaacttgagaatgagaacccctgtagttgaatatttatatgtacgattcttcatctccattcatattgcatgcatggccaatgcctggcatgtggatcatgaataagcatttgttgaatgaataaatgaacaaatgccagaagacttgagacagggaaataaccagttttatggggaagatggtagattatgggaacaacagatcgataatcttgttcttaatccttgacaaagtcctggaaccaatgagcacttgaagaagagcccactagtaggcacttgcatggcttcactggggttttgaaaatgcacttcttttcttgttcttctccagttgattggtccccagccagaagcagtgaagcttctcatgacagccctggggatgagatgggtagatgggagctgggtagcagcacaggtaggaacactcctaaccccggtgtactgaatggtggatggacattgatcatccagggacagatggtgctgtgggctttcctattcctgtcctctccctgaggaccttgatgacacccagacaccagcagagagaggagagtaaccttttcagatgatattcattcattctttttttaatccaccaacaaattattgagcattgtctatgcaccagaacagtcaaaagagtacttcaaaagatcacgacagggttacacagcattgtaaatatagttaatgctgccgacttatacacttaaacctggataaaatggccaacttcatgttatatatattttacaacaatgaaaaaaatgttgtggcagttggaggaatggactcagtttaactgggtgaaatggaatagtaacaaatgaaatatcctgtaaaactcctccccattctgaactccatcagaagaggatggcagaggtgtggattagcagcaatgagtgtgagtgacttctgatggttggctacagatttgatagtctgttattttgggttattttggtgaatggtgtgacatggctgctcaatggtgacttcgtcaaggaagatcaaatacttgcagggctttgataaggaagggggcagactcattctgtgtggtccaaggggtcacatgaggactgttgtgggctgtattgggagacaaatttgggctaagtataaggtagagcttctcaccgatgaacgctgtccaaaagcaagtggatagcccatgcaggccatgggtgcccatcacgggagggcaaacagagattgtgtgtatgcggtgggtggggggaggggcagggaaaggttccctgttctgatacttgatcattaatttctgcagtttccccagaatttgttctcatggcatcatctccctcagtgaccccacctttggttctgtcaccaccactgcacgaatgactgccatgtccctctgttctgagctgcagctcagtgtgtctgggagtccataggacattttggtgtggatgatccatagtcgagctcagtaggaactgatcttccccctccacgtgcttcatctccaggtctccttgttatgtgtgtccatgtttgcccattgctcaagccttcagtgccctcttgacaccttcagcccctccctcaatacaaacagtccccaagcctggtcacttctacccttgacatttgtccaaagctgggctcaggcatcactcggtgactctgatgagatagtctcctgttcgtattttgagatacctattttagatgtggtttccttttgtggctctgagcagtggcaatgctcatcgggtacggagacggggaagagaaggagggaaagtaagggtgggatggctccttagttagttcagatgctgtaagaaaggcccaaaatagcaatgacttatgctggaagagatgtttatttctcacccatgtgaccatctgggtatatccagggctgatactacagtccctcagggttcttctgtctgctgctctgccgtcctcagggtgttgcctttggcagtatgatcgccacacacaccacatctatgttccagccagtgggaagggggaggggaaagggaggggagggcatgcttctctctttcagggcatgacccagaagctgtacacatcagtgtacacattgcatggccacactcagctgcaagtaaggctgggatctgcagtcgttagctgagtggccgtgtgcctaactaaaaatgctatggaagaaggggagagctgggtgtgctggcagcacctgtagtccctgttactcgggaggctgaggcaggaggatcacttgagcccaggagttacaagggtgcagtgggttctgattgcaccactgaactatgatggtaccactccagcctgggtgacagagcgggaccctgtctcttaaaaagggagaaaatgggtgtaagtggacaacaactagcagtttctgccacagtcactttgtgcatttcagtgggaactgtgtggctgtgaactggttaagccttaaggatatagtccctgaaagcttcaagtactgataaagttccactagcatccacaaagcttttcttttataggtaggaacactgagctcagagaagttgcctagttaagattgcataacaaagtgtcagagctgggaccagaaccccacactttgggctcattttctagaattccagggtgatctggctgaggggcagacaggcagtgtcaggaggacgggtctctggagttcaggaaagggttacctttcccagcgcggctacctggggagctgctcatgacttttcagggatcatctctggggttatcatgcctctgaggtgcctccaattcgccctgaccatatcataaatagtatactataccaaactgcagtgatctaactgcatgtcccccttccctattagaatctgctccttgaggacagacgtgtaccttagttatctctctgcccctagtacgtccctaccaggaactccgtaagtagtgaaatgaattactaaagacatgaatgcatgtggattcaaggactccttcggttgcagacaatagaaacttagttcaaactggtttaagggaaaaaaaatgattggctcaaatatctgggcggtctaggtctgcagcttgcttcaggcatagctggatccagggacttgtctgacattttcagaactttgtgtctttctgaccctttttgtccctttgtgggaagtgttgcccaaggagcccctgcggggattgggaggaagtagggggttaggaggaagtggagtgatgtgggtgattatggtggggggcaaggagaccctcttgggcatccccaggcccagggcattttggccctgagcccaggtgcagtctggatttgttgtagctttctgagggcacatcttgggtcatctcttgggagcctccctgtggccctgcttctgcagggttggatgcccttgctgtaccttaggctgaggacagcctgacccctctctcctgctgctctgtgaaagccgaaggtgctctgtggttttgggatagagcaggaaggagaaggacgaggagtgggcactggcaggtgactcaccgggacgggtggcacatgctgactccagggcaggtcccggctggggatgagattcccctttgtggaaaacatgggtggagggggtggtacgcaggcagcatgaggcctgcgtggctccacgtggctctgggtcccgggccgaccagctctgtgttcacaggacactctcccattctccagggagcacttcctttctgagctctgtctctttctcctgtcctcagctcctccaggcccagctgtcagcgtaggggtctctgggtgccgtggactcttctggtctctttgcttctgggctgtcaaactgcttctctccagggcaggtttccaggatccagagtctaggaaaggaatgaaagggagcaagtccagggcgcagccctggaagtccctcatcttccctctggagggaagcgcagctcggccctgggagagcctgggtaggtctgatcaggggaggtgccctctgctccctgtacctgcccagagtggcaggaattagcctgatatatgaaggagacaattatatgaagagtcttgagtaccaggcagaggaatggggtctgacttctatagtgaatggggagccatgggaagttcttgagcaggggagggacatgagcagattcctgtcttaggtcctaagagaaggcaccttagagaatggggctggcagggaaagagaggagcaagcagggccagtgaggggggtgatgggtcagggtgggagatggaagcttgagaagcagtgtggagagtgagggaggcggcccaggaagaacccacaggccttggttctgtctggggttaaagagaggcagggagatgtggaatctgggcgttcgttcatccttagccctggtgcttcccgcaggggttgggcaggtcctgcaggcagctgcctgctggatcttcctgtgggcctcagggtggcccttgtggggcaggatgtggtgcctgccaaaggtgctttatgaatggagccggggaaggctgctgactcagcaggcagtaaggctttgaggccggaagcgtctggaaaggaagtggctgctcagggcttccccactgtagacagctgggagagaaggggggctggccaggatgcacatggtttggctgagggactcccttggcccagctgctgggggtgtgtgtgtgtaggagtggagggtggcggggggcgggtgtgcctggctgggattggaaggattgaggctgggcgcctggaatggaattgaggctagcagctgttgatgaggtttgctccgtggaagggtggaaaggtgtagcagaattggactctttttggctgtgctgactggcaaattacttgacattaacaaagtcacttatctgggctttaatttttttttttttttttttgagacagagtcttgcagtatcgcccagactggagtacagtggcgcgatttccactcactacaacctccgcctcctgggttcaagcaattctcctgcctcagcctcctgagtagctggtattacaggcctgagccaccacgcccagctaatgtttatatttttagtagacacagggtttcaccatgttggtcaggctggtctcaaactcctgacctcgtgatccacccacctcggcctcccaaagtgctgggattacaggcatgagccaccacacccagccatgggctttaattttttaaagtcctgcaaaaataggaccaagtgttacagcctatctcccagggtattaggaggacgtgaaatcatttctattcttgttgatcagtgttggttggcatagatgtggcttgatcaggacatggcacaaatgtttaggcagcagctgtgggactcagggacaaggtgtgtgcagcctggagggtggctgggattgggagcagggctggatttagggatgtctgcccttctcatccccagctcaggcctgacctgcagccacagacttgcctcttactcagtcctgactccagccttgaggtcatccccaagtccttgcctcttccacttctgatctgtcttggtcactcaatacagatgtgttaagctagcaaatgttctctctctgcattcccacactcatacacctagtcgcctcctaaaactctgtcctagaagcttctttgcaaatactgctgatttcacacaagctatactgaacccttccattttctctgcctcagtgaatgctccaccctgtcactgaggctcaaaaccacggccaacctgactgctctttctctctacccaagtcctcagatactgtcacttttacccagacatgctttgtctcctgtctggcccttcatttattccaccactataccttcctacagggatggctatattagcctctttttttatttttattttttgagatcgagtctggctctgtcacccagtctggagtgcagtggtgcaatcttggcttactgcaacctctgcctcctgggttctagcaattctcctgcctcaccctcccaagtagctgggattacaggtgcccaccaccatgcccagctaattatttgtatttttagtagagatggggtttcaccatgttgttcaaaccggtcacaaactcctgacttcaagtgattcgcctgcctcagcctcccaaagtgctgggattacaggcatgagccactgcactcagcctgaaatagcctcttaactggcctctcccttgccctgatacaatccagtctatgctgaggagctagagtgggttttaaacattgttacctagattatgtgtgattaaaatgctccccagtgattcccattactcatagaaaaacccaaattcctcactggtctctcaaagccctgcttgatctggctgaaacataccctcccatcagatagcgggtggaggtgctgtcagattaatcttcatgaagctcagctctgaccgtgtatttcccttattcaggaagcttcagtggctctcaactgcctttaggatacatttcacacctgtcagcccatctctaagtctggcccccacaggagctcctgctctgccctaccagctactgtctgccaaattgatctgcacacatcctagccccagagcaagccaaccttgccttcacttgccgccttgcctcctcttccttatatttggatactaacatcttagctgaaagggtggatcccagctgccccctaccccatcttccctgtcaggcctccccagggactccctgccaagcatctgtcaccaagattcctcagcagggggcccggtgggatatgggaatgaggacctcccagtgggcagttgcagccttccccactctggtccaggagagatgaggcaagagatggtctggggagaacctttggagacaaaggccttgcgtcctctttctcccaggcaggggcagccttccaccacggggagcccagctgtcagccgcctcacaggaagatgctgcgtcggcggggcagccctggcatgggtgtgcatgtgggtgcagccctgggagcactgtggttctgcctcacaggtgagggtagcagcatggggacgggaggggagggacagtgattgtggcagttggggagggggtgcccacgcctgttaggggtcctgccaagccagctctggctagcagggccataccttacttccacctgtgggatccagtaggcaactcacgttactgttcttagcctccatttccttgtctgtaaaatgggaacatgagtgctaaatgagatcgtgctatttcttgaatacactgtgtgcgccccctcccaggacctttccacttgctctttcctctgcctggaactttctgcccctaaacgtctgcatgactggatcccatattttgtggaggtctttgctcaatgtcacctcctctcaaggctctcctagctcccttgtataaaatagcacacctccgctcctccctccctatccctggcctccctgcgttattctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggtttcaccatatctgctaggctggtctcgaacgcctgacctcaggtgatccacctgcctcggcctcccatgccgggccttttcccctcacttctgactcatcagcaagtcctgttgattccctcctaaataaaccttgaatctgatccctctcttcttctctactaccaccctttgaagccacaccaccctcacctcttacagggacagctgaaaccgcccctaactggcctcccccttgccctgccacagtccagtctccacagaggagctagagtgagttttaagcattgctactcagattatgcgtgattaaaacactccccagtgattcccattactcatagaaaaagttagattcctcactggtctcttcaagtcatctttggtctgggtgggacatgccctcccatcagatgtgtctgccacactggacgctccccgatattttcacacagcaaggccagtcttgcctcagggccttccacctgctgtttcctctacggggttctctgtatgtcagctctttttcattccctataaatttcagcttaattgctttaaagagcatgtgcctcaccaccatatttaaaggtacgggtattctttcttgtataaaaacaaatcgtgtttcgttaggaaaagaaaaaaaaagaaaaaaagaaaaagcacttgtgattctctctcctccagagaaaccactattgacatttttggtggatacttttttggactccccaatttataacattacttacgctcatggggaaatgcacatggtgcaggcaggtgtaaagtacctgccagatttttgaaaagctgttgctttacttactaacctgctggctccttttcctcacataccttagtcacatgctgacgagaatctgtgtgcccatttgtctctctctcccattaaaatgtaagttctgtggggatgtgaccgtagtattgctctctgttgcatttctgacttttatgcttggcacctgtaggtgctgactatattcttgactgaatgaggtcctaagacaataaattactttgggtctcaggcctaaaaggaggggtggacagggcctggggttagcaggggcagggagcgggactagggaggcccacccctcctcagtcccccttatatgttctccactccccctacccccaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccggtgagcaccaggagggggacgccttccccttagttcaccctccattccccctgcagcccaccccctgctgcaccactgctcccagaaccccagtgctgattcctgtactcagccccatgcatccttttcgtcctctgccattgccctgcccttgacccctgccctctgtcacctccagctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtcagcagaggggtgggcgaaggaaaggagtcctgatggcaggattcaccagggctggagctggtgagagtcacctgccccaggcctggccctgggattggtctggtcaggccaagacccacctgctgtgattgttctcagaagattggggagactccatatctgagagtcctcagacttaatctgcttttgcatctaagaagaaaataggaagatggaacagggtctgggaattgatgggggaagagtttgggggactcgggtggtagcctagagagtcccatttctcctcaccaccctgcccctctgaccccgcccccaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccggtgagcaccaggagggcgacgccttccccttggttcaccctccattccctctgcagcccaccctctgctgcaccactgctcccagaaccccagtgctgattcctgtactcagccccatgcatccttttcctcccctgccattgccctgcccttgacccctgccctctgtcacctccagctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacaggtaagggcagatgaacagctggggaaggacggagcgagtaactccctctttactggaccctaacgtggaatttccataggtttgggtggccagaagactttcaaaatccctttcatagacttcaggtgctcacactcttccccacaagtccttaagggactcgagctgataagaaccatttataatgtttgccttcctaagagtgcttttcgtggcacttatgcttcttatgcagaggacaaggtacctgcccgaaatttggaggcatgggcaggaattctggggcagccacaaggtgtggcccaggggacttggtgtgggtgtgctttccagcaggaactcctctgagtggtaggaaggtattctgggtcagtgggcgccatctgattctgaagcctgagtgacagctggccctccctagttagtccccaacacctgagtcaacgtcagctcttcttcctgcagacttgcgctccacccaggcagccgttggatgggcaggggctgtctctgctgcccccgtgtggtcaaacaccagatagaggccacccctttagtgattgttagtctctggtttccaggttctagcctcgtgggcacctcttgtgcctgagggtgtgaagagggttgaggtcaagagccgcagtctccatctgtgtttggccctgagaggcctctggtcagtcacttcctgggccgacgtgctcagtctggctcttcagtatctctccctggccaactgagctttcccagggacctcgccctggtgcacagtgaggtcaggacagcaggttttgtctgtctggttctcctcttgtcttctgatgacttccatctgcccctcagcccatccaagttctgatctcaccccaagtttccaggtctgcatgcacctcaggactcacttattcctgtcctctccctcttgagacctatgtggtccccacttctgacaagctcggagccagggcccgtcacatcgtctgcttggagttcaggctcactcctccttctctcttacgtgtttccttctggcaaggttgtgctccttctgcccaccccttccccaagatggaaaacactcccttcctgtgctctccaggagagagtagctgccctgagctcttgaatgttctgagacatgtccttgaccttttagagaacagcatatggtttggtggtgaaaatgctgttcacaggcgaaaagaagaaatagaagatagagtgatcttggcagaggatatgaagctttcagaggagggagggtggtagtgaggacacctccaggggcaaatgggagctgagaaggccttgaaggataaggggtctttgtggtcatttgcaccctgggctgagctggatatttgcgatgctgtgcagaaaggacttatgagtataaatgtgattgcaaagagaatgtttatctcacctaagagaaaattctctattttaaacttgagtagctaacatttaaagtgatttcaaaaaaatttagggctgggcatggtggctcacacctgtaatcccagcactttgggaggccaaggcgggtggatcacttgaggtcaggagttcgagaccagcctgatcagcatggtgaaaccctgtctctactgaaaacacaaaaattagctgggcgtggtggcatgcacctgtggtcccagctacttgggaggctggggcaagagaattgcttgaacctgggaggcggaggttgcagtgagccgagacagtgtcactgcactccagcctgggtgacagagcaagacactgtctcaaaaaataaataaaataaaaataaagtgatttcattgaggccattgttgccaagcacatttcacagacgaagaaactgaggtccacagagaagggggaactttcccaaggtcacagactggcacagcggctctcaatctttgggggtcagacccttctttgaaaattggataaatgatcaatgcagcagtttgcacataactctggagggttcgctgcctctctaaactcctccgtgggtctgtagacctgggctccagtgccctgcagtgaggagatgagccatgatcagaatccaactttggcctctcagcctaatttcctctccttcccaccagccagcctcctgtttctgttagagcaggtctggcctactttggagcccttggcctgtattttgcttcgggcagctttgtatcatgtcaaacattctgggattcagactttcagtcctccagctggtctctcccgtacctgatgaagttagtgaagttgtgtgctgtgcagagcctcttggagggggatttatggagcaagccctagagacgtggcctgagcctgtcctttcttgggtgaacagggcaaatgtaatttgtgttccagggacaccaccagttaagggggaacatagagaccctctgcttgagtatttccatggctctgccccctcctctgctgtcagagccccatgatgggatttccagggtggttattgttttttaatgtgtgctctgtggatgggccctcttggccacatcagctgctgccctccttttctgcacacctctcttcatcactggggtgatggatccctgtgcttccaatggccagagcagcagttttgccagcagtgcctattgaaggtgacatctgcagatccatgcacgaggtgcatctatgctggggtctctgccgccaaagggtccatagcaccgcgcactgcactgacagggcctcctgcagaagctgctgaggccctgggtgtgcatcgtctccagacagcaaaggaaagcagcactgtcttttgtcaggcttttcctctcaagacttctccctaggacccagctgggtgcaggggctgggctagaggatggtatgtaagatggagtcacacaggctgtgctcagaacagctcctggccctacccagctttgggtcctcaacttcatccctcttgacgtgacagctctaagaggaggggcctcagtgtttcatgttaatatccccctggcaaggcccctgcagacctacctgactccttggggaaactccaagccctcactccagccccgtcagtgacctcatctgtatgtaggactcagcgaacattttctgtaaatggccagggagtaaatgtttttaggcatcgtgggccacacaccatctctgttgctgctgcttctccttctgttcctcctccgccttcccccatctttttttggtaaccctttacaaatgtaaaaaccatcactagtttgtggactgtacaaaaacaggccacaagccagctttggcccatgggctgtagtttgctgccttctgatccatagaatgggagatgtcaccaggtagggctgaagcagtcaaaagagggcctctggaggaggtgaatattgagctaagcagagaatttgggaaactgatagcattagtgcagaggctggaaggagccagttgcttctggagagaatggttaggacaccagtttggctgaagctgaggctcctacagtagaattagaaaacttaggggagggtaagcagcagccaacttctagaggtccttgaatcacgcttgaagcttgaagcattattctaaagtcactagggagccatagaaggtacttgagcatcaattcaaccacaggctcttcagcccttcctggttgaggcgtgtccacatcagccagggttgtatcagggtttggggagtgtatggcgaagggactgtaggaacttaagtgagctttattcatagtgttagggcccagtgagggtgggagcccctgttcacacttggagccaatggtgctgtcctccgggacatggggccaggcatgacagtctcactgttgctacttttcctctcagggcagcctatgacattccccccagaggccctgtgggtgaccgtggggctgtctgtctgtctcattgcactgctggtggccctggctttcgtgtgctggagaaagatcaaacagagctgtgaggaggagaatgcaggtgagtgtgtgtgtatgtgtgtgcgtgcgcatgcacacttatgtgtcttggggtatgttgctgtctttgatgtcaatagagtgtcactttctagtgacagaacgagtgtgtgtgtgcagatggggctggatttgtctgtgtgtgaccttgagtctacgtcttgtgtgtgtgaacaagcgtgagcctgtctgtccatgtgcagataccacaggatgaatgtggatgagtgtgactggaaggtggtgggagtgtaaggccaagtgctacaaagggatgagtgtgtgccaacaagtgtgcctgtgaaagtgtaagtcagtcacgtgtgtgtgagagagcaggccagagcatggaagctgtgcggcacaaatgtaggcatgccaggggcgtgcatggcactgggggtgatcgtgcctgccttggagtgagtttgaagcagctgccatttgcggggctgagggtcagcccgagctggcattggtgactggtaagtgggtgagaggacattggtgggtggtgagttgaccctggtgggtaaacagatgcatgagagtagatgggtagtcagaggctggggatggctggaggttgggaaggagagggaagaagagtggtcagttggcagataggtgagtacttgtgaggtagacaggtggaaggatgagcaggtagacggctggttggttacatctgttggaggttgatggttggcagggctactgagcgagcggatgggtgaggtgatgggtgggtgggctggtggagggtaggtggatggtctttggctgggtgtgtggcgggggctccaggttgagtggatggtctttggctgggtgagtggtgggctccaggctgggtggatggtccttgactgggtaagtggtgcactccaggctgggtggatggtctttggctgggtgagtggtgggggcgccaggctgggtagtttttggctgggtgagtggtgggctccaggctgggagccccttcatgttgtcacaggctcggctctgctgtgctctgctctcgggctctaacccgtgtctagcatttggtccgcaggtcaggcccactcaggccctgttcaccagcttcctgcactctcaggtgggaaagtgctggcatgaaaatgggcttgcaaaagatttttgtttattctgagttcttgcctttgcaggagctgaggaccaggatggggagggagaaggctccaagacaggtgagtctgaacttggagctggccctcttggctgggagagggacatatgggaaaggagagaggactctaggatctggaggggccagatttgctgtaaggtttgaatgaaatgtgttctgtggactcagacctccccaccccggtgagtctgctctttgcccagagttaggcaggaagtggatcacccagttccctcccaggtgtggcttcatttctcctgccaacctttacccatctgccagggccgattccacctgattggccccacaccgtggagtctggtggcttcctaggggtgggagcaggggctccggagatagggagtctgggtttaagttcctgctccatctcaggtaaacagagtggccttgagcaagatgctttgcctctctggcttcggtttcctcttatgtaaaatgaggataatcacagattcataggttgtttgaattattaattgagataatgtatataaaggacctagtatcatatctagtgccaagtgcttaatactctggagtcctattactattaggcaaacagcttaagacaatactgttctagttacagactgtgtagctttgggcaaggtgccttgctcctctgggcatcagtttcccatctgtaaaatgtcatcctgaccctgccctgatggcaccagagggctgttttgaagctctttcaggtgactggagagggaggtacttgcaaaggacataggagcatggcacagtaagctgggggcccagcttgggtgggtgccaaggcactggtgcccatggccgactcccaggggatcctgggctgggagaggcaggtttccgctgagccatttgggatggttccagttaatgccagttccctccccacccccgcagaaggaagggcaggagattgacacttggggactgctataaattatgccaattaattctttgcctgttggtgcccagcgtggcaggcgtagagacagctctgggatcagacctcattcttcatgctcagaggcagatgtagttggcagaagggagggagtgaggagaagagtgtgggtgatggagttggtcagtctcattccacatggtcccaggcccacctgcaaatctgccagcctcctttagcttctcacatcaccctgtgtgtacattgggctcagggcacttccgcatctccagctggaggtggagggctcgagggttgtcccattctatagatgcagaaaactaaggcccagagaggagaatgacaagccacagagtggaactgggacctgggactggggcttgggacagcaacctagggccccttcccttgtgctatgaagtggtcccactctgctgacttgtcccgccccttccagccctcactcctccctctgcctgactccctaccccaccacttcccatggttcctccctcaccgtgtgcgccttcctttttttacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctcaaaaaaaaaaaaaaaaaaaagtcagcttggttttgaagagttgctggagaatgtggcctggatgggcaaaccagtttgcttcctaaccctgctccttggtgaggcagcctgccccctcagtctctggccatgctggacaaccacagaggcagtgcccagatgggggagctcttctcctctccccagggacatacagagccccaagaatgggtgagggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctttttctctgtgaagtgtttggaagcagggtgggccccaggactcaaccagcaggattctctcctggatgttgcaggctggggtagggaagcctggccctccttatctcaccgtccttaaatcactggatccccaaggccatttggctccctccttggcttcagtttccctctgggtaaagtgaagttggttgtccagaaagccaggccctttggtcactgtatggggctcctcccactggaagcatcactcaatttctttgcctcagaaaactcaaacctaggcttgtttagggcctctactaatgaacccattttagagactgtgaagctgagacccagtaagaagctggcaccaggaaaagagttctgaatgctgtttctggctgactcaattggatgggcaccaggccagggatcagaggtccattcccaggacatagttctgccctatgaccctgagcaggacatttaccttctctgagccttggctttcttgtacaaaaaatagccacctatgcatagtggctcatgcctgtaatcccaacactttgggaggctgaggtgggaggatcgcttaaggccaggatttcaagactagcctgggcaacatagcaagaccctgtctctgcacagaaataaaaaattagcgaggtgcggtggcacccacctgtagtcctagttactcaggaggctgaggtgggaggatcgcttaaggccaggatttcaagactagcccgggcaacataacaagaccctgtctctgcacaaataaaaaattaactacaggcacacacctgtagtcctattactcaggaggctgaggtgggagaatcacttgatcttcagcccaggaggtcgaagttgccatgagctgtaattgtaccactgcattccagcctgggcaacagagcaagactctgtctctaaagaaaaaaaaaaaagaaaagaaaaataggactgaggttttaactaccttccattttgaaagactgagaggaggcgcacaggcttccagagagccagattcagggctatgggaacctgcctaggatactgcgttcgcttgcccctggatgacagtgtcctggcactgggacagcctggagctttgcagaccctgggcagcaggaggagcctgtgctgggggtgaggacacttgactttcaatcctggctctgctgctaacctgtgtccatgtccttcatacctctgagccttactttccttatccattagataggggtgacaagtcatctcccaaaaagtatgtggcattctttacaaactggaggctttgttataaagttgatggctctaggggtgagatcagtcatgttgcttgaggtcctgtcatcggtgctctgggtgggtattaggattgaaagacttatgcctttgccccttcaacccactgtgtgcccttgagcttgctgcttcaccacactgggcttcagtccctacctgtagagacagtaatagttcctgtttcaaagcactgttgagagggctggataaagcagtgggtgagaagacactgcaattaggccagatgcagtggctcacgcctgtaaacccagcattttgggaggctgaggcaggcagatcacctgaggtcaggagttcaagaccagcctggccaacatggtaaaaccctgtctccattaagaatacaaaaaaattagccgggtgtggtggcacgtgcctgtagtcccagctaatcagggggctgacacaggagaatcatttgagcccaggaggtggaagttgcagtgagctgagatcacgccactgcattccagcttgggtgacagagtgagactctatctcaaaaataaaaataaaaagacactgcaaaccattaggtgctgggcacatgtggggggctattctttccctccctgcagtcaggcccacgcgctgttgctccttaggtgattttgtagattgagcacagtgacttggaacaagctctctgaagcccagtttgttcatctgtaaaacaggcacaggaacccatgctttttctttgcgacagggctggataaggctcagacaggacactgtatcaagtgttctgggcacggacccagcaggtgtgggacttgcctggaggcttaggtgtaaagagagtggcaactaagtcctctggtgacaagtgccctggacagcagtatttttagctgcccttcctgggcaaagctccaactcctacattttaatggagaaataattctcacagtgcgacaagctatagcttgcaggtgtcacatccatattaaagaggggacagagcgaggttcatttgcctggctcaaggtgtgaccagaattcgcctccaggaccatttgtaaccagggcttgaagaccagtggatctgactactcaccacccagaaggaggagactgggaggaggggttaaaatggtgtggccagggcacctggatcatcctgcctcttctacttgtgtgtttggagcattctgcttacactcgcagaccctgggcagcaggagcctgggctgggggtcaggacacttgactttgaatcctggctctgctattagactggccaccttctagactgttgtatcagtcttacacatttacaaaaatatcataaacatcatgcaacccttttttctgtttttctttactcttttcccaagtcacttcttctagatagaagtgtccttgtcctctttaccttctatatcgatgtgtaacatacctctagtatttacaagatgctaatcctcagtgtatgactccatgaatttttacacaaatctctacccatgtaaccactacccagatcaagatatagaacagttcctggattccagaaagttccctagtgtccctacccaagcaacagccccgcccacttggctgctttcaccaattagttttacttattcttgaacttcatataaatggaatcctgcagtacatgctattttgtatctagcttcttgcaaagacctccctcgttctttttaaatggctacatagtatctcaaagtactgctgttctagcctatattttgctagttcctacagtttagacacaaataatgcaggcttgtgttcgagtttctacagtatggagccctagaagtgggatctctggatacattttaagtgttaccaattgtttcagctgcctttttagccagtccctgtggcagtaagaatgcaagtgaagaaaacttagggtggctggaaaaactgattctagacagggcagagatggtgcttggaattcacatccagttggtctctcagagacttcagagtggagcctgatttggtagtgtacagggcctgcagtcatcccttccacccgctctggaccaccttgcccttcagcatatgtcactgccgctgcctcagtttccaggagctatctgcgtccccgggaccccagtcctgggggagtgcgtctgcctcctagtggattatgtgggccgagcaccgtgttctgagtgtgtgtgtgccagggttgagccctgcacccgcagcaccataattgatggggggaggttctcagcatctttggggtttttctttaaaagaaggtctcactctgttgcccaggctggagtgcagtggtacggtcatagctcactgcagcctcgacctccagagctcgtgatctgcctgcctcagtctcctgagtagctgggactgcaggtgcctgccactacacctaattttatatatatatatatatatatatatatatatatatatatatatatatttttttttttttttttttttttttttttttttttgcagagacgggatcttgctatgtttcctgggctggtctcaaactcctgggttcaatcaatcctcctgccttggcctcccaaagtgctgggattacaggcaagagccactgtgcctggtcagcatcctgttggatgcaggtggctcaggttaggttaaatctcttgcacttgtgtcagagagtattcataacctttggcactgccagctccaggtaattatggtgacactacttcattactaatgaggcagctctttgttagcacagagaaacacctgggtctcatagaggaggcataacccagccctcagacagagggactgtgacctttgcctccagcctttctccagcatctgagcagcaaaatatcccctgcacctcagcttccttagctaatatgatttctccaccccagcgctctcctctggatgtgtttcatccgtgtcccttgcagattgaggctctggcatggatcacgatgcttcagctcatgatagatcacctctcacctcctgcatccagggcactatgttcctagtgatacagctccagatcccattagtccagcggttctcaaccctggctgcccattagaatcactttgggagttgtaaatggtgcctgggctccatccccagaagttctgatgcaattggttgagtttattgctaagtatttgatgtgcatatgccagtggctctagtctggcttataaattaatgtaaaataggattcagaagacagccctgagctgagacctttgagaccccacctcttagataagctagctattctcagtgatcaccatattggactgtgggttttttgtttttaattaagggaagcacacaaaatacaggagcaaggaaggttgagggaagtgataatctttagttcagaaaggagggggccctgttccctgtgttgtggggctggggaagagagcaggcatcctgagttcctgcattcagaccagacacataggctatgggagaatgatgaaggatggggtgccgctggtgatggctcaatcctttttagctctaggaaatggggggccctgcctactcctgatcatcccctcccccttctcctttcacggcctcccttttgcctctgtgtctctcccgtcacccccaggactccagatgtgcgcagccacgtggctgtttctgactccctcttccctccagcaccatgtcctccacggagggaaggaacatctgtcctgctccctgtagccgtcagtctacgtgcatgtgccaggctcagggaaataatagccttcgtgcttttcctgctccccgcccccccacctcccatctcacacatgcttcagaatcagggtatcctggggtctctaccacactgcagccctgtagtatccagagtgactgaagcacaggagctctcctctaccacccccaccctcctccttgcagctctctggcctctagttcttcctcagtctcaaaactcacctatctgaagtccacctgcctacctacctacccaccctaatttacaggccagcatgctccctgggtgctggtctacactctattctgtttccttcctgctcctcatgttgcaatatcctctcctaaaaagtccctgcagagtgtggcaccattgttggaggtggggaagagggactgatgtgtctgcagagcctgccagccactgactgacattttgccttatttgctaagataatttagtgtaatttgctaatgaatgaatgcacttcttgttcttatagcttttgtaattgcattgaaatccatgtgcttgctgacagtttcagcaaacgttccgggaactgaagctggccaggttacagagggctcagcctccttgggtgaccatgctgagggccttgatgacctgtgaggcatggccaggatgctgattttcttggtgtctctatctgtgctgcttttctcagcgtcctcccgtccactgcagccaggaggatctgggtcagcccaacaggagaatgtgctggcagccaggggttctggacctaggacatttttggaatgggctttgcagtgctagaagagagtgcattctgttctgtctgcaggatgggtgatgagggagtcagggggaagtataagggagaaggggacagagatgactggcgagtggcagaagttgcatgtttcatattcagtcgtgtttataagcatttgctccagctccccccatccttggatatgccctctctctcctccgcctgtgcagatcctagacacccccctcctatgtatccccccagatctctgcaactccgtgtttcatagctacgatgaagcacttgctcattcattgcactctgggaactcatctccccagagcagctctggctggcccccaagcccagagccgggcacagagcagctcctgtcctctggtctgctgcaagcaggaggtacccaaaccacattaattcaggtctctgaatggaagtaactaaggctgaagtttacttctacactatccatgaaaaaatgatttcccagcaaatgaacaatgtaaatgaggcagccaaatggtgcttcacctatttaaaggaataatctattttaaaaatcttttagaagcttttagttacccagaaacaattgatacggtaattgcaagccattttttaaatttacttattagagaagactccctaagctctgttcacccactcccatgctctgctaacccttagggagctgggtactaaatgctcgctgtccttgtaggccccatctgtaaaatggggtcaagagtagtaccttcccctccctagttgaccaaaatggacagagaatgcccaaaggacagagccttcacagggccacctcacctgcacttacacagtatgaatggacagatctgggcagatggcactggactcagccaggacaaaagagagctttgacctgagaccaatagggaggggctggatggtcagacaggatttgtgtggggaggatgggggtggaagcagaggcgatttctcattgctcagcccaagatggtagctgaaggagccccaggcacaaggagcagcagccatggccccctgagcaccagcaccgcagatccctggcctgcaaatcgattctgctttctgtttgatgggcttgttggcttcagcttggggaggaaaaacaagctctttcccaaggagaggagccgtgtcagaggtggctgtggtgcctccatccctgccgcacaccccatccccacccagccctgtgagagatgctgggtcagcgggcaggacaccattcttagcctctcccctggccctagccaggcctctgcctgcctggtggtgtggggcgaggcaggccaagatgcctgggttgaggggctcctgcgggcagttgtctggccctgtgcacctgctcaccgcggctgctcctggtccaatgtgtgtggccctggatggatgtgtgcatttggtggggtgagagagtaggtaagagtgaaaacaggaaagcaaagggcagcatccacaaacttggaaacatcagcctgctgtggaagggacgctcaagccccttgtccacagtattgctgagctctagaaggggaggaattgggagcagctgggagcaaagctcagaataggacccaggaggctctgcccccggctcagcgccatgtccacaagactctgtgatacacctctgtggggttcaatatgaggacaagaggatgggcatctgagcagccacttcctgcatgtggtgaggcagcccaacacagtgggcttttccgttttgcagcccccacagagccagcccctccaagggagcacgtttcattggcagcagtgctggcagtggcagctaagcccttatagggcaccactcctcccaacctcagcaacctcctctctcctcctgtggttttcctaataaacacctttaaaatatttatgaaggcagcttcaatgaagtaacacgacattgatttaaaatgattttcttctaataggtagcttgagcatgggctccatttcccaagctcctaagggcaggcccatcagggtgaacccccaggatgggcattcaaggctctccatcaatgagctgagcagtggggatcccttccctctctcagggcctccactggggggccaggtctggtgacaagtgtggtgtgacagtgtcatagggctcaggaactggactctggtagaaggggtctaggggatcaggcaggccaattagggctctggaagaacgcctgacatgggaagaagctgaaaactggaagtctccctagaaccatggatagcacctccaacctgtgcccctggggcactgagaagcccagaagctgggagctaggactcctcggtctctgtcccactttattgataggaatggagaaaggctgtactccagaaggaggtgatgagcgccatgggtttctagggaggaacctggactgggatgctgtggccactgaacagttggtagctgagtttagctgctccccagcagccctggctggaaaggacacaatggcaatgccttctgtgcacgtgtgggggtgggtcgggagcaagtcgggatctgcagttggccctcagatttgtctgtctggcctttgaaactccaagaagccaccacctaccctccttacacaaatccctgagctgccctctcttgacaggattgtactttgtccaatctcttcccggcacagagggggaaactgaggttcctccccatctaccagcctctccgcaggctagaaggaaaatcccatccatatctatctggcacgcagacagaaggccctgatggagaaattttgggaggaaggttctattctcaattctcaccccactcatccccagaaaagtctaacaagagctgttttcatcaccattgcctaaagcctggagctgctctaattacgtgtcaggcttgaatttgacaggaagcattttaattattaatttgaagtgtgctgagcatggggtggaggagggccggctctccaagctcaggcccagccctgtctgttgggacctcattaataatacctcagacctcccagcctttcttctccagatggagcctcttccctgccacggcccaggatctgcacctcccactcttctgaccttctaacctctcattttgcaccatgctttcttgttttccttattttcctaagccgtttggcacagagtctactgttcccattacatgggatggagcagactgaggtggagggagggcagggagtccagcggatgtcacaacatgcattagccacgggcagggcagggctttttggggttctttagttgttgcctgacagcagaggtggccttctgcagggctgtctctcacctgctgtgtgcctttatatccatatcatctagggtggcatgcaaagttttttcaatttgttgcctgcatctgatcccatctgatcctttttttttttttttttaaatgcagagtcttgctctgttacccaggctgaagtgcagtggtgcgatctcagctcactgcaacctctgcctcccgggttcaagtgattctcctgcctcagtctcctgaatagctgggattctaggcgcctgccaccatgcctggttaattttgtacttttagtagagatgggttttcaccatgtttgccaggctggtctggaactcctggcctccagtgatctgcccgcctctgcctcccaaagtgctgggattacaggtgtgagccactgcacctggcctgcatctgatccttttaaagatcagtttctttgcttcatttacacccaggtatgggtgtgccctttgggctcaggggccagaccacttgttcagtcctaggtgaaagagtcagagcctgtcgtaggctaaggacatcattttgcccattttctctcctgccctcaattaagaaagattcatcccctgctcattggttgttttctgagtttaaaccctggcactgtcctgtgtgttggggcctgtctcttctgtcacacgtcattgtttctgccttctggattcaggaccacaaagctgcaggctgggacgcagccctggggctgaagattgtgctgtgtcacatgggtctagctgctgctgtggtatgtgacactgagattgcatttctgtcccaggcttccttccttctgttgctggccaatccccttcctctccagggcatccctgcctctgcctgcatcccaggcttggtgctcaggggcctgtgctcagccacccgcccctacttcatttcttgatgcaaccttccttagtgttagattctgtgctgtagttggattggaaagtcatgatccactaggggagataagcatttatgtgaatttgatctaggcagaactgtggggtccagaggagggatcaaggaatcctggaagaattggggcagattttccagacacggtgatgtgagagctgagtcttgcaggacatttggtatgttattcatagttgggtacattgaacagaagcaactgtattttaaacagaaaggaatttagtacagggtattgggtgcttacaaagactgaaggagcctgcttggggctgggtctcaggaaatgattttttttgaaatggagtcttgctctgtggtccaggctggagtgcagtggtgtgatcgcagctcactgaaacctccgcctcctgggttcaagctatcctcctgcctcagcctcccaagtagctgggattacaggtgtgcaccaccacgcctggctgatttttctttttttgtttgtttcctttttttcttttctttttgagacagagtctcactctgttgcccagactggagtgcaatggcacgaccttggctcactgcagcctctgccacctgggttcaagcgattctcatgtctaagcctcccatgtagctgggactacaggcacacgccaccatgccctgctaatttttgtatttttagtaaagatggggtttcaccatgttggccaggctggtcttgaacttctgacctcaagtgatccacctgcctcagcctcccaaagtgctgggattataggcgtgagccacagtgcctggccaggaaatacttccagaatacagaatatcacagaactgaacaaccagggggctgctactttgtcatgcagtaggttgaataatggtccccaaagatgtccatgttctaattcctggagcctgtgaatattaccttacctggcaaaaaggacttcacaaatgtaattaggttaagaatcttgagatgggaagatgatcctggattatctaggtgggcccaatataacaacaagggtccttataaggaggcaataaagcagaatcaggaaaaaacaaaggagatggatgacagaccaggagctggcttgaagacggaggaaggggctgtgagccaaggaaggcaggaggcctctagaaactggacaaggcaaggaaatggactgtccttggagcctccagaaggaactcagagctgctgacaccttgactttagcccagtgaaaccgattttggacttctgacctccacagctatgagagaataaatgtgtgttgttacaagcctctgaatttgtggtatttagttatagcagcaaaaatatggggaatgggggaagaatcattggaaccattgggttcaagaccatgcttcaacctgatccagggtacaaaaagaaacccatcgctgctacccttccacacccctgaatctgaggcctcagcactgaaatgctgctgcagttccacaggcttactggctgaaagcagccacagataagcctccaaatctgccttccaggttttgccaaagggcctctaattgctggaacttaattcacacacaacttcagctgcaagggagccctgcatgtttagcttcccaggcactgcagtctagcaaggccatgagaagatggcaggaaagggatgctgagtgttcaccaaacatctcagacacaatggggaaccattaatgatgaaaatgagtaatatgcattaaaacctgaccacgggctcaccaggaaaatctcccaccagcccatgcatgaatattgagtatgcctctgtgtaaagatgaagctaagctatttgcccaaaaatcccacagcaaggaagtgacggaggcaggtttgaatccagctttcgtctactttagcgcttgagcttctaactgctacacagtactgaagaggggcagggtcagtgccacgaggggaaatggccttgaagaacacagatgcatgaagtaaccaggcacttcagggaactgcaagcagctcctatgccttgaacaaaagctgcatggagaggagaagcaaggtgagtagagagcagcagaggccaggccacgagggtctccggcgctctgccaaatggctgcactgcattcctaaagaccaccaggcaccatggaaatcttttttgcaggcttttcccataaaaggtcttaagacaggagagcaacaatttgtttcacattttgtatgtgaagaaaggtttatactagatcagagaactgagtcatataggaaagacaaaaccctgaccctggtcacacactaaaccctgaccctgtgatgggctcagggtcatagactgagccccaaccctggagacacacttagctccaaccctggtcatagactgagctccaattctggtcacacactgaaccctgattctaatcatacactgagcccttaccccagtcacgcactgagccttgatcctggtcacacactgaaccctgacgctgtgatgggctcagggtcacagactgagccccaaccatgggaacacactgagctgactgtggtcacacactaagctcaatctctggtcatagactgagctacaattctggtcacagagccctgatctggtcacacactgaaccctgaccccagtggtgcactgagtcctgatcctgatcacacactgaaccctaatcctggtcatatactgagccctgatcctggtcacagatagaaccctgattctagttatagactcagccccttccttgatctgaactgagtcctatttttggtctctccctgggccctatctctggttgtagaccggcctgtcttacagttgagctcttattcccatccaaccactaggaaggccacttatcactggggcagtcaggcaaaagtgtgattcattcagtgcagcccttctctattgctgtgtccacagcccaggatgcacatctttaaaaagcagagaagtctgtttgtgtgacgtgaaagatgactagacatgcttacttagtgcttgatgagtcaaggagtaggagaaggtggaagaggagaaggagatgagttcctagaacattaagctcccttttctataatgaagggagctctcactacaagcctagagctccctgccaaccagataggaatgcagagggcatagcgacaacctgggactagctgtgctctggcctggggcctgctgggcttccgggagagaaatcagacctcagcctctcccacggccagaggccagtaggatcttacttagtgagatcctgcatgtcacacggggtagcaggcagagtgggcccttgtggctgggccctgaggaaacaacccatttgtctgccggcaggtgggtccaaggtactcacagtatacttgagtcaccccaaagtggttgtagatggggtaaatctcttccttgtgctggaacccgtgcattgccctccacaccccacccctcctttccccttacagctctagaggtcacttgggccattcctctccacaccgccaagcaaatttccactaattaaaactggaatttaaccactctagcagccttctgtcctgtccatacagtctccagggctcaacaatggggtctacccactaccagatgtggtcgtctccagcgtggaggagagaaaccattcttaatgggcagcttgttaacatccccaggacatgactggttcggatagacccacttccagcaaagtgcagctgcctgtgaggctctgctccagccccaccctcctgtcctgcctctgcgatgacatatggggcaggtactatccctctctggaccttgcgaactgaccctgggagcagccacaagaatgccgccctgaacccttgttcctgagctcaggacatttcctatgcccaatatgacagggaggcagagagcccttgagagagaaggaaacaagacggtggtggtgcatattctggcaggccctggggaaggggcttcacacatattttttcattgagccttcacagcagggccattggtgggttttatatccttaagaaaatgaagctccaagaggtgaaatagctggtgcaaggtcacaaaggtaggaggagatggacccccagtctggaaccagggctttctggctctgaagccagagttaggattagggacctcacttgtaggccagccttctcctggctggccctgcccaccatttggtccagaatacaaagcagcttctgaatctggccacggttggggcaggggttggtcagctatcttgagcctcaagactctgggatggtgtctgccagccttggcctgccatggatcctgccctctgcatctgaagttttgggatgaggtctctgccagggacagaaggtggtgaggtggggattatggatcctcttgggacaagcctggggccaggaagggaccctttcactagccacactctgtcccctgctctgttccatgtggaaatctctctgggccccagtgtgtgcggtgagggtaccgtgggcagctagagctcaaaagcatgaggtctgaggctctcaacctggtccagaagccctggcagcctcagcttggtgtcagggccatacgtccttgtggccctgtgcaggtgtcataatcaccatactgcctacctccagggcacactgctgtggtgtctccagcagagctgtgctgaggggggccatttacataggtgacagtgtgagtggtgtccctggagttgtgcagtggctctgacaggtgccctcaacactccctagggaaagaagttctgatagtgatggggcaggggcacagggccaaagggaagagagcttgtctgaggggtacattgcagggcttctgggacagcctcccaaggccagcagtaatggggaaacgagggaatctgatactgatgcatttagctaaaccttgcttttagggcacaccactgggccttcagaatatgcaagcctatggggcaaagatacaagaaaaattcacttactgacatcttgctatgtcccattcagtacttgaaaaatggcaattactcagtgaatgagttatccatgtggctggcactacagtggattgatgaaatagcaacaagggctatttgatttgaagattcccttattaaaaagcatgaaatcatccctcagccctgcaatgatgctctaaatttaaaagcaaacaaagcaacaagaaaccaaaaccagaaaaaaaaaaaaaaccaccaaaacaaaactgggtgagtgcttcgcaaagtccagcagaggcctgctgcctcaaagcaccagagggtcaaagtggcctgtgcctgccttcactgccccacgacccagaatgaaacttcctccctttcaggaagcctttgggagtcttgaccctccaactctgaatctggagagggagttaggtcccatggacaagggtgggccaagcaaaggcaagacgtgtgtttattcaatgtacattcactgagaaccttatggaagcattgtttctgccctcgggcttgcagtcaactggaggagacagctgtatgggggaagataaacctcagtgcagtgatgagggtgggtcagaggcacacttaagacgcagcaaggcagaaaggaaaagacacggcgaaacaagagtttggggtaggctgaattggcaggaatcagcctcatatgcctgcaggtgccagtgcgaataaatgagtccctgggccagtgtggggacactggtgagtgcctgtcccacccagaagggccctgctgctcagttcctgctgactggttctgtgcggaaatgccagcccagtgttgtcacagctactgattttttctaagaaatctgaaattttacgtaaaatgctgtttttaaactactgtaggaagcaaaacaggtatgcaggccaccagtctgcaacctgtggataagagaaataaatatccaaggaaccgaaaggtgagcagggttagcccgacctgaaaaagggtgttctctgggctagagttctcaggacgtccccacccaccccgggtagaaggaccatctgcagtttccctgacaccaccgccagcctccagcccaagcacaagggaccgcattttttttttaggaagccagaggaaagactggaaccctctgggaggcccatatgttgactgggaagactgaactccatgtctggggcaccatcctgaaaaactttttctcgtttacaccaggcattggagtgaaaagtctgtcttgagaggggctggcagctcttaagtaccaggacactgcagcatgtgccactcattgaagtggtgtcaagactgagcacacctgggaacatgtcctagacctacccccttgccaagtggggctcctggctcctgctcccagcccatatcccagagacctgctgacgctccccttggtgcctttgggatcacaggtttacccctaaccaccctcaccccctgcaggtcagaaaatgagctcatcatacctagaattcacctgctctcaatggttggttttctagatttaagcctccgccctcccgctaggtctacaggaggaaataagcctcctcttagtactgtctctacggaaacggtagtgtctggagggcaaaatagatagtgccgattgttcactatgggcagggggcagtgagcagggttctatcccctccccacactcccaggttactcttactatatgaacctcctccctcccctcccccttccccttccccacctcacgagctggacttgtgtccggaatccgtaggttctcggtctgacttcaaaaatgaagccgcagaccctcgcagttgagtgttacttagttcttaaaggcgcgtttctggagtttgctccttcccatattcggatgtgttgagagttttttccgtccggtggattcggtggtctcgctcgttcagaaacgaagctacagactttctccgtgagtgttacagttctcaaggtagcgcgtctggaatcgttcgttcttcctggtggttttgtagtctcgctaacctcaagactgaaactgcagactttcgtgataagcgttacaactcacaaaaacagtgtaaacccaaaacataaaaaaaaaaaccgcctccacaggatggaaaacaaacccaccaggttaccactacgggctcgggcagcccgcttttattctctcatctggccccacccacatcctgctgattggtccattttacagagagccgattggtctgttttacagagagctgattggtccgttttgacagggtgctgattggtgcgtttacaatccctgagctagacacaaaagttctccatgtccccactaggttagctagatacagagtgttgattggtgtatttacaaaccctgagctagacacagagtgctgattggttcatttgcaaaccttgagctagatacagagtgccgattggtgcattcacaatcccttagctagacataaagattctccaagtcaccaccagactcaggagcccagctggcttcacccagtggatcccccaccgggactacaggtggagctgcctgccagtcccgcgccctgagcccgcactccttagcccttgggcggtcgatgggactgggcgctgtggagcagggggcagcggtcgtcggggaggctcgggccgcgcaggagccgacggcgggttgggggcgtggctcaggcatggcgggctgcaggtcccaagccctgccccgcggggaggcagctaaggccaggcgagaaatccagcacagccgctgctggcccaggtgctaagcccctcactgcccggggccggccggccggcggttcccagtgcgagtgcggggcccgcggagcccacgcccgcccggaactcgcgctggcccacaagcgccgcgcggagtcctgttcccacccgcgcctctccctccacacctccccgcaagctgagggagctggctccggccttggccagcccagaaaggggctcccacagtgcagcggtgggctgaagggctcctcaagcgcggccagaatgggcgccgaggccgaggaggcactgagagcgagcgcgggctgtgagggctgccagcactacctcctttgggaagctgctcacactcagccatttagctaaggaaaaattctccattttacaggggtctcctgggaaggccccaccactggccatcgtgtgtcaaggaaccccacaaagatcagggcccctcgggatctttccacagctgctccacaggcagtgccttgcagtgacacctgcaacccccaccccatcctgctttcttgggggtggaggacaggtcgggtgatgcctggagactgggtttctgtggctcttctaagatagtgggggaggagaggacaccagggtgggtctgcaccatcagatttgttgtccacagtgggaagtgcctgactttacacatcccagcataataggaatggagcagcctgaacaggaactgagagccaaaagcctcaggcaggtgtgtaagcttgagtgttcctggcagggagtcatgtctgatcagcacagtgtctgagccctggatagcgtcagcctgaggtcaccctccaagaccccttggtcccctagtctggcatggctggtacaggtaaggtgggggtgggcaggtggtgatggcagctgtgctcgcccctctggtaggggttcggggcaggccaatggaggagtcaggttgcatcagaattccagctagctcccgtgtaacatgttacaggaaggtgcagctccagcatcccacccctctgccctgtgggagaaagaaaagggcactgcaaatgcattgcaggagggacgtttaacccgcttgcaagatccaattatcttcaagggcttagcatatctatgttacttaccaatgtgctaattgtgtgctgttcttatctattcataagagtgggtccctatcatgatggtctactggataactgttgctgagctatcataaagctattctcccagtatcagactagacaggataccctggcttcctcccccacagttaaagaggatggagtggctctgagtggggctctggggactcaaaagtcccttgcagaaggtgctcttatcttttccattttgcaccaatgtgcacctctactttaacaagggctctctccaccatctcctatatggttcccccagccacctttgtgaagttccaccagtatctcatgtccttcattcccacttctaggtgacccagctctattccatttcaagtgaaattccatgtgaaatcctccctccttccagaagccttttccttttttttttttttttttttaaatggagttttgctctgtcgccaggctggagtgcagtggtgcaatctcagctcactgcaacctccacctcctgggttcaagtgattttcctgcctctgcctcctgagtagctgggactacaggctcccgccacaatacccggctaattttttgtatttttagtagagacagggtttcaccatgttggccaggatggtctccatctcttgacctcatgatccacccgcctcagcctcccaaagtggtgggattacaggcgtgagccactgtacccggcccccagaagccttttctagatactccagccccacccattgtcaggtaagcctagaccagaaagggcagtgatatttactgggcttagggcaggctagtcttggctctgccagagaaatggaaagggggaaggatgctttggacttggagctgtttttctgctagtcacccagtcagtgccccagacccaccagaaactagggggtggttctgaaagtctggcctaaagcggagttgaagtcagggcccaaaccctggtgagcactatgtaaagtgcctaacaatcacatagtatgctatacattgtagcacttatatatagtgtaaataataatggcaatgtcagtccccagagcagccaatttctggctgtgtaacttagaatgaattccttatttgttcatcagttgcctcccctgacctgtaaaataaaaattgtggttaattcatttactcaacaaataattattgagcaacatattctgttctaggtacaactaaatctgtcatttagtatttgttaaaagatgtagcacggtacctgacatatatatactaggttgtcaataaacatcagttttcttacacaagtctcagctgtggaatgggagatgggtgggtgtgggaagcgccggaacagagaaacagaaagtcaggagtggacagggtggagggctggtcttgttgcctctggaattcccagccccactacacccactttcccttcttgttgacaagtcctcattaaggacaggggatggtgctggggtctctgaatagtttaccctcctttctgtcccttgatcccattagaccacttctgtggatgacatcatctgtccctcatctataaaatacagacagtgatgcctcctcattcttagacaccaaagacatggcaatgtgcccaccctattaatggagtgtcaggttggggacccccacccttcccaggacatctcccagagtggtctcctcaccaagctgacttgcctcccacttctggttccttaccctggcatcccaggctagacccagcagcagctatggctcccttagtgctgaaaccccacacccttcagttttgactttccccagccccaaggcacaccagaccagaccctcacagaggagttgtgtatacctatgtgtgcaagcaccatgacacctggtacacaggaggtctgcaataaaagctgattgaatgaatgcatagtggatacccttctgcaaatggggctcgtttattcattcaacaaacatttattgaacccataatccatttggtgccagtctccgagtcaggggtggtgacattcaggttaacagtaactaagttctccaaagactgaggcatgttcacatgtttcctcaccccaacactcccctcaccccgaagacccgcctggctctcagacgacccagccccgaccctcacctccagtgaccaggccacccactccaggcattttaactgcagtggatgtttgcagtagatgatgctaagtcactgtgtttgtggttgaatcctggttccatagcccatcctgtgtttccttaggcaagttacttcacttcccagagcctcagtttcctcatctggaagctacttagacataagtaagattgcttatctcatacgtgctgtgaggagtaaatgagataagacatacacttagaacaatgcccagtgcctagcacgtgcccagtggacatgagttattcatcatgctatgacttctctccatcaccaggttccagctcccttctgcccctccacagcaccactcagcacaagcctgtgcacacagtaggtggtcagtggaataggacttcccggaagcagagagatctgatggaacatcctgggtaaagaaactcaaaaactggcaaaggtttggaggcagggaagagcagcaaagggctgtacctggaaggtctggaggaaggacccaagggatggctgtgtctaccccaaggacagggagctcactacccagaagcagcccatgccatgactcagcagtgttgaaagtcagaattctctctatccctagctggccacattttgtgtttcaagtctgaagaagccactggggccaggtgcggtggctcacgcctgtaatcccatcactttgggaggccaaggcaggtggatcatcggaggtcaggagttcaaagatgaggctggccaacatagtgaaactccatctctaagaaaatacaaaaattaacccgggcatgatggtgggtgcctgtaatcccagctacttgggaggctgaggcaggagaatcgcttgaacccaggaggcagaggttgcagtgagctgagatcacgccattgctctccagcctgggagatggagcaagactccatctcaaaaaaacaaaacaaaaaaaaattggccaggcgtagtggcccacgcctgtaatcccagtgctttgcgaggccaaggtgggcagatcacaaagtcaagagatcaagaccatcctggccatgtggtgaaaccccatctctactaaaaatacaaaacttagtagctggggtggtggcgggtgcctgtagtccaagctactcaggtggctgagacaggagaattgtttgaacctgggaggtggaagttgcagtgagctgaaatcgcaccattgcactccagcctggatgatagagggagactccatctaaaaaaaaacaaaacaaaacaaaaacaagaaaaaggaagccacagggatcccactccactgtcaggaggtccagactgggtgtagcaaaattgtgaagtcagccaagtactacctatatcccacttccccctcctccaggatatactcccaccactgccctatttgggggcaaatggccaggcaggggagcagggggcgactgatggacattagccactactacagagtcacatagagccagtgtggggtgcaggatcccatggctgtgtcagagacccctagctctggccctcagtttcttcctctgtgaaatgcgaactattccataggtttcttttccctgactgttgaaaagatgagaaactgtgagcctgaaagtgctcttgccatgacagatgaaatgcaagcctcagagggagaactgttatgtccattcttagcaccaggtaggcccattcctggtcggggactgcccccttctcactctcagggtggggcggaatgcagctggcccctctccccagaggagcccctggcactcatcctgtgaaccagagccctatcgctgatcagcaccaaatggctgaggatttcctggggctgatagaggggctcagacccttggttctcagacgtgagctgggaagagctggccatggcctgcgccatccctggatttccacactggtggctgcaccctggctaactctttagggctccaatctcaccatgagcttgaggaataagctctacattgcagagcctcctaggtctgctcagtcttatccagatcatatcccctgcagctgctccagaccggcctgtacaatctcactgtatgtccacagccggggctggatagcacctcttcaggcaggagcagtgggtgctgccaggcctgctgctcaggccccctccggacagacgctggggggctgtaaacctgccttaattgaaatatgcaacagggaggcccccaaggagcgatgtctttgctgtgctgccagtcccacctccctgctctgagcgaggggctgtgaatcaagctgcagtcaacttctgacctcgagctactgcgagggaccaagcaatggagtgtttgtgacccaggggtggctcccagttggatggaggtgtcttctttggccatcccactcaaagcccctgtgccctggaaatcactggacatctgggttgaggccacactgaccacaaggcatgtccagtgccttcagtttgtcaagtgctttcacagtcaccatctcgtcggagctccacagcagctggtgaggtaggtgaagactaccagacccattatacagaggaggtagataggctcagagaggcaaacggacttgccaaggtcacacagctgctagctagcagagccaggcacagcctggaaatcactaattcttgggggcagagtagcacaggctttgtggctttggggcaggtactgaactactttgaacctcagtcatctcatttgaaaaatggggataggtgggggcacagtggctcacgcctgtaatcccgggactttgggaggctgaggctgacgaatcacttgaggtcaggagttcagaccagcctgcccaacatggtgaaaccccgtctctactaaaaatacaaaaattagctaggcgtggtgacgcatgcctgtagtcccagttgctctggaggctgaagtgggagaattgcttgaacctggcaggtggaggttgcagtgagccaagatcgccccactgcactccagcctgggtgacagagcgagactccatctcaaaaataaaaaaaataaaaataaaaaaagaaagaaagaaaaagaaaaatggggtaataatacttcctgtctcatcaggttattgtggtgattaaatgagatgctgctataaaaagtattcggcatagaagtagcatagagacctgctcaataaatgtgagcaatataattgtcattattatcccaaggatattcagctgctgtccctgtgctggccatgccccagatgaagccctggtacctctaggctgtaacctcatctttgttcaggacctgctgagatgggctcaggggctgggtgtggagacatcgggacggagtggggaccactgggctcctttccaaggctgcccacctggtgaaggtggccaggagcctgtctacggccctaatttttagccccatggaagtggctgcctacttcctcgcacagatctcaggtctgcttagggccacgccaggactggctgaggctttgccctgaggttttggtcttggtctcagaatcaggctgagaatgggagctgaaaggattgggggtggtccagaccctccaatcaaacccctgcccagcccaggcgatccttcaggctctgtggatgcccagcatcccagcacggaggcctgcgccatgggagcagcttgccattcccctatgtcccaggcaaccctaagatggaagggggtgaggcaggactgtgtatagccgagtaagtctgccttggagtagaaggatggtgggtgcaagtgacgcagggcctggccagactgatgccacccccaggccctgagtcctgcagtctccagaccaccccgactgtgaaccctggcctaaagggacaccactccctttagagcccgcctcctgcaggggagtcccctctaggacatggccctggccatcagccagactccaccacagagttcaggggctagcaaaaggaggatcagacctcccatcagttttacatactttcagatacccccttcaggagccccgcaatgagaacggaggaagggcagtcctgcccacacctcctgggacctaggaggccaatgggcatcttcatgtctaagaggagctctgtgaaagctttggggcctgtggggccagatccttagcatttttaaattttattatgacttcatttgtttaaatatatatatatatatatatatatatatatttatttatagctctatgtgcccaccgcccccggccccctccccggcccctagtttttccccctggctttctgtctagtggctgtgtagggcagaaccgtctgcgtgctcttgtctgacactgtctgggtgctgctgttcctcgtgacccttcgagtctgttcaggggccaaggtagagcctgagtggcggctggtcagtggagagcgccgtgacttgtagggggctggggagggcttgtgggggcctgcatgggcctctgtatgggcaggctcagggggcaagcccacttcttcctcctccacctcctgctcaccgtccccctcctcatcgtcacagcacagagcatggtagagcactttgtcactgaaccgcaccctctcccgtgtccctggggtccgctggggcagctggctcttcaccgtggggccagcaccaaaggcctcctcactggaggagtctggggtctccactcgtggcccattggggatgggcgtgccaccattcatgaggcggtagtcagggccagcccctggccgagtcgactcgggaccatccacggagtccgagggggtagagacgtccaggaaggagcagaactcccagctgtctgagaggatatcggctgtcatgaagtccaggtggcccaggtcaaaggggccacccatgcccgccttgtcactgctagaggtgctgctcacagtggccgtggtccagtcgtccggctccagttcaaagtcgaagtccgaggttagcttatcgatctggctcaccacctgaccagggaaggggagaggagatgagaggggccaggtgggtccctgcatcagccaggtgtgagtgtgtctccaccccatccctgtagacccctggctgatgagcgtactggacaggggagagcctgtaggatggtgactggcctggaggtcacaggttggtttgccctgtggagggcccaaatcagatcaggctggacagagcttgttccggcccttcccaaaggtctgtttaccactgttcagtgccctgggggagagggaactgctttccagccctgcacaccatccattcactcacccctgtctctcaaacacagcagctgctctgggggcagccctggtgatcagggatgaatcttccttagtttgagagggggccacttcagaggggctgagggcctccagcaagcccattccacaaagagctgagcagcccatgcaccctcagagaggaaatgatgtgggtgatcacaaggaagaccctgtgtgggctttctaaagcatcctggaccagtccttgcagctgactggtgactgtcgcccctgggtctccaccatccctcacggcaagaacaccaggtgtacagcactggctgggtcaccccacccccatctccatctcccggagcctcctcattccttccccttccctgcccactgacaagtggagatcaatcctggcttgttgagagaaggaataaagcaagcattatttgataagcaataaagaagccatctattctgggcccagagctgcttgttcaatgcactcagggggcagctcagctgtggaggtcactccaccctggcctgcctcgcataaagtgaagcccttggcttctatacagaaggccctggcttgggacactcccttgcctgggtggccactgtcagcacataaatcagggaggaagacagtgagggaaagagggagatccagtcagagacacagggatgggacagggcaagagaagggagagagaagattccaaccaaaaacaaaacagaaaaacaatgaaaacaaagcagcgaggccaagagtcagagtaacagagaccaagagatccacagtgagtcatccagatcagaatccagcccccagcacctctctggcgcccttcaacctggggtcagagcaggcaattaattaattaactcattaagtccttaattcaacaaacagttgctaagggctgctgctgtccagggatgtgctagtatttggcaaggagtgggggtagtgagtgccccaaagtgagaggaaagcaaggacaaaagtgatggccagagtggcttgggccagtgggaagactacttgatcaggagtcaggggctggatgcaggagacctggtcaaccatttttcctctgtaggtctcagttgcccagtctgtaagcgaagagggtgggtgaactagtttatttccaaggttccttccatgtctgagattctaggactctgtttataggaatgactctgagaggctgcttgggtgctgatgcctagggatggcccctcaaccattgcccaggccaggagtggggaaaccacttggctgaggcctccagaagagctggaggaatcaggacatctggattccagacttagctttgacattgttctgtgtgtcttttggaagatcacagaacctctctggacctcaacctcattcacctccaagtgggtatgacaatcccagaccaccaagtgagtatgacaatcccagccaaccttatgagagcttcatgaaggacagtgagaagggcagcaaaaggactctgcaaagcactggggatgaaaatgacaccacctcccatctctgagcacctaccatgcaccatgctttcgagtgctcacctccacccatgagatcattatctcctgtgtctacagatgaggagtcttgggcactagtccctggaaagctgagaatctccccctgcggccccctgcaaaactgcacaccatcatgaagtgctgctgtgactgctgggcttgggcaggcggcagggatagggccctaccctccaatctggctacttcttcttgtgcttctcccaggatgatgccttcctgccccaaaggaacctcagagaaactcctatctcccagaagcccttgctcaacccaagctccacccaagggctggtgggagcactggcctagcgtagggacactcagacttgagtgtccctcagctcactccccagagtttctggttctgctggtctggggtggtgctggagaaggtgcctacctagtgtgcctccaggtgctgttgctgctggtccagagacctgctttgaaaaccactagcctagggcactgggagatttaagctgggtgaagaccagcaattcaaggcattgatggcctcaggagaggcccaccacctctggggcagctatgccctcaaatgagactcccctgatcaagccagagctgtggagtttgctgctgcctgagggcggggcagaatgccagtaggaattggagttgcatgacttggctgtgacctcacagggtcagctgaggccaggctgggcccagaagctgggtctcctgatgcttagtgaggacaagcaccattgggcctcaggcagggaagatccagggtacacatggcaggagcccaagccttcaggctggaacactcccccaacccaagaagcccttcctcttctttattagtacactcctctctggttccaacctggggggatggaggaaagagaaagagggaggcctgcattcccgagtcccacgtctgccacctcttggctgagagaccttaggcagatgattatccccctctggggcttgatttcctgtcctataaaaggaagtaacactcccctcctcacccagggtgatgaaaatttaacagatatgggccgggtgtggtggctcatgcctgtaatcccagcactttgggaggccgaggcgggcagatcatgaggtcaggagattgagaccatcctggccaacatggtgaaatcccgtctctactaaaaaataaaaataaattaaaaaaattagctgggcgtggtggtgcgtgcatagagtcccagctactcgggaggctgaggcagaggaatctcttgaacccaggaggcggagattgcagtgagccgagatcgcgccactgcactccagcctggcaacagagagagactctgtctcaaaaaaaaaaaaaaaaaaaaaaaaaaaaaagaaagaaaaagaaaatttaacagatatgaatgtgtcacagagtcaagatagctaaatacttaagaacctgggctctggagccagacatggagtcctaccctggcttcactgcttaccagctgtgtgaccttggccaagttactcaacgtctctgtgcctaagttcatcatcaaaggagaattctagtaatacctacttgatagggctgttgtgaggatttaatggcttaatgcgctttggacagcatatggaacaaggcagactaccaacatctacaatgcaccgttgggggctaacatgtgatcatgcccccgcaccaggcctaagagcagtgggaattagttctgcaccaaaggaatgaccctctgatgtgggtccagtgactgtggcagaatttccagtgcctgtggcagaataatgggacatgccaggcctttcaaaacctagcacatggacagtacctattttgcccaaagttagggctgtctccagaaagaacagaaccagaagaagttctaaaaaccaactggctatgaggcccacaggcaaatctggcccaacctattaggtgagacaggtcacaccacttgatgaatgacatagtgaggatgtgaaagggaagccatgtgcccaagggtatgcagcttctctgtggggggcctgggtcagttcacaatccccactgctcttccctggtgcctcgtttcctgggccaatggtgagggcaggtgtggagcagaccccagtcttgtcttgctctctgctttggatgtcttgaaatctgtgatttttccctgaggtttaataatcattttgcctacatgtaatttgggattgtcttggagtgcatggaaataattatatacacagaaggaaagagagggggagagagagagtggagagagaaattgaaccataaaattacagaatcagacaacccccaagccagaagggactgcaggcactgttgagtccacctgtctcaatgtgtttgccgaggggggcaatgaggctcagagactgggaggagctgagctgggaccagagggtgagtcttgactcctgggcattgcaccttaagaccaagaatgacttgctctgaagagaccaagagggagccctagagagcaagggcaggactgagggctgtggcagaacctgcaaacctcgtgccagaggtgtccccaacctctgtcctggtcacagccttagcgcccctcgctgaaaaactgcacccatctagtctttccaccgatagcaacttcctcccagctcttgcttcatgctgcacctagggaactttcttatcagccaacaggtccacgttgcccctgtgcttccagcccttccatactccccaaactcctaagcctcccaaacataactccctacccaccccctttcctctccagcaagcagcctccaccctgccaggcctgcctcctcaccacccctacacactcacactccatcgagctcacttctgcctctgggcctcacctgacacgccctccctcctttcctactcactccgtcttcacttcgagaaggaagccttccctgatccccagctgaggtcaggttccctatgaaaggctctcaaagcaccctgcacctctcctgaaaatgttacacaatatttaacactgctacaattttgcacctatatgttataacgtggttgatgtctgtctccccactacacagtaaaccccatgaggagcaggactaggtctcttgctcaccgctacatccccagctcggcacagggatcggcacattctgcaaacacagctgttggatgagtgatgagttgagacagatggcttaataaaaactactcgggaggctgaggcaggagaatggtgtgaacccaggaggcagagcttgcagtgagccgagatcacaccactgcactccagcctgggcgacagagcgagactccgtctcaaaaaacaaaacaaaacaaaacaaaacaaaaaaactgctgggggcttcttttctgaggaagagttccatagacctggacaatcctatattgccagacgccaaccctctctccagccctggctgagccccctctccagtggaagctttgctgtgttccttaaggccttagagctaggactgaggacctgtagtcccagaaccagcatcctgtacccccggaccccccaccacaccccccaccctgccccacctcacctcccctgacaagctgccacctccttccctctctcccagctccccaaggcagctggttacataactggggattctgcattatttatgaccactgattattttttaattctgtgattacgttattatcttcttggggggctgtggagttggaggggcagcgagctgatcgtgattcatggctctcatcctgcaatttggcctaattggccagggagctttggtaaatctgtccggaggaggagaaggcaaagggaaaagggaggaaaggaaggcgtgaacaaaaataataagaaaaaaatccacgcaattcttgctgagctgcaggtgatggagctgacccactttggcgcagctccgtggtccccagcctctcctgctccagctgcttcctggctgggccccatttatctcacacttgcatggcctatggctttccctgccaccttcagacaaagccccttgccgatgggactgcacaatggaatggccaggaaacagaatgccaggatgactgcttcctaggcaaatccggtgggggatcctccactgccacccaaggctggggaaacgttgtgccaacccctccatcttcctgaggtgtttgggccaaagtgagcaactgtgcccttaagttatatcccacccaagagtcaccgatgatgtgggagacactggtgttaatgcaaggatcactattgagcccccatgttgagtgacgcctgggggagggggaaaccaaggatgaggaggccaagtacctgctcaaggtaagctcaatacctgggggccaaggacaggggcccttaaccctgcctttgggagcttctggtgggtgggtaacaggggagcagtggggaggcagattcccacccagaaacatgaccagcagattcctggagagtgtgtgggattctcactgagaacgaatccaaattccgtgcatgctgtgcatggctcgacggaatctgactccctgctccctctttgacctttcctctactcttctccttgttcactgccctccagctgctctggcttccttagctgaacctgcatatgccaagcacacttcctcttcgagaccttggcaccggctgcaccctcagccgggaatgctcttcccctagatagccatgtgacttgtatcctcacttctgtggggtctctgttcaaaggccaccttattggagacccccttcctgcccccatccctgtcactctctatctgcttttcccactggcagggagtgagactgctgactgcaggagaaactaaagggccccagccaggaggccaggatgtggtcctgacctccctggtcatggctaagaaactgatgtgattccagaaaacaaggccgtacgtggagctgaggagcaggccagttttagaataattcattaaaaacatcaaacagatacggagtgagctttgtgcctctcattgtgctaagtgctttatatatgtctcatttaattctcgcaacaaccctggggcaggggtaggggaggatgcctaaaatgtagtctccccatttttaccaatgggaaaacagaagcacagagaggtaaagtaactttcgcaagttcacacagctaaggagagggtggagctcagatttgaactacaggcatctagctgcagagcccatgctcatagcccctgagctgttctgcatctcttacttaagatctacagaactttgaggagcttagagaacctgctgggactggcccggtatcctggagtactggggagcctgggagagataagggctaattaacgattgaccgtcatatccctctgcagcacaattttagctttcaaagcacttttacatcctcacctcacttaatcctttaaaagactttccccaccaatgggatagaacttgctcatcgcccagggagccagtggcagagctatagtaggggtttgcgagggcgagggaggtgtgggagagggaacttcaactcttctaggagtgtgagtaggtgttgatccccgcgcccccagcccactgcatgccaagcccctaataaatccttataagatcaccgtgcagtgcaaatcaccacatcccaatttcagagatgagcaaactgaggctgagggacctggggaggaagtgctttggtgtggctcatctttcagtgaatttcaggccatatgctcgagaggatgaggagagtctgccatgatcagtggcatcagggggctggggaaggggagcagcaggcagaggaggaagatggctgaggggaataaagctaagcccttccactccgctggccttgttctttcaccaagcatatgtgcagccccccacccccaacagtcttgtatgtgactctcatctccacttctaagtgcttggcctgagacaagaacacagctggtgggctctaagctggtgctgcccaggtcatggggtgaggtgagggaacaagtgagtgcctctcaaccttgagcctacccatgcccccgataaaaaaatgctacacaaagggactgaggagagccaggcagattcagctttacagctcccttggagagccaagagccaagaccacaggttccagagagcagggagattccaacccttttctccaaaccggggtctggcacccccccttggtaaccccatccctggcaaatcccatctcacaggaagacggtgatggcatctcttcttttgcttgggcctcccagagcttcacctgccttcctccacactcccctctgcctgtcaccctgtgtctagaccctgcctgggggacgagagagttctgaggcttacccactcccccagctgggtgccattggcagcgggcaggcagtggcatacggggtaggctctggttgccgtagcaacctgccaaagtcttgggtggaggcacatggcctacagggtgtgtggggggaggggactcattttctctgtcctggctgaggcctctgggctgcatagcctgtgaacctggagctctgctattggagacatgggagtgggtgagtgtgaaagggaaggagagggcatctaaacgatctgcaaataaatcctagagctattgcatcacagatgagcataagagatcatctctggaaggcccctgtcaaaatgcaaagagatcgcccagtagctcacctgctgaaaccccagaaaaggcatcaggaacccgagttctaggcatacttctgccactggtaggctgtgtaaccttggacaagcccctattgctctctgggcctcagtttcttcaatagtaaatggacagagctggtctggattacctatgagatcctttgaagctctgggtggctatgcggtggggagagggaacacagatgcctggaagatgcccaactgggaaaaggctgggagttgtatcagagttgactcccaggcctagagtcaatcctggctctttgtgggtacctgccggggcataggtctcatgtccctggccaagactgagactttggacagttcccatggccctgatctaaaataagatggaggcagggggaaaactgtagtgccttggacccaagagtttggaggaggaagcgttccgcaggggcatctggcgcttgatctccaaattgtactgtccaaagatgtgcaacccagactatggccggcccagtccatgggcagaagcaccaccacctcagtctgcctgaagcaacagtcattctcatcttctgagatgggatttcctggtaggctccacgaggctgaccctggacagctcttgtcctggcatctctatgcccactccctatcccattctgaacacagtgcccttcaaacaacccctcctccttggctctcaggccaggctgcaatgccactttgccagcctggagttggtacctaccatcaccccacctcttcagccttcctagagcccctatcctccctgcacagctggccagggagagcttgagcccataactccaattcaatcactctccctgccatctctgcaggggccctgattacaaggagttgaaatttgcctaaagcccacctggctggtataatggcacccagtgggcaaattcaggctagcagctcagaacgctggtcatgcattttggactcgaacgcagcacagggggcagggctgaagacatgtgtacctcattaccctagcgatgtgagaagcagtaattaaaccaggctccacttagaaagacagagagggacacacacatcccagcatttctcagtggcttttcagccttggcaaaaatatttagaacagtgggatggagactcgcatccccttagggaagactcctgcccctgccaaaatatgcaaggaactctgttatccactacagcacccccagacccattcttacccccggacaaagaggacatagctggcttaaatttttccaagatcaagggttctcagtatctgtgtgatttctagggatatgctttgagctgggcctcaagcagtggaaaccacctcagcacaactatctgcactctcccagggtcccttgtgaccagatcagagtctgggagacagatggtgggttcaagggtcagcttgggtcccagaaggttgtcttccactaagaagctgtggcgggattcagtccttactggccatcttggcagccctttgtgctaacccagagctccaggcccactgacatgctgctcaagtaacctctacaacaccgaggcccctccagccttggggtctgatgagatttttagcaaagcagatttgcggaaaggagagcaaggagaaagaaggtccccagtagagtgacacatgtgcacgcagctttgcacactccaacgtatttatgagtacgtttttgtgccaaacccaagaaggttggcttagggtctgtctggtccctcctcacccctcacttacctccctcagctccttggccacctccttgagctcgcgaaggatgccctcaagctgcccgatgaccatcttcatgcgctgtcgaatccgctcccgctcaccaccactgctggggtcgtcactgggctgcccgaggtccggggcgccccgaatgttcatcgtttaccacgtggccgcaggcctgcccatactccccccagctgggcacacactgcgtctgcctccacggagcccccctcggctgggcagagctccacattttaacggccccccagcccaccctggccctgggcggccctcaaccagcccctgccccctgccacccagcctcctctgcctctgggtggagagtgggacacccagagggagacagagtctagcagagggggtcaaggtgaggacacaggagaggagggggagggaccttgggtcccaggagtggcctccaggtcttgaagtgcctgtgggtgtgcagagctgatctctgcctgagcttgaacacagaggcagggggatgactctgcagggactaagggtaagagatgcccttgggatgggggaaggcagcagggatcccctcacaactcctaggcagttgcaaaggcagaggtctctggatgcaactgacacctgcagagggatggtggccagggtcttccagatgtggaaggggctccggatatgggcagctctggggagggagctggattggaagagggcagccccctgcggagagagcgagcctggcgtcagccctcccaggctgcagcaccagccggcaatgccgctgcctccctcctctcgccagcctgcacccttcctcgctggggatttttttttctttgtggggaggggtggtggaggcagacggtttacagcacagcccctcctctagagggaaagggagggagcccctgctttagaagcagaagtcctcagcctgctacggggcaccctggccgtagctcccgccctccccccccaccttccccccagccaggcctgcccaggctggttcaccagagggcctctccagtcacccatcctccctcctagcgcccccagggtgccctcgttcccagcggaccctccctcccccagccccgccttccctcagaacccccactcctggactcaccgagggtgggggcaccggccttccctccaagcagcgtcgggggccaagccccaagacggagttggggggcccccaaggctccctagggcgggcttctctctctggacccttcggccccgggcctcagggaggtcctccgagccgtgaccggagacatctgggcggtgggagggggcggggcctccgcgctccagggaagggggcaggaaaaatctttctcaagcctctccaggctcggggtcgggaatgagcgagggtccggcagatttggggctccgaggccacaggtgaccggggcgcggggaggccgaggagacgccgggcaggtcccagcgcgtgagccaaagtcggagggctgggagggcgccgggatcccctcagcccacgcccggcattccccgggctctgcaccgtccgggattcgctctgtccagtccagatcggccgggtccgtgttccgctggggtctgccctgccctaccccgcccggagtgagctggcaccgccgggcgcccgggacgcgctcagcccggacccagaacgtccgtgccccggcacccgcggcgtccggagcggccgcgagggtctgctcagcccagccccgcggtcggccctgggcgagaccgctcccacggctcagttcacgttccgaaaggtccggaatccaccgggtccccgaggaggggcgatgtcagccgcggggacccggtccccgccgggcccagccgagagcgcgcgaagccgggggccccggccgggctgggttcggcggcccgggcgcaggcgggagcagcgccgggcggaggagaggagaggaggcgagaagaggcgaggggaggaggcgcggcgaggggaagggaggggagggggcgagcggcgggccgggccgggccggggcgcactaggctcgcagcctccgctcggctccgctacctcccgtccgttcgctctcggctccccgcctcagcagcccccgggcgccgggtcgccgccggtggggcaaacaggcgccgggtcggggctgggcctcccttcaccgcctcgccctgccctgccccgccgggctcccggggcctgggcccgctccccaagcgccgcggcgccgcgccgcccgcgccccggccgcccccggcccgccccgccgccccccgccggactggccgcccgggcgggcgctggctcccttaaaggccgcccggctcgcttggctccgcttgcctcggcgctgtcagggaaggggccggcccgccgcgccgggagggagcttttaaagcgacacacacgcctcccaaccccgagggccaagcgtgcgagccaggggggtctcgccacccgggcgagggggaagggtctcgctggcggggctggaggcggactgaccggaccccacgccggctgacctggggcgcggagggacagcgttctggggacttcgttcctttcccacctctccagacacccccattgcccccttcccctactgcactgcccccaagcttcccttttggccacgtttcccgcatccagaccctcccttctaccacccacataacccagcccctgaccttgcctgaaatcacattcattcagaaaatagaatactgccaacctttcctgagaacctactgtgtgccaagctctgggtcggcagggctgggggttggaggctgtcttggacacccatcgtttccttcagctattcaacaattgactcatgtattagaggccttctgtgcatcaggttccatgctaggctccggggccaccagagcatttcaggaagctcacggctcggggacactcctgagtcacaacagaggcaaattctggaagcaatgttaacaggggagtagggaagtgtgggttgggtggtgcagttcaggccagggcctggcgggttctgccaggtaggccacccctgagctgaatctcaaaggaggagtaggagtgactgtcagtgtggggggttggggatcagcattccaggcagggaggagggtgggagcacaggctcagaagcagaaatgggaggaggggagtttaagttaactggggccttttagataccattttgactgcagaccacagagagactcagagaccatggttaggagcttagattttatcccggggcggagggagctttgatattgggaggaacctgggcctgcttgccttctcaggaaacccctctggggcattgtgagtgggtgtgaggaggtgccaccgagatagagcagttaggaggctatttcaccgttggccagaagacagtggagtctatgaatctatgctcatgagagaggctggggcttgagagtaacattttgtttgtttttttttttgaaccatcattagaggggtgagatgaacagggacgctgcgtagaagtaacaaaagcagtagttctgggctggaacctcagaaaagagtccatgagtgagagggaggagtgattagaaagataggagaagaaccagaaagtggagagttatgtaggcccagtaggaggagtttgggagaagcaagtgctcatcagtgtcgaacgcggcagggagtggctgtgagagaaggaacagaaagtgtctatttgtcttggtactcaggaggccacgggtgacatggcaggggcaattggttttggagggtagaaggtgacaggaaccaaactgttgggcatcgaggactatgtgcccaacagtgaggaacaggagtgagtacagatgacattttcaaaagtttaagtggcggggaagcagagatcttgaactagaggcagaggaggggtcaagggaggtggggctaggtggtggttttaggctggcccatgggggacttgaattccagagacagtgatggtactgtgggtgctaatgatgttccttggtctctgagttatctcagagatgtattcacagggggctgctgggggaactgactcctacttccttgagattcagctcaggggttgcctttggagaaccagaagctgtgagggtgggaatccagctgccctgggttggggagatgttcttctgatggggtggatccagagggcccaccaatcacttaaaaaattgtagcaaaatatgcgtaacataaaatctaccttttttttttttttttttttgagacagagtctcgctctgtcacccaggctggagtgcagtggcgcgatctcggcttactgcaagctccgcctcccaggttcatgccattttcctgcctcagcctcccaagtagctgggactacaggcacccaccaccacgcccggctaatttttttgtgtttttagtagagacggggtttcaccgtgttagccaggatggtctccatctcctgacctcgtgacccgcctgtctcggcctcccaaagtgctgggattacaggcgtgagccactgcgcccggcctaaaatctaccatcttaaccattcgtaagtgcatagttcagtggcactaagtacattcacattgttgtgtaaccatcaccaccacccatctccagaaccttttcatcatcccaaactgaaactctgtgattaagagctgatagcagccactctctgtggagcacctaccaggcaccaggcactgggccaagtacttccacatgcattatcttattccatctcacagtgactttccatcacccctccccccgccagcccctggcaaccaccattctatcttctgtctctgtgactctgactactctaggtgcctcatataagtggaatcacacagtctcaccaatcacttttgtggaagcagtgatgctaaggaacagccgagaccaaaaatgggctaagcctgaaaaaaaagagtttctagtcttaggtccagggaatcatccgccctcatccaggatgagggagatgtgtttgaactggcaaggttaggagacagtgagcttgattggacagggtggactgtgactgcttaatacataattgatctcgggtctcattaatagaagcacagtgttttgaaaaagggaggtaacatttcttctgtcatttgtgtggatcaaactgtgcctagcacctcaattcattgggtgtgtccataggaggacagccaagtagaataggggaggtgactggtgtatatgttctatgaaggatggtagggctggtcagagcaggctagagaagaggagactcaggagaaggggtctctgattgtaaatctccaaagagctgccacaggcgagagggaatagatagtatctgggtggtgctcagacctgccttccttagtgtttggggattgatccatcctttcttccacccaacctccctggccacctgcctagatgtcccatcctttagatctctgcttattcaccgccaacctccaccctctaggcagccttccctagtgctttagtctacggagagaaatggaagcacttttttttgcccttaaccaaatgcttcccagggcattcatttaatgtgctagctgtgtgaccttgagcaagtcacttaacctctctgagcaaggatagcagcctataaacattttaattctttcttgaattgggtctcttgtaaaaaaaaaaagggggggggatgtatttcactgtctctctgattcagaaaaatcaggacaataatgactactttccagggtcactgtgaacatggaataagataatgcacatggaagtacttggcccagtgcctggcacctggtaggtgctctgtaaatggtagctgctatcagctcttattcatggcttcatgtctgtaagccttatttccatgtgagtctgtgaactcctcatgatgggcttgtgtgtgtctgcccatctctcacatggaccactgcagtagacagtagacagcgatttttacctgtctgcctgttttccaccatccagttctagcattccttttcttggggaaactccctgctgtcatcacataatcctagtgggttgtcagttaaagtgcccactactcccacccatccctatcccactgccactaactaggcatgtgactcagactgcaccaaccgtggaaccccatcctccagcaacagtgattggtccaaggggtgggcacataacctaagcaggaccaatcagattctttccctgggattgatatgtggatgctgggaggaagaacccctcttcctagtggggtgcaaaactggatgttatggtccaaacctgctgacaagccatttttcccactcaatctaggaagctgagcaaggcagcagagaggagaggaatttagagagcatgctagcagcattgagtcccagtttttgttctcatggccttcactcctgcagttcttctttcagtctggagagctgcaacaacatcctactcatctctaagagctgataaattcctcatattgctccagttcgtttggtggggtctctgtctcgtgtaaccaactggagcctgacagatgcactcaggaaatactaaatgagctgactaaatgattgactgagtaattgggttcccagatggggtaagatgtctccaaatcctgaagccagagggttgggacctgctgccctgtggccatggaggggaagtgggggcatttgggagattattgcaacaggccaacttggatttgggccccagctttgtcatttgctagctgtgtgatctcaggcaagttacttgccctctctgaacttgagatcctttgtctataaaataggcaaagtactagtgactgcctagggttgctttgaggatggaatgagataaggagcaaaaagcaccaagcacagtgcctggggtgtgggggtgagggagcaggagttggaagaatggtaagaaatggtaactgtttttatttagtctgcagtctactctctctaatagcgcaggactgagactggcatgcagctcaggagagaacgaggattcagtctgcaagctagattctcagaagcaatggatcctgacaccagggaagcagtgccggggtgacagtgggcatgtttgggcttcgaacagataatagagacagtagagagagtctacagagagaaatggaagcactgcctaacacttaggcagtagagttggaatgatagggcaccaatgccagcttttccattaaccatgtgactcatttaatcttcccaagcctaagtttctcgttctgtaaataccttcctggtagctgtcttgaggactaaataaaacagttcatgtatcatgttcagcacagggcttagtaggcgtttgataagtattacctattattattgatattgggggcttagggaaattttctaaacacaaaggttgggatgagtggcagtcaggtgggatcagaggcaaacttttcatgacaaagtccccaaataaaggagttatagagaatcatatctgaatagccaaggaaaggccatttcagaatgacagggtgacatatctccttctgtggctggacagtgtcgggttcacactgggaaagccatgtctgaggacatttctgtcatcttgctgcccacaataatctccccagctgagtcaagtttctcaagagttttctacactgactccttccacttcctcacttcccactcactcctcaaaccttgtaacccgcgcctgctggcactgcattgctggaataaccctcactgtgcaggacattatccttgctaagaccagcagacacttttcttcccctatccaaggcagcgaccttgggggacctgaccctgctgagcttgtcttacttccgggtcccctgtcctgtgtggcctcatgtctcctttctctactgattcccttcctgcctctctggctgctgcttctcagttggcttcaggtgttcatcttctttctctggccccttaaaagttaagtcctcagggccaggcacggtggctcatggctgtaatcccagcactttgggaggctgaggggggtggatcacgaggtcaagagatcgagaccatcctggccaacagggtaaaccccatctctactgaaaatacaaaaaaattagctgggtgtggtggtgcgtgcctgtagtcccagctactcaggaagctgaggcaggagaatcacttgaacctgggagatggaggttacagtgagccaagattgcaccactgcactccagcctggtgacagagtgagacttcgtctcaaaaaaaaaaaaaaaaaaaaaaaaaaagctgggtcctcgagattctcgtctagactctcttctcactctatacaccttccgtaagggagctcttcacactcccaaaaagtttttgacttccaattcactgtctccagaggagacctttccaaagcttcagatcatattgccacttgcctactggacagttcatgaggttgtcttgcaggcacctaaaactcaacatgcccaagttggaacccattacctttcctccaaatgtatccccttttgtcttcctaatttcagagaatgtcaatgccctctactcctccatgcacgccacaaacttgtgatcgcactagagtcagagccagagttagagccaccctagagccagagctcttccacatttcttcagttactaagtcctgttgcttccacccactttatctccctgtcgataaccaggctcttgattgcacccatgagcccctgtattagccagcagcctcctgatggatctgctaatcttcacacttaccctatgaagtctgctgttgctgttgctggtaccagccttctgatctacccacttatgaccatccacagctccctgtctttatgaggaagtccggtctccctagtttggcgtccacatctttccaggagcctgcccttgtctagctctccaacctcatctctattgcctcttgctctctgtgcctctgccaggctgaactgctttcagctttttcctcaccaccaccttatacctgccctcctctttgcctggaatgctcctctcctctctcttctcgagaccaacccccagaccctcctgaaatattcttccagtgtgcaaggtccctcctctgcaccaccccagagccctcgtccaccgcaagtacagtgtctgccacacttccttgccattgtgaatccagctctcttccacagaccacatgctgctggagagcacctccatgcccttgacatccagtagagccagtcaaagtcagttctcaaggcatgttttgtaaatattgagtgactctctcaaataattatttattttgcatctttgttaaacacactattttaaagatgaccctaaggtggaaaaaactggaaggaaggggcatggcacataactcaggggtccccccaacacgtaccctgaaccttaatggccttccccagaactctaacactcagacatcactttccccaggaaagacctgtatgcaaagccctgctgtgtgacttagaccaagcatatgccctctctgtgcctctacttcctcttctgaaaatgggatgttggggtattacaggaagatgatattttgcagagtactttcaaagaatcttcagttagcttgccacggcatggaaaaagtatgctgttatcatttctgcctgccttctggggaatttaggctgcccattaccctactccccattctcttatccttaaatctctctctctcacttactctctctctctgtctctcctggttccttcccatcagcatttaaactggctctctaaattctttcatcttacaagtaagatcccacttccctctccaagtactgtctcgtctttcctctttccacagccaaactcacgccaagagttgtccccattccctgcctctccttccctggctctcactcatccctcttccttgcaatctggcatccgcctccaccactcccctgaaaagcctttaaatgctaaacacacccgtgacctctaagatgctcaatccacaggacacgtttgagccctgatctgacttgtcttctcactgcatttggacattcagccgcctgtcctctctcggcatcagggatttccagccttcctggatttctgcaggctgcatgttcatggctggctctcagcttcctctgcccactttccacactgcccaactttggatgctggagttgctcaaggctcagttctgggtcctttgctttctcatgtctctctctgcctcctcagttgtatatccttctctgctgattgccgttactaccaatatggccacgaatcccaaatccacatctccagcccagattctccaattccagactcatggatccatcttcatgtcttccgagaagctcagattcaaaactgacctcaggataaactctttgctatggtctaaatgtggtgtctctcaaatattcatgtgttggaacctaatccccagtgtaatagtattaagagatggggcctttgggaagtgattaaatcatgagggctccaccttcacaaatgggattagtgcccttgggagctggcttgcccctttcaccacgtgaggatggagaaggtaccatctctggcgagcaggccctcaccagacactgaatctgctggcatcttgatcttggatttccagcctccagaactgtgagcaatgaatttcttttgtttataaattacccaggctaaggtattttgttgtagcaacagaaatggactaagacactcttcttccccatgttccctacctcagccactcttaccagaactctgtgagtcttcctttatatcttcctcccctctctcctgcctgcctcaaatccgcctccatttgctcattctcctcctgaagatccctcctgtctcaattctctgctgctaccacctttgtctgagcacctgcatctcaaccagacagtgaaacccccagaccccaccatgtgctctctggtcctcttccatatattcttctcataggagcacagtattcttaaaaaacttggagtgtgacagtctaacatatcattctcctgctccaaacctctcacgatttcacatcttccaagccccaaattctcaccacgttcacaagaccctgaggtctggctcccgtggctctctcctgtgcccctctttcctcactttcattgctctctgcccttcagtcactccagcctgccttcattgccttggatgtgcacattttttgcctcttgactctttttttttttttcacatgctgtttcctctgcctggggcactcttgctgcttcttcacctagctaacttccactcaccctggaagacttgacttaaatttcaagcctccagaaagccatcccccagggggatgtcctccttcccattatttgtcacagcataacacttacatttcctgctagaatgtatatcccttgaagtgactacaatatgaagtgactgcaatacacttgctcaatgaatacaactgatggagttcagggtagttaaacaacttgcttgaggtcgcacagctcattagcagcaggtctcatcttaaacccttttagactatttttcatgcctctgccatggggcaccaccacacacaaattcttatcaaaacagtaaccacactttattgtagctgtgtgttcaatggcccgtcttccccactaagcagtaagcttctaaagcagaggccatgctgtcttgtttattcttgtgtccctcacttttagctatgcgtctggagtgttctggggatggagaactatgaatgcttgttgatggactctctggtgatgagtcccccagatttgtttccaggtctgacttcctaacaagcaccaatcttattcattagcccagctatggattgtgtttcctttgaattttcattcaaagttaactctttggaagtaacttttattaaaaaaagaacaaatcagtgaataatggagggaagcacacaggaaataagacaaaaagcgtaaaacacaagatgctagaaaaggttgaggcacagaagttcagctccatatagaatctgtgccaaggccggatgcggtggctcacgcctgtaatcccagcactctgggaggccaaggcaggtggatcatctgaggtcaggagttcaagacctgtctggccaagatggtgaaacccatctctactaaaaatacaaaaatagccaagcccctgtaatcccagctactcaggaggctgaggcaggagaacccttgaacctgggagtgggaggttgcagtgagccaagatctcaccactgcactccagcctggttgacaagagagagactccatcaaacaaaaaaaaaaaaaaaaaaaaagaatctgtgccaagttatccacaagtcactgtcccccacccaattctgcccttttggttcttgagccaatctcccacctgcgactcccaaccctcctaccccattctctgagctcagtcctggttaggtgatacttcctactctttggaaggcttctttgggcaaactcacttcctattcatgccctagttggcaaatctgggaaaatacttctaaaaggcttggggtctgtcttagtctgttttgtgttgctgtaacagaataccacagactggataatttgttttaaaaagaaacttatttttcacagttctggaggatggtaagtccaataccagggtgccagtatctcttgaggccctcttgctgcgtcatcccatactggaaagcaagaggttgaaagaggccaagagagattgaacttgaagcctcaagcccttatataataagcatgaatccatttatgagggcagagcactcatgacctaaacacctcccattaggccccatttcccaacactattgcattggggactaaatttccaagacatgctttttgggggacacatgtaaaccatagcacatcaatgatggggaaacaaaggcccagtgagagttagaaatggacaatggagttctgtgtttatcccacagacatgggttatgctagtgctggctgagcctgtctgcactttcccccagagagctatgtgaccttgactgggctatttacacccctctggatatggaaggagaggagcagagggctcgaggctggactgctggggagtgagggtggtggcggctgaactgactgggaaggaagctggcaagactgaggctgaactcaggaggaagggcgggacaagggggccaaggctggacaagaacagcaggttcttgtcaaacacacagtttaattctgaggctgtattccttgtgcctgggagattttcagcttgcaatagtgtcatttacagatggatttgcagcggcgaattacaagtttgtaagcaacagcttctctgacgccttgaagaaaaaaaagccttatccctctgcaaattataaattcataactaacagtgttatccaactgaatgcaaaacaaattcattaccaactacattattccattgaataccaagtgaatgaacttcacagggctttgtgcagatcggggacatgttgggagatgggaacgaaacagcactcccccacttgcctctcctttgtgtcctttcaggcccagaaggtgggcagaactggacagatgtacactgcttgaattaaaaggtcactcgaagttatgatggcgatggtggcgatggtgatgatgatggtgctggtggtgtaccaaaaccaatgaccacactgcgattgtgtgtgtacctcttatatgattattaggattgctgtggtgacatcttaagacactatcttgtgaaggcttacatgcctaagtccctgtgactcgcaggacacccctgaaaagggggatcacctcctgtcgttcaccatgcaggaagatgtgggtcctctgagcttctcatcagagtgagaagatggggctaaatttaggcattcgagcagggattccctgtgtctcctcaggacgttgctctcttgggatcaggcttcaaagtgctgagacatctagatagaagcttctgggtgctgggtatcaagacagtgcccacagtgtgcaaacagcctggggtctatgggagaggacataggccacattttgtaacccagattcttcacttccctctgactttatgatgtattccccatttgtggtccctgatatttactatttttcttttctgtctcttttagaaaattagaagatacaaataaaactaacaaatatataagtcatccctaattttttttccaccagaaagaaccactttggggtggatcagacctgaaacttggccccttttccaattctcacagaaaaatccttcattcagaaactctgagcattcagtagacttgactgaaaatttgatatgggggaaaagaagaaatggttcatactgtagccacacaaacaactttaattatttatttatattttttgtagagacgggggtctcattatgtttcccaggctagtcttgaactctttgtctaaagcaatcctccctcctcggcctcccaaagtggtgagattacaggcgtgagctctggggcccggccacaaaagcaactttggagaaagagcaatgatctgggaaattaaaaggccttcccccactccccacctcactaggcatttttcttggcatctgcaccatctcctccatgctaacttctttggctctcccttctcctctgatcatctcacctttctctgccatcttcctcaggagcaaaaggaattcctctccttgtctcatgctgagtggtttgcaatcactgtatgtctagatagtttaccaaagttttttttttttcccaaagacagttttccatctaagaagaattttgatgccaggtgtgaaaatattttcatcttgtttcgtgaagacattacacttttagaactagaggataattttataaatgctgatatgaaacctgcttttgcttataacaatatagagtcagcatatttttatgtcaataggcaaatctatattttctgttttaatggctgcatattaatccatatagtttctttaaacaatctctttttttgctatacatttaggctgtttccaatgattgttattataacatccacacatcatctttgcaaatttatctaattattgccttatgataacttcttagaagtaagatttctgagaatgcacttttcaaagatttttcttgtattgttcagctactcttcaggaagttcgtgccagtttatactctcatcagttgtttaatattattgtcccacttactatgaatgctctagctctatctcagctgtgccttgaggtgttaaagaaagagctcctagggccagtttggtggcaacagtagccaattagtgtgagattatccaaaggatacagaatcccagggagcaagaatgggggccgtgaggtccagctgtttcactctatgtaggttcttttatggcctctcttgaaggatttgaaattgattgcttgattgattttatgaaggaacacattatttccctccaaatgatggtggtggcgatgagtgcatggtcatgatgataccaatgtgtggtcatgacagtgtgatattgatgagggtatggacaatggtagtaacaggttaacagtggttctgacggtgagtgcagtgccaatgatggagatggtggtggtgctggtgttgacaataggatggcagttatggtggtggtagtggtgacaatgttggtgatgatgacttatgatggtggtaagaatggtgatggtaactgtggtggtaatagtgagttcagcactgataagggagatggtggtggtggtactgacagtagggtggtaggaatggtggttgtggtcacagctatgttgtgatggtggttaagaaggtggtgagaatggtgttgacagttggtgatggtagaaatggtggtgtggcattgactgtgggatggtggtgacaatggtgagaagatgtgacagtggtgaggggcagcgtgatagaagggggatggtggtggttcacgatagtggtgagtggagttggtgctgatgggaagcctggtgctgatggtagtgctggggtgttgtggaaacagaaaggtgaaagtgcatagatgatggtgaaggaatgcaatacaggattaaaatagatacaaagggagagagaggttgtcttaggaatgtgaataaaggaagcagcatattctagacctagaacagtgaggagacccactggccagaggggatggtgggggagacgtgcagcaggagtgggtgctgggaagagtcctggaagtagtgagaagaatgtggactccaggagggcagcacggggaggcattctgggtcctgggagggataggtcagagccgattggcctgctagagaagaaaagtggatgaggagccagctgttggccctcatgctggcctcaaatggaggcagaaggtaggctaggccctctccagtgcaggcaagtgtcccaggcatgctggcagcatggaggaagcgggtgtgaagggccttcagtagctgagccaaccttagaatgcatgggcatggggagaggtaaaataccctgtgctcttgtaccagctgtacctggcagctcctactctcacctttgcttgagagggagaagggtctgaagcagggacccagagctccagctcccttctctcccccggctccctgcctctcaacagctccctgaatctccagtaggcagtttttgttcactagaattgcctggattcagagctccttccccacctttccaggtatagcatgaagctgtttggtgtgtatacaaagctgcaggattcactcttccggggcacagatgcctgagaaacttcagagaggcagaaggcgtgagtctgagcagccatcatctgggcatcaaggggttaacccatccctgagggctgggccaggtcttttcctcggactgggccccgccctccggttcctccatagaagccactggagtcaactaggagctcactttgtgggagggagaaacgtttttttctcttatttgaatggtgctggtgacctcacaaggtttccatggtgacaagaccaagggagccagggggccttggtgaattaggccaaacaaacccacctccaagagtcttctcccagactccagccttgaggatgaggactccaggtaatcagtgagcttgctgaagagggaaggttgggggctggggacatgccaggccaggacctgcaacagaaaccgccgccccacctttcctttctgtgccccaccccatcctgcctaaaaagttgctttccatgagggcttggtgctgagtgtggcccccacagggatgtctgtgtggtcacagagtacctgtgggagggcaattctgaccccaaggtaggaagcagtgatccggtaattccaggcaccaaggcagataaaaagaccaaggtaggtgaacagcagagtagaggcctgggtgtgaaaggagaaagccatgagcatctggttgggagtgggagccctgctctctgaagcttgactttctcaggagcagctgggggctggagcttgggaacacaggatcatgggatccaagtgaccagggtttgaaaccaggcataaataatgcctgcactctatggttgtggcctacatgggacatcacagggaaagcaccgagtaggtgctcaatatgtgtttgtttcctccctccttcccttcctctcctctccaccactcaacagccacagcctcctcaagaagtttgaagtctgcattgaactcattaatttccagcttttggccgggcgtggtggctcatgactataattccagcactttaggaggccaaggtgggcggatcacctgaggtcaggagtttgtgaccagcctcacctacatggtaaagcctcgtctctataaaaatacaaaaattaggcgggcatggtggtggccacctgttatcccagattcttgggaggctgaggcatgagaattgcttgaacttgggaggtggatgttgcagtgagtggagaacatgccactgtgctccagccagggcaacagagcgagactccgtctcaaaaagaaaaaaaaattccagctttcaattatttgatcctcacataattcaatgtctaaaatattgtactcctacatattgtcctaaaattctaccatggaagctccaaccattgctttgcatgaaatctccttgtaaatggcaacatcttatctggaagtaattgtcttttccctggacaggggcagttgtatgagtgggtggggagcaaatggggtggggtggggtgggagggtagacggggggaatgagtgatgtcttgtttgtttgatttttgttttttctttttctttttctttcttctcttctcttctctcctttcctcttctctcctctcctctcctcctctcttctcttcttctcttttcttctcatgcagatggggcccatgagtgaggaggacaagagagaaaggagaagtttgggtgtaaatcccagagattgttcatcatgtgagaggagccgtgcatgcatttcatgccatactcacaccatggatggagaaaaaaaatcaagcttcactttctgagaatggccctgggggcactgcatctagtgcctgtgcatctgcagacctgccggatgcctccaggggaatcatgccaccccaagcaagaaagggcccagttgccaggagcctggaggcagagagctgaggagccagcccctgacatcagaatggagctcaaaggttggctgggtgtgactctgccgtggacagcttctcttgggaaatctactttaatgaatccaggggaccaatttgtaatcagcccatcagatgttcagcgacacttagctggaatctcgttgctggactctgtgccccgcagtggatgacagttctccatcagggtctgcagtcctctaccctggacttgctgcatcctggagcccccagcagtcaggtaccggctctcagaactgcctgcatcccattggcctgagctgctgtctgccagggctgctggtaaccaggcccacagggttggatattcccccaacagggcagctcccagtccaagcccaactgttaccagcccagaaagatgtttcaggatacccctttcctccccacttccctgccctctgcagctccagctggtgcaccccatctttctctccccctccctgctaggctgggccctaacaggagacctttgaggtggttgggcttgttctgcaaccttgagtacccttgagctactgcctcactcctcagttttcttcttcttaaggtttctaattggactttgccagtgtatttatttcaaaactggtcatcttactgacctcgctcatagtctcttattacttttctagttgattctcttgagttttctggataaacaataatatcatgtacaaataatgatgacaatttctcctcctttccaaatgttgtgtttccttttgtgtattaatgtactcttgccttggctaaaacttccaaaacaatgtaaaataattgtgttaatagcaggctttctcattctaccctgactaaaatatgaatgaccctggctaggtgttttattgctaagaatgatgttgacggttggttgcagataggttttttttattattattatgccaaggaaatgttcttttatttttattttactaagggttttcagcagaatggatattcagttctgtcaaatgagtttttgatgtcagttaagatgatcacaaaactatttcctttctggtaattgacatgattaattataggggtggattttctgatatgtaaacgtcatcacttctaatgtagacatctttgaattgcggaagagatccattgccagggagaatctgtattggttggatctgtattgtgctgagtcccatgaatgtgaactcataacttttcccgcatcaccccctaatccaggatggcctgtcaggcaggagcactgtgacgcctaagggcttgagctggggctctggagagctggatggggtgtcagcttgtcccagggtgatctttctaaaggccagtccaatcacatgactccctttagtggctccccattgccttcagcaggaaactcgagcttctgtgtgcattttccaggcctcttacaactggcctctgtccacaccacttatcacctccaatctctcacctagaaccatataggaccagaactcctggaaggaggctcccccacatctcctatgcctccggccctctcacttggctgctctcctgcctggaatgtcctttccaccttccttcccaggcaggacttatcagtccctgctcttccgaccccacaaagctcagttactgcgtcattgctacttaccagggggaggttagtttctatgttcacctctatctctagaagccccaggaggttgaggacctgcctgatccaccccatctcatctcccagcccagtgtctgccccatcacaaatgttgctcaatcagccctaggtcaaacattttgttcacactcatggaccccctacttgacccaccgcctgtgacctgcagggttcgctgtcccagtggtgggcactgagaggccccagtcgcaggcctcacaggtggctgcagctccctggagcctctttagaaaatgcagtcggccttgtttcctcctcagaaacaacgacttagcacagcatccgggccccaggggagagtgttcccccctcaaaagctgctgccattggagatgcaggagaggaagccaagtgggcccaggagggaccggatgattcggggtagatgggagggagtgagcaggaggggctctgataggctgcatccctggggtttcctgcacatcccagatgctggcacctgctctgggcctgggccggcaatagctctgtgtctggctctccaccgggccttgggtgcatcccctgattcccccagggtcttctcacccgactctccatgggatccattttcaactctctgtgttccctcaactactaggcagccagctagagtcctcacctcttcagaaaagctgatactagttaagcatcccaagtctgaaaatctgaaacctgcaatactccagaatttgaaactttttgagcgtggacatgatgctcaaaggaaacgctcatcagagcatttcagatttgggatttggagatttgggatgcttaaccagtaactatttgtaaatattccaaaatctgaaaaaaaaatccccaatcggaaacacttatgatcctaagcattttggataagggatgttcaacctgtatcaaatggagggctgcttggctgctaagcctggggtgggacaggagcagcccagacctgccccttcttttttgccaagcaatcctgagttacacaacacattcctggctactatataataagaggttaggtgacatgacttcaagggcatcggagttgggttgtggagtctggcagacccgggttcaagttctagctccacctcttgctaactgtgtgattttgggcaagttacttagcctctctgagacccaatttcttcatctgtggaacagagtacctacctatggaggtgttgtgaggattacatgaaatgactgactgactataaagcacttaacacagtgcctggcacgtagtcggagttcaatgtacattagctgttttataagttacaggtcagcacaggctgggccatagctgtcgcttcatacacctttgtcccccatgcatgggtggagaaactgaggcccagagaggagcgggacatcacatcgctgcatccccttcatcagcctgggctgacacctactgaggagctctctgctgtaatggtttcaatcacaacaaacctgacgcatggagtcttagatcttgggcttgccttctgcacagcctggcaccctcttgtttaagaaacctttacattgcactaaatgccaggaacagttataagccctttatacgtataataacaatattatgcatattaaccttaatccttctagcaaacccatgagagagatactatcattatccccattttacagatgagggaatggaacagttcgagggcttgcccaaggtcacacggctagcaagtgggaggaccactattcaccagcagggatgccatcgacaaggtttccaccctgaggtgaacatagcctgggctctgtggtgtgatcatcgcggggtgatctggggtgtctggggcacctgaagcctgtcttctccctgcaccctgatgctcgggtggaggaggcattttggaggggacttggtggcctgtgactgggcacagcgggagcatctgctttgtcctattaatgctattcactagatgccacatctcaggccacagcaggtatttccctcgagagaggacagtgaaaacttggaacagaagagctttttattattcagaataactgcactatttaatttactattaataatagctcttgagtcaaccttctcctgaagagaagtgagaactgaaaggatgtccctctcttctctcccctcctccctccttttctgcctccttacttcggaatgctgtgaactcagtcacgaatgattgagctgttttgggggtaggagtgggagaaatggaggcccagctcatgcagcgagcctggttactcctcctccctgcagagccttgctctgctgctcctcgggggtccctggaggccatgacccatctgttgtcagatccctccgggaaagaggatgacctgtcctcctaggctgggctggaggctagaggccaggaggctgtttcagctgcagcaaagggaaggctgcatccagcaatccttgccctccttgtcctgagggcaggagtgtgtgtgctgaaataagaagatggggatcccgtcagagacccatcttctgccctctgcatccagcgaagggctcagcgttaagaaggagcacgtccagagaggactacagccaggaatgagacttgaacccaagccaggggaggaggatttggtttggagttcagaagagttgggggactgagaactgctttcaaagaacctgagggatttggttcttcatctacaagccctcactgagggcctgctcttccaggtgctgggaacatgtgaagcccccagaggggcagaggcaatgagatataactaatgctactgtaaggcagtgctccaaggacaggaccaccatgtccggtgaagtcctaggaggtgaggacttggcttgcctcattcagagctaaatgggcctcctggctccctgaggcaaaggatatagatggtcttctagggttgactttatcccttgggcatttattcaagacgtcaggcacgctcccggcatctacatccttgactctgcctcctgtattggggccctgtgggatctcaggtgtgtcaggtggcccactggggctgaccttccagaagatagaggcctgtttctctctttctcctaactacccaactgtgcagagctagaggacagtggctgtccccacaaaggtctctcacggctgcagaccagcaccccgtccacctcctctcacccctgggacatagccaaccagcctgctctcctcttgtcaatctcctcacaccctgcccatctgtagagtgggctgaatcctagatatccttaggtgattgaagagtgctttctaacactctggtgcggggtggtttcggtctggctttccgaacgtgccagagctgggttccacatacctgcatgcacatacactcctaagcacacacgctgcctccacgcatcccggctttcattgtgagggccccactctttattcaaggagcggtctcgggtgtctgaatggatgcttgaaggctccgtctttgcaattaacacgctgctgcagtattattagcctctgataggcaggtctgcctttgccagaaactataaatatgtggggccaatgactcagcaaatctgttgctatttttcttgcaggtccgtgtggatctgtatctgtgtacaccatggccccatctcccagcagctcccatggcttgtatccatggaaacgcagtcctccccaactatggttctctgctgacaaaacctgggagtctccccagccccctacccacctcggaaaaggagcgtggaccacacaggctccagccagcaggagggcggcactgtggaggaggtggccactttctcagttgctttgaagggccaggcaaggccaggcctccaagaccttcctccgcgggtctgtggtcaaggccttgtcacctgcttaaggggagcggcctgttgagagagccatcactgaggccctgggccctggtgggattcagttggcagggcagtccctgagggctgtgggcagtgcggcaggggagggggggggaggggttactgccctcacgagtggggagcactagcacttgggagagggaggctgaggagtagggagagggccagtggcagtgaggtgggggaaggggatgtgcaatgtgggatgaaatcttggagccttggccgggcaccgtggctcatgcctataatcccagcactttgggaggctgaggtgggcagatcacctgaggtcgggagttcgagaccagccagaccaacatgaagaaactccgtctctactaaaaatacaaaaaaattagccaggcgtggtggcacatacctgtaatcccagctacttgggaggctgaggcaggagaatcgcttgaacctgggaggcagaggttgtggtgagccgagatcgtgccattgcactgcagcctgggcaacaacagagaaactccatctcaaaaaacaaacaaacaaacaaacaaacaaaaaacaaatcttagagccttggctgtgtcaaataagctgtgggatagaagaaagagcatggccttggagtccctccctctgtccctcctttccttccacaaacattcgcatttgcttcttctggaccagactctatgctggatgtgaagacccagaaatgtttcagaattagactctttctcctcaacgacccacagtctcgggagagaagacagattcttcatcaagtcagagagctcaggggtcctgaaggtcaggatggttgtctgtatcagagcagtggggcacaggagggtggtcagagaggcctcctagggagctgcagcccagggggcaggccaggaagatgaggcagtgtgtgggacgactggcaggaggcaagagagggcagtgccgggagccagtgggtgagagactcgcgcactagagttctaactctggctcctgttggcggtgctccctggagaaagccacctaaggtctctggtgtgtaaaatgggaaatggcaatacctaccttatgggccaggatggaggattaaataaaacatctggcccctcatgcagcatttattgtattcattctatgccggggctgtcccatgccttttgctttcctccctacagggtctctgtcacttcgtctgtcaaatgagggagctgggccagatgatgtctagagcctctgacattccctgtcctcagtttccccgtttttgaaataggaagaagaatcttccaacacgctccagaagtgaaggaatggatcgtggaatcaacagatatttactaagagtagcttgggacagggcgcagtgactcatgcctgtaatccaagcactttgggaggccaaggtgggaggattgcttgagccctggagttcgagatcagcctgggcaacagcaatcaaaaaatcaaaacgccgggtgtggtggcatgtgcctgtaatcctagctactcgggaggctgaggtgggagggtgcttgagcctgggaggtcaaggatgcagtgaccccagtgagccatgattgcactactactgcactccagcctgggtgacagagcaagaccctgtatgttcaaaaaaagaaaatataaaaaaaagagaaaaagaaaaaagcagcttgcttttccccagcttagggaaagcagaacccagacagatatcaccactgctacctccatgggatgtggaggagcaggacacccagcactcccaatgtggctggagaggcccagtgtggtctgcagccatggagcagtgactctgggtgtctcgtgtcgctgctctgctgctttctctcttcctgtgtcttgtctgtcttgggtaaggaaggacttgctcaaggccctgggatctgatttctaaggaccatcttgcccaccagggacctccagacccttaaatccttgtactcaaagccctagggaagctgaggatcaggctgaggatctgaaattattaacaccgctttgtcatatcatagtggagtctcacactgagcctctgaggtaacccctattgctatctccattttgcaggtgaggaaactggggctcagagattttagggactggctcaaggtcacccagatgcaatggcaggaccaggatttcaatctaggtcagcatgactccagccccatgttctttctggggctctgtacccaccctctggaactctggtaaacctcctgaatccatcgggaaagtaaaggagatataaatagcacgtgggattgtgaagtgaaaaaagcaagttgcagaacaatacctgcaggattattgcagtcatgtaaaagaactacttgaaatgatgcgtctatataatgagataaatgcacagaagcaggtctggagggagatctatccagggttgaatggtattcccctctgggtagggttcaacatatttcagaattggttaagtttttattacaatgagaatgtatttatgtactacttgtgcaataacaacctccctctcccataaggcaggagatggggtgacccacctccttatgacatgagccatgtaaaggctggggcaggtggagacctgcaggggaatgtaggctcatgggaaccttggagacagaatggcagttttatgtcagaactctttgtgtgtttttcttgtcttttaacagcctggagagaaactccttcagtcattttacagtgaggaacccttggctgggtgcagtggctcatgcctgtaatcccagcattttgggaggctgaggtgggtgtatcatttgaggtcaggagttcaagaccagcatggccagcaaggtgaaactgcctctcctgggcgtggtgacatatgcctgtaataccagttactcgggaggctgagcaagagaatcgcttgaacccaggaggcggaggttgcagtgagccgagatctcaccactgcactctagcctggggaacagagtgagattctgtctcaaaaaataaataaataaaaaagaaagacagaaagaaagaagaaaaaaaggaaggaaggaaggaaggaaggaaggaagaaagaaagaaagaaagaaagaaagaaagaaagaaaaagaaagaaagaaagaaagaaagaaagaaggaaagaaagaaaaagaaagagagagagaaaggaacccttaaatctagatagcctcagcccaaggtcagagagctttgttgccacggattggttggttagtaacttgctttatgttgaagacaggcctggctttgactttatacagttacttgcagattctttgaacctcagttttcctacctgtaaaatgggattgatatagctactttgaagagtgttcgtgaggattcagcaagatcaagtttgctaagtggccatcaccggacaggggctgttttcaacatcattccccaaccctcttttctgttccctttgtctaaggaatgccattctagactcagcatggtgcagatgagacataggctttggcctgaattggggcttggccacgtcaattattggcatctaacattgaggacatattagatgtcaggaatcatgctaagggccatacatacaactcccttaatccaaatcttgctgcctacctcagaggtgggcaccacctattattatccccactttacagatgtgggaattgagatatcaacatcaccctggcctcataaaatgacttaggaagaatttcctctttttctgttatctggaggagtttgcataataaggtttgtttatttacacttaaatattcacaagaattcaccaggagaatcatctgggcctggagttttctctgtgaaaagagttttgactataaattcaatttctttaggagttctagaagcagtcctgttcctctgcccatgcctcctccttaatcctcagctcccaaatctgagtcctggaggaggtgattataattgcaggccctgcaaggtacccccagttttatttaccccccatgtggacactctggccttgactctcctccttattgaatggcagggcagagtggggtgggggaggaggcagaatgccaagaatgagatccgactttgctatcttggctccaagcttgcacctctccctgctctggtaagctgtaaggagcaaggcctgtggctggaggacccatccctgaggccaaccttctgggactgttcctgaggatccactatgcaaggtgcactgggccctgtgacagcttagcagagcagagctgctccacctggcattgggatctctaggagaagctcggtaaacctagaatgaatgaatgagcaagttaacaatgacttcctgaatgactggaacacctgctctaggtacccagcttagaaaggttaaaaagacacttcatctggtgcaaggcagacacatggacacatggtccatgacatctttggtgacaaatgctgtgctacgggtggcatagggtactgtaggggtacaagggaaaatgtctgacccatcctgggggtgggtgatgggggtggcaggggctttttggaagaggggacacaggctgagtcttgaaagacactaggagttagtcaggaggctggtggaactgggagagagcatggggtaagaaaagcagggcacttccacagaaggggaagacactgcatggtccctgagctcggtctattagagaagctactggtcactcaaaagtcagcctcatttccaggccatttattgctccaaaggatcctggactcacagtgcattggaagctcagtgttctgacctttcctgccaatatcaaggtcaggggaaagagatccctttctacccgagctcagcatttctaactggaggagggtgataaaacaattaaggatgcatctgacagtgagtaagagagaacctaataaatagtgtcctaactgtttattagggtgcagtgggggtgaggagggtatttattccatataaaaagaaattcagggatgggcagtctggggccaccaggccgtcaaggctccaggctcctctcattgtcccttccaccaaccttagtgtgaaagcctttgtcttcatgcttgttgcctcataattgcaagatggctgcagcaactccacacctagatccaacttccaggcagaaagaagatggaaaggctgaggggaatgccagttctgtaccttctagaaagaatgtcctgaagccctacccggtgacttcactcctatctcattgaccagaagtgggtcccgtggccatctctaggccagtcactggaaggtggctggggaaaaaggggtgtggagaggcttgggccaaccagccaggagcatctgctacaggtggtcacccaccccagaaagcacagccctcagccccctagctgtgagagccagcagaggcaggggggaagctggccactccagaaaggtctcgcttcaacagtcattcaacaaatgctaaccattgcccccactgtgcccagcaacttgggccctggagcccagtagaggaagtgagctttcaacacaaggccaggcagaaaggagagccagaccccaaagcagagagcccctctctgggtgggagcatcagagggtcccaagcctgccaaggcctttccttgcctttgaagaaaaggagattaaataggaccagcctcaaaaccccagcagaaaggacctggcctctttatctgactgactgatgaagtggcttcctctgggggttgaaggaaggtatgcagataagtgtgagtagtagttacgccacgatcattcaggaagaattggggtggtgtgggggcggggagaggtcactgctgtgccatcaatgtcagcctcacacagtgttgcagagcccaggctcatcccctactcctcccatttcactgatgtaatctgacatagccttcccccttggaggcctgagcccaggaagttaccttatgttaccgcccagcaaggtcgctcaggccttcttgagcttgccccgtgattctgccaaccaatttcagacagagcagatcactctgggtctagtaggaaatgcccaggtctgggcatcagaaggcctgtgtgaccttggaccagtcagccaacctctctgagcctttactgacaccttgtggcagcttctgcccaaaaccaaagtgcttgggtgaaaataaaaacctgtatttcccttccactactcccctgccactatgctctggtctgagtcacatcactgcagaaggatagccttccaacacacctccccatcccacctctctaggccactgtcctgaaagaatcagtgaaaaggcttcccagggaagcagttacggctcagtcctccagtctccagttgcaggtctcagaactcagtcctgcacagtactagtactttcatcagctccaggatgaggatatggtggacacgtgcttatcacatgatgtcagaaaatctccagaggccaggcattggtggcttatgcctgtaagctttgggaggccaaggtgggaggagtgcttgaggccaggagttcaagaccagccttgaacaacatggtgagatgagaccccatctctacaaaaaatttaaaaattagctaggcatagtggcacatgcctgtagtcctagttacttgggagaatcgcctgagccccagaggttgagtctgcagtgagctgtgaacatgccactgcacttcagcctgggtgacagagcgagaccccgtctcaaaaaaaaaaaaaaaaaaaaagaaagaaagaaaagaaaatcttcagaagggaaaagtaagtccacagcctctcctagattactgcttggtcatgtgtttgtgtgtgtgtgtctgtgcacatgtgcgctcacatctgtgtacacaaacacctgtgtgtgttttgtcatggacctggggaacttcctaccaggctcctgcaatggaatggtttcaaccgaagctctagctgggacagggcccctcgtttttggcttttgagatgaacgccccaacctagttagttatcagtgctcggttttcttggcttcctttcctgccccatctatatcctctgtcttccaatcccaccatccaaacctgctccaaaccagaggtttaaatgaatctaataaaaccactcctagaggcagctgttcatggctaataagggtgcccagagtggatggataggttgggaagggccttccaggcctagcgccaaacattattggtagaatttcaaaccaggtctctgtggctaaaactttgtctcttccaggctactggtctgacccactggcacagggaagcagttttgggtatgagggaaaagctgtcctgagctctccacacctccacccagccatctgggaattctggggtagggtatgatctgtggatgtggcttggggacttggcgtggacctgcagtggttggctggctccactccatcaagaagattaagaggtaattgagcagctgttctggatgagggagttgctgcttgaaagttggaggttggcctgaaaccctcccattaaatgtgcttgtccctgggattcaagagctctcttcaaaaggcagggagcccatccaggccctcctatggctggaagaaaccagtagcaacccagagcatatggggaaactgaggatcagagaggagtagctgactcccattttaccaggttgagtgtcatggcagcctgctgcctgaggttgggtggtatggccaaaggtggttctgggccagaatccttcctgctgggctccaggaacctcctctcctgttggttaagagccaggagtgcaggcttttggagccaggggctagaccaccctcctggcactgctatattccagctccttctccccaccctacaacactgtccctaacgcatttttccattacttttgtgctctgaaacattcgatggctccctatcacctccaggatctgctgcaacattccctgctggcccctccccgcatcaccagcctcactctgtctggactgcctgctactcttagcacccacctgccctctgccctctcctccatctccactgtggccttcctgccatcttcccatcccttaaaagccatttctccaggaagccttcctgtctccactccgtaattggggcaagctacttaacctttccaagcttcagatggcacctctgggaaaaaatgagggaataacaagatgctgcctccaaagggttgtcgtgaggctgtcaccaatgaaataatgcatacccagggcacatcacagtacctcttgtacaatgaggactccaacaaaggatgctgggtcaatttcatcatcatcattgatatgttatggctatctcatcgtgaattgtaggtcccataatccccatgtgtcatgggaaggaccaggtggagataattgaatcgtggggcacagtttcccccatcctgttctcatgatagtgagttagttctcataagatctgatggtttttataagaggcttcctcctttactgggcactgattcttctttctcctgatgccatgtgaaggacatgtttgcttccccttctgccatgattgtaagtttcctgaggcctccccagccatgctgaactgtgagtaaattaaacctctttcctttataaattactcctttataaattacatctcagtacatgtaatgtacatctgtaacgtacatgtaatgtactgagtaatgtacatctcaggtacatctttattagcagcaggagaatggactgatacaatcatcatcatcaaccactcttcctcctcctttctgtggaataataaggggataataagagggactctgtggctccctcttctgagctgtcagagtacccttggtctctgtcctgtgctccatttaattagagaagcaatgtgtgggcatgcgcccctcccctcagactcctccatggctgggtcctgaacccctgaactccagggcccaggacaacagtgctcacacttttgaatctcaggacagcctgagttgctaggctttcttcctcagccctggagagcactaatggtgtctttcaaacctggtatcctggatgtgtgagcgtgattgggtgggggccagccctgggctgggctttgaccccctcctcgggcctgatgagagctctcattaccttccttccttgccagctaggccttggggtgaagccagccctcaacctttgatgggaggaaggcttaattaccccctcaggcagagggagaggataatgaggagcagatgaaaagcctgggaaggttgctccttccagaggcccccacctcttagcacccaggctgcccccggccccaccttcagcctctttgggcttaggttaaggccttgcaccctggtctgcagagggccccagcacccatggcccttgtgtgattcacagatcacagggattaccttggattctctctaccacagtgcctgaaatctcattagcacttcctattggggtcacaccaagcactcctacccaatctagaaagaatggttagaatttttcataccacactgggatcctgggacagtttggataaggaagccatacattaaggcctctggtttgtatgaaacctgaaatttgtgatggaatgggaagcaaaggacaaatttcacagaaggaagccagtggaaggggtcataggcctgcctcctcttggggcttggctggggatttgtggttgggacaacatggctgggcttggagactctcttccctccattgcagagcagctgaagggcttggtgtgttcttggctctcagtgggcaggcaggaggggaagaggaggtgtcaagtgtgtctgggcaacagtgacaaaagatgagggagagtagttgggcagacaagtaaagatcattcttgcagggcaggcccaggatcctgggttctttcttgtggggggcacggggtgatgtgggtagaactagggtgttttgtcttcttgttccccaactcctgggccatcccttggaaatgccactgtgctcagcccaacagggaaaccctgagggctctggccccacagctgcacacaggcttgcagggtgtttagcttgaatgccagtctgtcctccccggcgttgtagcaggactagccgcagacaaaacctctcagacaccaagatgtagaaggaagggctttattccgctgggagcattggcaagctactgccttaaaatccaagcttcccgaatgcacaatttctgtcccttttaagggctcacaacactaaagatttcacatgaaagggttgtgactgatttgagcaagcaggtggtatgtaacaggggctgcatgcaccgggggtcagagagaaacagaacagggcagggagtttcacaatgttcttctatacaatgtctggaatctatgaataacatcggtttctaagttatgagttgatttttaactactgggtttaggccaagcaggcccaggcctggtttcgggcctggcgccaggctacctgtctttggttttacctccttgttgttttttcttaaaacaggtactgagtataaaacaatataaaacaatatgagagggtctctctcttcgctcagcgtgggcacctctggagcaggacagtggagaggggcctgaggaaagtacttctgcctggactagcacctgccccggtcatggttccccaaactccccattagtgctagttcttcccaaagaggcatcagaggggcagggaggtgctgggggacactgtggtccatgctgccattgactgattttagggtcctgggccagttaatttactcttctaagacctagttgccccatctgtaaaatggggtttgtaacagtatctcaaggttgtagtgaggactaaaaaaacatagtgtatgtaaaatgctcagcataatgcctggcatggggcaaatgctcaccactgttaactgttattacagttattattaatcccgctgggcaacgtttctcaacctttttaaattccaggctcacttgtgataagcatacaaacctcatactcctcccagtaatagtataggatttaaaacatcaaggaaatagaaggttgaggcaaaaaacaaatcgaagcacttattatatagaacatgctttttcagatgagagagcacccctgcccccgcccccccaacacacatacacaattgaggctcactacaggggtgggagctgggaggactggcagccccctctgagaggcctcagggtggagggccaggagcacagggtggcctctggtgggtgcctctcctccctcgctggcccacagtggcctctggatcccagcccagcctcccagctctggcaacaagggctttgagggaacagaggaagctctttggaatacaaatatctttggatcctccggtctcagccggcgccctattctcatgctaatacggagagagtttgggggatgcttgaaggggaaattgccaactgtaggaaacccagcccaagcctggggccctggggacagggctagagcctctggggtcctttcccgtgtagcttcccagtacccagcactaagttccagccccatgccccaacagtcctggcacatcccctggcgggctgggtagattctacaactcagggtctatttgctggacaattgccccttccagttttccccatgcaaataataattcacttggcaaataataattcactagcggctgtttaccgcagccctccagtgccaggctttggggagatgctccgtgcatcttagttatctcatgtaaccctcactgtgcagcccatggaaatgaaactcaaagagagtggcaatttgccccagatctcgcaactgtggtgccaggatccaagtgcaggtgtgtgcaccccactggactcacagggctggtggctttggagacctcatgagccacaagatggcatcaggggggcctgggaggtgaggggcatggggtttggcacagcagcagtctaggccgtaggtactacaggcatagacaggacccgcatgtcaaaaaaggactcggttggtggctcaggtcaggcagacagtctccccaggtgctgagtctgagttctcagcccccaggccaggctggggcagaggagcagatggagatgggtaggcgttcttgagttgacctggaatttagaaaggtgatctgctgatggcttagggggtatgctgggggcaggctctggacctggacaatctttccctacttctcagcttggtcaatacctactcctccttcaaggcccaattcaaaccccagctcactggtggaggcttccctgactctcccaagctaacacctagctccatactcctctcttccccaacctctgtggcatcatttaggtgcggctctgcctcctgccctaggctgggaagtcctgagggaagaggccttgcctgattcatctccatgactccagtgcccagcatgggacctggcactcagcatggctcaggaaatgtttgcagaatgaatgagtgactctacaggatgaaggaggctgtgatcttcactcttgcagagtctccaacaaaaggaagccactgaaacctaagcaggagggtgctgcttagtatcattgatttctctgtgcccagcaccacatctcccctgctcttctctgatttccaccataattgtgtggatggttctggatggacttgggctcaccctgtgctggcccttttcccctcaagtgcaccaacgccaggaaaggcagtttgaccggtggatcaaagcaggctggaagtgcgggggagagaatacctccaggacagccctcaaccagcagggatgggagccagtgtgtagctgctccagcctcccgctttccagtggggagttctggagacagaggccccaccctccactaagggacccgtaagactgtcccgttaggttggccgtccctctttcctggtttgcgctcctgctccctcaagatggcaagctatgcagtagaaatttcgtgactgtggagtcttattctcactgggctctgaccctgattcctgaggcttccaagggttctctggaggtatgtaggaagctccagtggaagagagctattcagggaattatgtcctgaaattaaactccacggtccccaagggagggagagaatggggcatggtgacactggggtggggatgggagagagaagttgttgggggtttgatgggaaacccattttgccgtaatcgtattgtgcacattaaaaccacagctaccagagcaaaggggtgggggtggaggcagagcagaaaaatggctagaatgagctggcaggggagggcgtgtctgcagactcatttgggataaggggttgggggttagggatcccttggccagtcaaggacagccccacccacctcttgccaattggagtatagagaaggtggcaggcagagagtggaaactgggactctgctgcattgacacctgctaggtgccaggcacggcagtaggtgctttgctgaacgccactcatttataaactgctttacatgcaccaccacatttaacctttgcagtagaccttggagcttggcactattgctatcctaagttgctatgagggaactacacagagagggaagtgacttgctcaggatcccccagccgtttaacaaccccatgcaccacagctggatgagcaagatgtctgcagtgaagggacagaggaattgaggccaagctactggggaggggtggaaatgccattctggaggatctgtgacgttgacagagactttatcgacacaacaagccagctaacccctaacgaacgtgttgattcattcattcattccatcagttactccaacatgtgggactgcatggttgtgaaaacagaatatgaccttgtaaaaggagaagccttgggcccttgatgccaggtgggaggaggatggagagctctaagaggactggagatgccaagacggcttcttaaagaggtgtggaaggactgcggatggctgctttccctctttagatcctgctgtgggatgctagcacaaagtctggaaaatgcacctgactttgcctagagggcaataggtctcttcctgggggtgtcacgcaggagggtacctctcttgctagtcttgcccagagctcctgaggaagggtccctgtgacagctccttctctcccctgatcaagtggcctaggcttcaggtagcaggactggtgaactggttgggcagacatggctgtccttgcctaggccaatgtagtgccagccatggccttcccagaagccttagactacaggcagagctgcctcactctagctgtcctagctgctggatgcctgccaggtgtgtctctgaaggcctatcttccaagactcagagagtgaccactggaaaagacacatctggaccctgagatctccaataaacttcaagtgttccctcatcagcgtctcatgtggcataaacttcccaaatccttactgaggaggtcatgatctgtgcatatctctcaggagcccaacagcaactatctattcaacaaatattggtgctggcctttattctgaatgtagacttccatcggggctcagtgtgaggccagggtcaaggctcagtgtacgatcagggttggggcttggtctatgaccagagtcagggctcagtgtgtgcccagggtcaggagccactgcatggacagagtcacgactcagtctatgaatgcgatcagagttcagcctggagctgctgtcagagactaatcttttccaggccttgactttcctttagagcaagactacaggctcagggactgcctgctaagagcaaggtaaggcaaaacaggctgagttcaaatcctggcttaccacttgccaactcacctggagcaatatcctgatcctgcaaaccttgagttgcttacctgtaaatgaggacaaggggaggcacctgccttagttcattctgtgctgctgtaacagaattcttgagactgggtaacttaaaatgaagaagtatttattggttcatgattctggaggctgtggagtccaagatcaaggtgtcagcatctaataagggccttcttgctgtatcatcccatggtggaagcagagaaggcatgtgcacatggggaagtgggtggagcgtaaaagggggccaaacttgtccttttataaggaacccactcccaagataacaaacccgctcctatgataatgacattaatccattcatgagggcagagcccttatggcctaatcacctctcattagaccccaccactaaacattattgcattgggaattaagtttacaacacataccttttggggcacatatacaaaccatagcagtgcctcataggttgggaaggcttaacaggtgaaaaacacctagctctgaatgtggcacttagtgaatgctcaggaaatggcaaactctgctttatccattataaccatcatactagaggctcaggatctaaacactttacacctggttccagtcctgccctcctgattcaggtttgagtcagagagtcaaagggaccagtctccctgctcatccacggccaaggaagtcactgggtcctgggaaacttccctggagtcaggaaagcttgggatagggaagcctcttggggcaaaatctcacccctttgatgaccatcagcttttctcagaggcttcaagactctacctgcctgctgcttgtgctctctggtgggcagatgagccctgcagccctggtcccttcagtccccagatttgggatgaagaccccagtctcctagatgaagcttgtagcactccctcctgtctgccctactctgctccaagggccctttgctgtccaggctctgtgtgcctcttcctgccttctccagcagtcccatggcccacttcttagcctctcccatcacaaccctccaggattctttcattgtttttggcttcctctcccacccatctttcatttggatgtttcctaagaggacagaattctaaccaccagccagcccttcctgccccatccaacaaaacagataatctgttctccattttcccagaggagaaatgaaaacaagtggctgagattgcaacaggaattgagacgagttgcattggcatgggagagctgtgggaggcaggcatgagctggggatggggtgctcttttgggattctggtcactaatcttgagtggcgtagggacgttttgtcagaaacaaagaatgaactgagtaatctagaatccctgcttcctgtctgaggaccccagtcttatcagagaagcattatggattctcagctagaccactgggggcacatcccagccctgcatcttccaggctgagtggccttgggcatgtcactcaacatttctgggcttcagttttcttatctgtaaaatgggctgttgtgagaagtaaaggagcatggagcacatgttccatgtaattgttagctattattatctacagtagcagaccctaaacacttccagcagctcactcccagcagtaaaaaaagtaagtgtgggctgggcgcagtggctcacgcctgtaaatcccaacactttgagaggctgaggcaggcagatcatgaggtcaagagatcgagaccatcctggccaacatggtgaaaccccgtctctactaaaaatacaaaaattagccgggcgtggtggcatgcatctgtagtcccagctactcaggaggctgaggcagaagaatcgcttgaacccagcaggcagaggttgcagtgagccgagttcgcgccactacactccagcctggcaacagagtgagactcagtctcaaaaaaaaaaaaaaaaattaagcgtgtccctaatacatatcaatattaattcattcataaattatatgcatgtatttctgtgctaatatagtctatatgttataaaatatatacaatagtcatattaaaagtataagataaagaacaaaatataaatagaagctctaatagcttcttcccataccccagcggatcctcttatgcccccactggaggcaggaacagtactttggaaacctcttcatgtgccggtagcctgagtaaattgcagaaaagcttctgccagggccgatgtgagaggagaagctccagagcccccacgtgggagccagggagtgctaatgtgggtgattaaatcatttacaataatccatttggaacagcagccgtgtctaacatggggcgtgatgactgctccacaaatagaaaggtggccagggaggcagttggtgggacatattccaagggcatggggtaggcgcacagacttacccttgctactcactgtcttgctgcagttcacctgccagcctctgtgcctgcccagtgcaatggatcagtctgccccctccctgcataaatgtgcctgtcctcttctgcatctgaatcggtcccatctcttctaggaagcctcattgatggctcttttctttctctctctctctctcttttttttttgagatggagtcttgctctgttgcccaggctggagtgcagtggtgtgatcttggctcactgcaacctccgcctcctgggttcaagtgattctcctgcttcagcctcccgagtagctgggattacaggcacacaccaccaagcctggctaatttttgtatttttagtagagacacggtttcaatatgttggccaggctggtctcaaactcctgacctcaagtgatccgcccaccccctacctcaagtgatccgcccacctcagcctccaaaagtgctgggattacaggagtgagccaccacatctggcccctcagactactttttctacactgcaccaggctggtgctttgctccataccctcagtgtacttgacactgtggcctctttggcccttgatgaccaccttcccttaccaacctgactcccctcctgttgctctcctcttcactcattctgttccagccacactggcctccttgctgtgtctcaacaaatgctgagcacttccccacctctcggcctttgcactggctgttccctctgctggttacagcccctaagcccaggtgaccctcaaggtttactctatcatggcttttccatctcatctcagctgacgtctttcctgaccagctagtagaaaatagcaaaccacccccgtcactccttatttccttagcctgctttgatttttccatagcccttgtgtttaattgttctttttttttttttaactgtccacctctgccagctaacctgtaagctccataagattaggcctttgctttgtaaactgcagcatccccaggttctagaactgaacctgacacatggcaggtgttcaggaaacattggttgaatgaatgtgttccattgctatcccatgaggctgaatcctgtctctccctggcctaggcccataggagagaggctggagcttttcctcttccatctctcccgttggtcaactctccaatttagtggctggtccctcccatccggcattctccttcaccatatccatcacatgtttaattactttttgggaaggtgtctagcttccccatcacctaaccccctaattgctcaaaactaatttttttgggggtgaggatctaaacggtgctggataagagggaaccaggagggccgaggagccacccagacagccccttcaagatttccaagtcagttttgaaagagcagcaggcagttactttgctccctaattaccagcctcactgtggacatcctcagaagacacatctttcctaattgaaacagcagggtggattgcaggctctgggcagcctcctttgccttttctggcaggagccagaggcaggcaaaggtgtttcattaaaagagagctgtggaaagggagtggtcatggtgcccactgcctcctggaggcccacaatttagacgcacaatgaaacagcaaatatgacaacaaaagaatcaagtccctggtctgtctccccatctcagggcctgggcctcacctggcctctccttctcccatcaactctctcctgcatagccacagactccagccaagtggcaactctgctgagcacctgcccgagtggactttggcctcctgccatctgtgagcagggaggtgtagctcaggggtggtcccgggatcgtgggcagcccctctcctccctggaagagataaaatcttggcccaggccagccaagctcaaggtcttaaggcttattcagcttgctggagttgctgcttatggcggagcctactgagcctactgactgcattccctgtacctagtctcctccttttttctgagtaataagaacacttcagttttcctctaggtggcaagatgcccagctaaaagactacatttcccagtttcccttgcagctacatgtcaccagtgattttgtggggtggatttttaagcagatgttgtagggaggatttgggggaatatcccttcagggaaagacaggtagataacatgtgcccttttatttttcactatcctccttatttctgcttcttgcccagaatgtggatgtgatgaatggagctcaagtagccatcttgggcccacgaggatgacagccatatataagggatggtaggtcaaaagatagaaggaaagtagattcctgagcatcatggagctgccatacaaccttggacagcttaactccagacttcttttttggcagagaataaactgcaaatgtgcttttgccactatagttgagtttctgttattaacggctgaaagcaaatcctaattcactgacccctttaagaatgtggtaaaatgtgggccctcactccacaggtgcatagaacagcaagagacatggacacacgtgtacacacacacacacacatgcactctctctctctattttttacacaatttgtgggggagaaaaagccatagacattctccaagtaagcagactcaatcattgttttagtctgtcacccaggctttagtccttgttgctcactgtgtctggggctttgaggtacaaacccatgacctggcatttagaatgtgttttattgacagcccttttgcatttactgctgttagatcaagtatttgcatcatggagtagaaaataacccagtacctgttcttgccgagtcctgagtggggatggggaaggaacactagactgatttattaccaatacagatgggataaaagttaggtctgcagagggccataaccaggaggtgctctggatcacaggaaacagtggcctgcaggaatgagagagggcttcctggaggaggaaggaacactagacctggaagggccagctgagagatgtagagggaacagggatcacctgaaggcagcagctaagatgacaatgctaaggggactttggcctcggtgtccataggggactgagcaggcaaaataccttcacctggagacacagagatcactgtggtcataccaagccctggtgggagggcgaggagtgtgaactcagtcttttcatcctaagaatatgacggagagccttgcacattgggcctggcaggcagaacgtggggccagagaccatgtgggccatttcagagaatgggaggctggaggtccccacctttcccaccctgcaacaggtgcagctcatgaggatctgaggaagccgccctacgtggtcccaattccttgcgcacactgctggctgtcagtgcctcactctgtttcctctgcctgtcttcctcaaggcttgtgccctccgctggcccttccaggtctagtgttccttcctcctccaggaagcgctctcttattcctgcaggccactgtttcctgagatccagaacacctcctggttatggccctctgcagacctaaattttatcctgacctctgcctccaggcctcgctctgccagcagttctcctctatgccttccttctagtctctctcttctcccacccacagatctccatgctctggggctctcaaagaattcagggactgtggcattcaaggccagctggttgatgtcactccttctagcctcgaggagaaatctgctccgttgcaacctatgccagctcagaggcccccctcctcccacagatacccactctaaaaagtcctcctcctcctctcacctgtcttcccccataagggtgacggaggtcagagagacataaacaacctacggtttccaattaatttttaattgcaacttgaaattcttaattgcagctgacacgctatctctgatggaggcgcgatggtgaaggtgggggtggcggtgacccagttagagatgttcagcccctgtcggaccaggcactgagccagctgaggagaggaccagagggcagcctgagcctggctgggcgtgctggccaattgccccaggaatgccatggtggagtagttgtgcctcgggccctgggcctgctccctcagaggccagaggcctgcactttggcccatcctctggggagggctaccagagatgccccatttgtcactgtctcattatggccactgagggtcctgacaggacaatgcggcaagctccaagtggcccatcagggcctctactggagcccgtttggacatgcaaaaaccagccaagttccagacaaacagatgagttggtcaccctagctggaaaacaattagcccctttgacacccttagttctgggaagcggggagctgccattgagacactcttagatggctggggagctgcccctcccctcctcccacagctgttccttgacctgaggtgccaacattgggtctgtgcgaccacagggtctgtgggtgcagcttctctcctgggctagtcgcctgtgcgttctgcccagcaatctctacctccccccttggtagggagacagacaggtagatctgtctgtctaccagctccacaggcaggttgttatctgatctggagcaagacatgtccctggtctgagccttagttactccctttgcccttcctctagttcaggagtagcctggtagtgccactcgggggtagccagtagtgtggttgggagttgcaggacaggaaggggccagagatggacagcatcatctgcctctgcagcctgtcctgagggaggagctctcagagtgtgggagaaatctcgcccagctgccaccctgctgtgggagtggggcgcccatggaaggagccagtccgaggcgttctgccatcctctgctcacccacccactcctggcatgcatttgcaaattctttggctaaggtagctagttctccacaggcgctattacctgagacctgccagctagtgacaacagaaagcccgcacgttgacgtccctctttggcttgcctggaagtctactcggggctgcaggactggcaggagcgggggctagggtcagagtggggcagagaccgtggctgcttatggggcagggagagggtctgggccgggtcaggggctgggggagtgggaggatctggagaggatgggctttcctggggagctgggggagcatcccatgggtgtgctctgctgagtgacacaaatctggctttcactcactcattcattaatgcattcattcattcactcattcattcattcgctcaacagaggtttactgagcagctgccaactgcaggccccattctgggccctgggggaacttaggaaggaaacaggccaaagccagaataccagtcccaggaagccaccttttctccaggggtgtggttcatgccccctcctggcttggccccctccctggtggaccccctaccttctctatcacaagtccaggtctgcagtaaggtagacacagggtcctggggttccaacctggtccaagggagcagcctggagtgtgcttagaaacatttgttgactaatgggctcagggactgagggcctggggagcctgatcagggagcctgcacctgcctgtccctcgatgtcattccctcagtcttcccggcactgaatgaggcccagtgtgggcaaagccgcgtcatccttagcaggggcccccatcccagggcttatgaggcaccccagctccccaggagcccctctgggaagctgcaaactctgctttccatacttcagaattcatctgtcctgccaccccttccttcagaccccctgggagtcaatgggactcaagggatcagtgaaataacccaaagtacatttatgatacaaccccctcaaccatgcattctgcacctccacacccctccaaagccctgcccttggggagcctggagacacatggagagggacctgcctgggtcctaacaactgtaacatgtgaacactgaccccaagtgacatggaacccttgtgatatggcaggtgccacacttggcactttacatacatagtcacatgcactgcttatagtaaccccggaataggcactatcactatccccattttacagatgaggacactgaggtgtagggagggctctcacttgcccatgatcattcagctggggagtgggacctcacacacaaacccaggggtctgactgctgagcccatgctcctaatgtccacacggtgccctcctacgaagcgaacctaacagcagagcacgattaacagcaggtgaggacaaaagtacatcagcctgttggtgctcagaggggacgaggcccctgtaaacggaacactcagcgaagggccctaaaggagcggggatgggggctcctcaaggcagatcctgagcaggacccgcccagcacccgctcccagcctgtcaggaaggctgaatgaaagaacaccgtgtggatcttcctctggcccttggaggctgtgccctctgctcagagaggaggagcaaggacattagcaggaagggctgcagagtgagctaaggtctggaggtgaggatgactctgaaggccttcctggagagcaggctgaggaggtaatgcctgacttggtgggggaggggtgctgaggacccgcaggccactgtggaattggacccatctggctgaggcaaaggcgctggcagttatgttgcactaagtgggccaagaggtgacctctgctttggtctgactttggccacagacctaagaatctggatacagttgggctagaagggccttggcagactgcacagctcaacctgtcttgtgcaggtgggaagtgggagatccagggaggagggacttgcctgcaccctccccacctcctgcttgggtgtgtggccctcccgctgggtgggaagagcaggcaggaaacattgtctgaggtttccaaccacacgggaggaaccctgaaaagacattcctgagagaggcataaactaagacctagaaaagacagaggctgacctcacagcccctgacttcctgcttcaacctcccttcccagcccaggccagtctcttccccatggtcgcacctttgctcagcagttcttcccagcgggaatgactgcccccactttctatctttctgtctctctaacactcacttgatattgactggacttttatgtatagttgggcccaacccttagaactagctccaagggctctggttcctccaagaattctcccgtgatcgcatctacctgctgacctctcactcccttgtgtgaccctgaacctgagactggctctgacgagacaaatggggtgctgtgaaacttccctcatccgtccacaggcctgctgctcctcccctgccatgctctgagctccctgaagaggtgaccccactgcaggctgccctccagtcctctctgcaactcccagagcaatcatactggagaagagaaggtcaccaaggcctgggtcccaggggaagctgaagaagacccctccagctcacactgcctgcccttgtcacctgcatggacagagaaatggcttctgtccctgcagtcagacaaccaggcttgtgggctctgtaatctccatgactttatccacccttcccctcagggtcttacgggacatcgctatctttcaatctctccaagacttatttagccagagtctttaccacactcctacctgagtttatccagcttctcttgcatgcctccggtgacaggctgctcactatccacagggtcacttcttatcctaccagggctggtcaaaacctgtgtctctttaggtcagcagtgcctggtgccagaggtcctatcagtagacccaaagctgggtgaacaaaacaaaggctgggcaactcactgtcacctgggcatgtgaccagcctttgctctccactctggctaattcttttgtctgggggccacatcgcctgcctgccctccctccttctgtgcgattttcttcttcttctctctttcctccccccacttccttgtatctaaggattgcatgagtcacttcactttgagctgccagatgtcggatgcagttgggcttggagtggaagccaattttttccctttactcaaaaagagcttggggctgatgaaagcccccaacactgtcatcctggatttttcaggacggtaggatggctgcgtcagctagcaccacttcttccaggttctggcctgcccaccgtccgttcccaacttgggagggcaacttgtcctctcactggcaccaggcatagggccaggccagctctgtgcagtccaaggcacgctcagaatggccctcatcatctggccatgcagagctttgccagtctgagtggagcccagggctcagggccaatccccgctccatccagggagttttcaatgagagctaggtacctagctccatgctggagctgtgggggagacaggaaaaaataaagaagggcctcgccttcaaggaattggcagtctgtctagggagatgaaattcatacaaatagtggttcatgcgtttctgtttggattgtgcatccactcccagacatgacctcatccagttctcacagctattcagcatgggtgtcatcatcttcgttttacagatgagaaaaatggggctctgagagattaagtgacttgcccaggtcacataggtggttgtggagctgggccctgcctcattcgctgggctccagagcctggcatctgtgctgaagttggaaaggagggagggatggcttccaggaggagaaggcccactgtcctctccccgtctcctccaactgaggctgggctctctcctttgccatgagaatatacctatcttgagcacattccagaggtgctaggcaggccagagatcttgtctgttggggagtatggaagtggtggggtgctttcttagattgggctcccttgaacctaaagcctggggccaggacttgggtacaggaagtgtattgggagatttcaggaagagggtagctgggtagtgagacagggaaggaggaaaagctgatataaaggagcattaacagagaagccgctgtggagggcagggctctactcccctggtatctcccaggactgaaggcctaaaggacggaagtcaggggggcgggttatatattggccaccatcacccattggttggggggcttctccagggaggtgatggctcctctggactccaggaagaaagtggaatccctggcctcaagtgcttgaagcggatgctgaacttgcacagaactgcctatcccagagtgtggctgggctggaagtgtcttctgcggcagagagttaggaacatttggttccgggcaaccacatcttaggccctgctgccaccatggaaggccctgcttcaatgacccagtgggcaagttttatcgagcagttactggtgggtgtctggctgggagtcccggagtcaggtcaagagagaagtaaagatttaggggaaggggaagaaaaagacgtctacacactcctgattcattttgcctaccgtcagcatcagttccgtaaatctctccccttcctgctggctggctggttcctcaagggcaagaatcaagtgctatccatccgtgtgctcagctccagcacagggcctagccccgacatgcccagaggtgctgcactgaaaatccagcatgggattatggcccagccttggctcttggctgccaaaggttgaatgtgggtctctgggctcatctcacaaggccctgggtctccagggcaggggaaatgaggagcaaagccacccttttttttttgtcattaacagagtagggcctctggctcataaagccctgggatcccgctccctcccttctctttccacttgattacttgtctctggaatggagtggtttcaggctgccaagtgttttggggaaaatatcctgtataagaaagacacattccctccataaactcgtattgtgtttttgattgtctcccataaaggaagagatgtatcttccagtttatgtttacgactgtgtagattaaaaaaaatcaattctttcactctacattttttcagccaaacttcccccagcagcctttctgctgggccaacaggctgatgcccagaactcggggctggaggtttctctgccatctgtaggcaagcaggagaggccaaagcctcggactggctgcaggcctggcacaggaagggaacttcttgtccctgcttgatttctaagccaagttggctctggaaggcaaggggttggctgagagaaggtggccggcagggaaataggaggcagccccagcctgcaccagcacccttcaccaggcccagtgaagcctctgatggaggtggcagggagctctccccgaccagcctcaagtgctgctgcctccttcatgaagccttcctgattgcccagggtaaatggaactccttgatctgttagcttctttgctggaccctctagattgatttctgattgatttttgtctgctccagggtcatttggagtgatggttgcctggtatttgaataaagagctcccctatcagaacattcaggttcaaatcttagtgcctctgttcctactgtatgaccttgggcaaccaacctacttaacctttctgagtctcactttcctcaactggcagatgaggggcattttgaggattaaaccaggggtattttgaggattatggtcgggtttcaaaccataccttctttcctgctttctttttctccacatcacttagcaccatctcacatcttatgcttcgttttgttcagtgcctgtccgccctcactccaggagggcaggggtgcctgtgcattgctccctgccacatacctggcacagagaggcggctccatggagcggaccggatggatggtgcaggatgagcaccaggctccgcatcagggcacagtaaatgttggctctgtgccctttcatgtctggaatccccagtttggcattgcaggcaggggaagcactgtccatccaaggccgatcctgaaggtggcccaagagcctgtccccagcagcagactgcaaaccctttgggtacagggactgtctcttgccattccagggtcctcaatgcctatcaaggggcttgctcacatgggccctcttgggatcagaatttcttcctataagaggccagagaactgatggagggtagttttagtctaaaccatgctggcgggtgccaggctgtggactgccccatgtctgtcaccaagctcagcccagatgagccaggcataggtcaccaacacactcgcccaccagctcagcccacagctcacactagcctcagttatctggttccagtttgccaaaggcactctgactccaaggtggagtggggaagccactgacttctgtgtctggcaggctccatttctggagagtcaactgaggccaagcccaaccttcttgagcctcacttttgacatctgcagaatgggtgtgggtggagatttcaagcaggaagctagttctccagtgggaccccttctcctggcagcccctcgacttgccgcaagttccagcaatcacccctcacctccctctgcttttcctcaaaccttttacaaccttttattttgtctaatcctcatgacagattggtggaaaagccaccaggagttattatgctcattttaaagatgaagagactgaggccaagaggcaaaaatcatgcttgggggttggcgagggggtcccccagcagcctggggccagacagacagttctcctgcctaccaggcaagccccagcaccagctccaagcatctggagggctgcagcagggcgctggagggctgccccctgtccccctccctccctcccagctccactgggggggtctgccgggctcttctccctctgccttctaattgcttggaaacagagctgacggcagtgggaacagctcagccactgctggtctcatgactggaggcttttgtttgttcacagaatcatatttttacactctggcttccgctaatttatgccgcagactgagctctcccttgctgaagattgagtttgggagggtggggagttgattcctgggtttatttagtcatcttggagcctatcagaagccaagcaggggataaattaacaacaacaaaaagtaataatagccaggctcagggtttattttctggcggttccctcctccaataggcctgccgtgttcccttagctcatctgctgaaggaagcttcgctgggaaaattaaacggctcctcatttaagatggagcaatcagccctgagctagtcgctgctcagcacctatgggagctcatcccagctcagctgcaaggggagagggaggcagggaagcctcagagcacccccaacacacacacacacacacacacacacacacacacacacacacacgcacacgcactgtagctgctacctcgctctgtgtgaaatgatgacgctcaggtgcacagttgcaacatcctgtaggaaactgggctctgttggaagcaatccaggagggcttcctagaggaaaggacccagggatctgagaatgggaaggagtctgagcctgacccataataggccaaaggcggggatggggacagcactgccgcagagaagtggggaggggaagaaagccatttggggagcctaaatttttgcaacatctctcctgagatgggctctgcctctacaagtgagggttggggcaaaaacactctgtacctactgcaaataaagtgagcgctggtgctgatgaaagggcatggaaggacctcccctcaactcctgtaagccccaggaacataaaagaattgtcttgtacttaggaactgagtcaggaagggcctgagaaggcccatggaggtcaagttcatgcacacaaggtcatgagagcagggagaggggatcgatggggacaagagagagaaagccagccttgtgcctcaaagctggcacatagtaggtgcacaacgcatgttagttcttggctccttctttccctctcaggacatatgtggctaccttgtcacctgccatgccccccagggccaattttgccagtgggcacaaacctgctgattgtattcacccatccatccaccctcccacccaccagtctccctttcatcatctgccccttcactcatctacccacccatccacccatcgttccacacccagcctccgatgcagccagctcctacgcaatggagccagcagagccagcacagaacctcaccggcaacccggctggctgcctggaggtctctcatggtggcgtctactttgagaaagtaccacgggccttgctgccagcactggagacataggaatctgctttggtgagctgggtgctaaggagattcatctctctgtggcagattcacatttaccaagctcacagggactgatatttatatacataccctgatgccaatttattaatttataataagaaatgctactcaagtgcagcggatgtttgtcttggcagaatagcatcgctcccagtaggcaagctacagtaggaagtcaaattatcatcaaaacgctgggttaggaattcacaacgagaaatagaacttctgagggttttctgggtacatgtatactcctgggtccgcttctctccccaaaagcaagttacaagagaagatgatctgaagtctctctggtgaacctgaattagagagctgaggtggcacagggttgttggtcatatgatttgctatctgatggcctgatgcacctgtcccaccacagccccagatctgtctcaggcatcctctggcctggaggtcagcgagttccaacccccaccgcctagtttttagacagcctgcaagctaagaatggtttttacatttttaaatgattgagggggaaatgagaagaagaataatatttcatgacatgtgataattatacgaaattcaaatttcagtgccccaaaataaagttttaatggaacacagccacatttgttcgttacatattatctatggttgcttttgcgctgcaactgcagatttgagacgtggcaacagactgtttagcttgaaaagctgaaaatatttccccgctggccctttatagaagtctgccgacccctctccctttggtggcctttgtccctttactgaactgctgccattcttcagctctgttgacctgagatcgtccacagatcacctggccttcacaagtcaacaaactcccagctttgtttgaaacttttatcagaggtgaaaggctggtaagaagaccatggtctctccagtggttcaggcttcaggtaccctgggcaggctgtccatctccagggagaatgttctctgagggagaatgaacagcacaactgagaccctgtggccttcctctgctttaagactgtgaagcgtcgtctggagttcttaagaggcagctgtgtgggagagagagagagaaaaagaagaggaggtgagggaggggaaggggagagggagcaaagagacagaacaagaaggagcccaggagaaggcgggaggggaagcagagagattcaccgccctgtaggaagcattcaaagcattcaaatggcagtggctccaggcccattggtccattcttccaggactcctttgtcctgagcctgggaggtgtgggcgagcttgtccaggagtgcccagggtggtatgggcacagctgggcgcttgggcagtcaggttctgggcatggcctcccatgttccctctgccctgctggggactgggtttctgcctcctcttgagtagctgaggaggctgggcaggattcagattgagctttaggggcattcaggttgacaggcccctcaaagattgagaaaggggggctttctctgcatttggtggcacctgtcctgtggtccagagccagctccaaccctgcctcagctggcttctgctggcctcaaatgtaggccctgggcagggtagtgcagaccacacagaggtaccagagaagatggggcactgaaacccagagtctgagatccttgcttcaggcactgtcctctactccaaactgctaggagaaaataaaccctggtttgtttcacatctgcctcacttagccaggcttccagaggccatggacagaaggctgtaattaaacaaataaagcaaagagaagaaaacctttaaaacaacaattaagcaaagcaaacagaagacaacctttaaaacaagatgtccacgggaaagcacatttattgtctttcctgctactggcataggccttaagctggaagcacctgtcctcccattttatggatggagaagtcaaggcctcaggttacaaagagccagacacagccatgatgggtcttaggcctcctgacctcgagtccaggactcctgtctctacagagaggcagcgtaacatcacagaacggttaagaccttgggctcttgtgtcagaaagacatgagttcaatgcctgcccccattcctagacagtgcaagtttcaatctcctttataaaatgggaatgtcacaaagagaactgacccacaggttgttttgaggaattaaaaaagagactccttgtcaagtgcctggcacatgtagttggccaacatgtattaactttaaaaagtctctgacgggtacggtggctcacgcctgtaatccagtactttgggaggctgaggcgggtagatcacttgaagtcaggagtttgagaccagcctggccaagtgaaaccccgtttctactaaaaatacaaaaattatctgggtgtggtggcacccgcctgtaatcccagctacgtgggatgctgaggcaggaaaattgcttgaacctgggaggcagaggttacagtgagctgagatcatgccactgctctccagcctgggtaacagagcaatactctgtcttaaaaaaaaaaaatctctattgtgcattagatgctggggttagagaactgaacaaaaccctgtatgtaagaaggcttccatttagtgggggagagatatcaactcactgtcgtggaggatatggggtgctgtgggttgacgagaggaagggaaccagaggtcacttcacagaaatggcaggtgtactaactcctggcggcagagccgttgttcctcaggtggaagaggggaggggagaacattccagaacatcaaggcagatggcccagcacaagcagaggcagaaagagacgtgtgtccctcccaggtgtgaggctgcctcactgggcagtcctgggggcattctctttgccaatgaagggtcgctatttggcctcccatggcctgagctcgtcataccctccctccagtgtcagctctgggaaagcaaactggttcaatatttgctaaagccaaacaccattttgtttcagcaaattttctgatggaaaaaattattctgtaatgaggtcccaagttaaatagacttggcgtttggaatcatctggccctacactttgccaggtaagatagaaatgcggtatgaggatgagggggattagtctccttcactgtctctccctccagaaagtcctcctagcttttaccctcataggcacacacatagatagacaccccgccccccaccaccacatcctagcaccatttagcctacattcagaatttgtctcataccccacccaagcaccctgccacaaatagttaggcacagttacactcacctctgagcatatgcagtctcccagacttacaatgttatagcttctgtgcacaagtgcacgtgcatacacacacacatatgcacacacacacacacacacatacacacacacggggctgttctgggtgtttcctaaggccactgctccactgctgcttctaataaccttccagatgctggagaacagaagaattggggggtccaggacctatgaaggactccagcctcccatttgctgctgtctgcttcccccaggctgggagggcacatgcaatgctcctacccagccctggctgtgcagagcccagaactgtaggcacctgctctaaccatgtgctcactcagagtcggtgggggcactccaggaacactctatggccagagcccagggaagaccccatgggaggcagtggagtccagtgtgtctggttcagaatggcccgtggactaaaatcatgtcactgccaggctccatggggatgtagttgggtctgacagtccttgactaatctgtgcttctcttcctgaaaccctggcactctgccctctgccagcccagccacccacagccctgggcactaactcagctgagacagactcaggagagggaggaaggaagggaagagcaggggcagagatccagttccagaaccagagaaagacaccacctcagacacatggacccagacgggctctggttttcagaattaaacctggaaactctggaccctgcctatgtctgttttcctgcctatcacacctctcccagccttagtcacctccgcagttgggtgagcgcgtccctgctctggggtcagaagggaggggtgtcatccacccagcagatgctgactcgcacttacagcctgtcacccgacagagcaggctgcacccaggctgctgagatgcgccggctatttttgtggatgaagtgtgatgtcacaggtacagggacttcctggataccagggggagtggcagctgggagggagacctgtgcctgctccactgcttagctccaatggtccctggtcaggggtggtctccagggtcaccaacagctttctctttccattggcctgcccgtcctgcaggggaggagtccaagcatttctcaacatctcggtgtgcctaggcctgagccagggtgctctggggacagagctcaccaacagtaggaagattcctgggtcccggaccagttgggaatatgtgcagtcaggtgcccaaccttgagtgccccaggggttctgagatgagaattccccatggtggtgcagtggtcagggaagccttaagaggactggcatcctagccagggctggtgggagccaagactcagcggccaggggaatagtgaacatgccctgagggctcaccataagccaggacttgttccagtgcttgtacatggctcagtttatttaaccttcataacagctaaggcacagagaagttaaataacttgcccaaggtcacacagctagttagtgacaaggcctagatgtgaacccaaggcaatctagttcagagaccatgctcatagccacttggctctgctttgtatgtagaaattatcctgctagaggaagggtttagggtgggggaagttggagaggcaaggacatggggagggagttgtaaagggactgcatgccgggtgaggtggctcacgcctgtaatcccagcactttgggaggctgaggcaggtggatcacctgaggtcaggagttcaggaccagcctggccaacatgatgaaaccccgtctctactaaaaatacaaaaattagctgagtgtggtggtgtgtcctcaggaggctgagacaggagaatggcctgaacctgggaggtggaggttgcagtgagccaagatcatgccattgcactccagcctgggcgacaagagcgaaactccatctcaaaaaaaaaaaatgggactgaaatgccaaagagaggatttgagagctgatccgatgggtgactgagagctgatcccagggagtaggagaggtgatagcccctgcatgacccctatacacttccctaactatatcagcccacccctggctcagaggaagaagggatgttgcaggtgaactgagatgctttttgctttgtctgtccaatctccacccttcttcttgtaacagagtgccattcctcagggacctgccaatcacagaatatcccccccacccaccccacagggacaggcacatgatccaagcatggccagtcaacatctcttgaaaatttagaacccaggaaagacagcccttctccgcaggtagctctgggcagagagagccctggagcagcctgtgggcaatatgctggcctgtggagagggctggcaggagaaaaagaggctggcagccagcggaagcaggggagaccccaagagggaggccgtgtggcttaggagtctcactttcagtctccacgaggcttgctactcccctggccttccctaccacttggttttgtgatccagcgacatctctttgtgcccacctggctcaaattgggtttccatcatttgttactacaagggccctaaaaggtagtgcctcctagactggagaagggacctttgagagcccctagtgaagtctctatgcagaactcagggtcccctgacggatatccactcacctctcccaagatggggagatcaccctgcgcatatgctctgtccaagtccagtctgtacgacgctggggtcagggatgaatgggacagtctatgcccctgaagctctaagcctgacagggagacagacctcagacggggagcacacaccatagcagaatggagcctggacagtgtggaggtgccacccccaaccataagagccagcccccatcccctgatcctgagctgcctccatataaacttttgggggatgagggggaagactaattctggagacccagggtctatccggcctggctgcctgccccagccctgggaaagagcctggcccatctctgagcagatgagccagcctgggccaggtacaacaaacactgtttgctggtcttccccgggtgttgaccactagccctggctactgttccagcagcagggcctgcctccagactatttagggaggttctggaaaaacagcaacaatacaacaaaacctcaacacagaatcattggagctgtcattcctttccctggagccagtccttcctcccacagtgccagcccagctgccctctggtccctgcatcccaggtggctgtgccgatgttggcagctgtgtgctctaggtcaaggtgcctgttgtccagctatgtccttaccttcttctgtgtgtgccttccactctctgttctgttccaggtgtctggctggtttcctcatgcctctatctccccctctctcagacaatggtctctctgagatagacgctggaggcccaagcctgggtgattccacttccccaagtcagctgttgcaccccaccctctcttccctttctaagctgaccaatttctctctccccttaaaaatagtttaaaaaaagtgtttcctaaatcctggagcactggaatttggtgattgttcatggagatttgggccagctgtttcctatgctggggctctagcagggcagtgataagggaggggagaggaactcagacccagggagggagggaggcccttggtgggctcagcagcagaccaccagagaggacactgtgtgagtccctaccatgttacatttcacgctggggacctaggctcactcaggagctgtgatgccaggagaacaaatcgtggcaacacgctccacttggcttttggacttaaaagcgtaacccaaagggcaactgacaatttatgaatgactctttctggctgcctaggcttggttccaggccccttgtgtgtgtccctgtgcgtgtgcatatggttatgtgtatgcgtacttggcccaatgtctgcctctgagctcacatgtgcacacaagcatgtatacatgccaaggcttggctacatctgcctctgtcttctgctcatgacaagagctaatctacagcaaagctgaggagttttaagattctgaggctggcacctccatggaccccttgctgtctctggcccttgccaccttcccagccagcccctctgcccttcctttctgtactggaatccccatgaggtgcctctcctgactgacaggtgcacaatttgattcaatttgtgggtatatgaagaatactgtttataaatgcagtattttccttaaagccttataaaccagattcgatacttctcacagtctctggaagttacctttcggtaagagaaatattagaacatctgctccttgtctgttggataagctccccaccctgggagctgctccaggctttctctagcctttccccaaactcactattctgcctcattagacctttctggaccctcatctctccgcacacaggagaatgaggggtgggaggaggtggcctggggccatgggaggactgggagtccttggggggctcttgggtaccagtcctgtctctgccaatcactacttttgtgaccttgtgcaagtctctgcctttttctgacctcagttttcttctgtctaaattggatacattaggcaacaccaagcccttggcctggaggatggtcagaacctccaagggtggctttagaggttcgcaaactactcgtttaattcactgaggctctgatttgttttaaatcattttactggtttcctgtggcttctgtaacaaattatcgcacactgggtggcttaaaacaacagaaactttttctctcacagttctggaggccttaagtctgcaatcaatagtactgggctggaatcaaggacttcagcacagccactctctggaggctctagcagagaagctattcctggcctcctgcaaattctgctggcagctgacattcctgggcttgtggccacatcacttcaggctctgcctctggggtcacattgccttccttctgtgtacccatcagatctccctcttcctctctcttgtaaggatacttgtgatggtatttagggtcgatctagttaatccaacataatctcctagtctcaaaatcattaacttaatcacatctgcaaagaccctttttctaaataaggtaacatttacaggtcccagagattcggggctgatatgtttgggggctgtcgttcggcctactacaaccaaaggtgaaataatttagaaatgtcgcttaccactaaagtgaagaatgagatttctatatgaagcaaagggaggcaggagttttaaaagcttgagtgaacaaaacgacttgcaagggtcctccctgtcctatcactgcaattttaactgccacatgctgagggagacacaaattaattgagtttccttcaaagcaacacacaatcaaaaagtgaaatccattaccactagacaaaactgatcccaggcacatggcctgagatgcccctgtggataaaatgttacctggatccatgagggtctttggttcaggggggaaccccattccagggcctcaaacgtctctggctcctggttccatggtgggccccaggctcaggaaagacagagctcaggccaggctggtggatgggttggaaaggccaagattgcaggcctactgaatgccccagagattcagggccacacctcagcaggaatacagcccaggaagagggggcaggccctctggttatgccctctggccttgctgtgagaagacggccacttctcagactattccagacaagcctgtggagcctctgggcctactgccttgaattaggtgcctgttacaatggacccctttgcttccctcatgcctggcacatcctgcctgtagccttatagcctcagggagcaataacctgaggataagaatgcgggcagagtttaaaatcagacagtctcgcgctcaaatcctggccctgtcgtttgccagctgaatttgcttgggcaactgatttcacctatctgacttggggactgcctctgtgaaatggagacaatgctctctgggtccttgggaggcatgagggtggaactgtgcccagtaatagtggtcatttttatttggctggggaagagattcacagcgtgtacttattagcagcaaaagccaggagatcaaggaatccagagaggctgggttaggtcatgtgcagctgaaatgattgaggagcagaagctgtgtaggagccaatgtgaccccaggctataggaacagagatagccagttggaggcaggacagaaggaagcaggcaggatgacattcaaatgccttatggaggtctacaagaccctatgtggctgccctgctcacttctctggccctttctgcccctgctcctccagatatgctgtgtccagcctcactggcctttttatcattctctcagtgttccaagctccttgccacctctgggcctttgcacatgctgtgcttccttaccactcagctaaacttacttaccgttcagtctcagcttaaatatcactttttcaaggaagctctcccacaaagactgtttcccaggtctatgttcatcagcacaggtcactggttcattaacactggaccacgtgccaacctacctctgtcccatgagcagcagccaggtgaggtggttgctggtgggacaaagcatggggctcaggggctgtggcagggaggactttcttggatgcagctctgagcaggcaggtgccataaggcgtgtctgaggcacacagagagaagacagggaggtcagttgataacccagagcccctagtgaccaataagtccacatccactctctgccgggggatacctgtgatgaggaggggagtgatttgtctaaagccattcaaaggatgaaggcagggctggtctcctgacctcagctaaggatgccttccaatgccctgggctgcagagagaggagctgggctaatgagaactggggcaaaaatcgggagcccagggctgtgtggctgggaattcagagaggaggaaggtgggtttgtgtgaaggtactggcagggatctcctgggccaatgtgaccccaggctgcccacacctaggctgcattctcctcggccaagctagccaaggtagccctgcctgggcccagacttccagtgctgggcaggaaaggatggctgtgattcttggctgatggcatcttgagcccttctttttccatatcccttttcttgttttattttgttgtcttattaaataaaaaaaaaagatgggtctcttctagctggacccacactgcaggtcctgaaggtagaagccaggccacctaaggagggatctggaaaggggtgaggagtgttctgcaaattgtgggcgagtctcctgtctccacctggggaagctgctggtgcactgtgagggtctttggagggccctcctcttttggctacgagcgtctcacagagcccctttatttccacccccatccaatctgctttaccatgcaggccactgagaagggtcgcagcctgagtccttccatctttgagggaagtacattttctttgtgactagaaggtatggcaccaactgctgggtctggggcctccatggggaagcaggtaactaagggagacttggaaccttcactgcctggggtaagcctggtgccctggatgggatgggaggagtgaatgtaacatgggcagtgagccggggagtgggcgggggtcagggtccagctctgaccacttttatatcttgggtctggtgttaggctggggatgtgtgtaattagttggctaaaattaagaggtctattgtgcccctaactccttagaggccaggcaggggtttccagcagtagccgcacctcctccccacagggaccgatggcatggtcggtggctatgccggcacttctgcggctcacttcattctgtcaggataagagtcctgagtgggagacaggccggcctggttatgctctttacaggtaaagggggtagatatagagcagataaactaggccagggatgggaagggacttgccagcacccctgctcccctggccagcataggagtggctgctgcaggaacggagggcccagagaggggccttgggcccagcaaaatagctccaaggccacacaggtcaaagccctgggttaccttgttcccccacgcagcagcagggctggcgaagcaggaggagaaggcagggcaggactggtgccctccaaacctcagccagcaccccaggcccaggcctgcctctgctggtcccaacattagccacatgggttgtaactcaagctacacagcatcctgggccatctctcctcttttggggacagttgtgtgacgtcctgttcctgaccatgtgtcaagccacctgaaggcagcggtgctgtcccaccccaacgtggtattcccctctgctcccctgcccttggcgggaggaccatgcccagagaatgagggttgggaggactcaagtggtctgggcagctgccgggaggaggcatgtgaaagacagaaggactttggaaagggaggcagactcaggggagggatcccaggagaagggagatgcaccctgagcagaaggaaagatgaggccatggaaatgcctggtgtttgtggaggccaggtggccttcatcctaggggagggagcaggaaggactcctgtgcagggccttgagtgatcagccatgagaagaggatttgtcttcagggtagagaaggatcaccctggggccttcctgagctggtggggacactccctgcacattcgttcccgccactctctagggctgccagctggcctcccttcctggtgctgccatcactcctcctctctcctgaggactccgatactgggctcaggctccagctcctttctacggggtgagtgaaaccaaatgggcgggtttgctggcaaggggcaggaggcaccagggcacggtagggtggagaggaggccagttccaaaggctggggtctgggctccaaccacactctgcattcactgcctcctccctgagtaaaccaggcactctcctgggcctcaggctcctcctgacaaccagcaggatgccagcttcttttgggactgcaccagcgtggggctgtggcacagggccgggtgtgagcagctggtctgccctgcagctgctgcagagagcagctcccgtcctgggggcaggggccatgtggtctgtatttctcagtgtgtctccacctctgcttctctgtccattttcctctgtatctcttggtagctgctgctgcttctttcttatcttcctcctggaccctggaaatccctgtaattctgctgtcaatctcttcttcccttttttagtttcttttccccactatctccctcatctccgaacacccacacccagccagctccacatgtgctgcacttttcttggaagcagctctcacggctgtcccctgtcaaggctgccaccctggttcagatgcccagtggcctctgtcttaaattgctacagaaatctccaatggctcctatttctttcttgaaaccactgccaaaatattctcccagaataccatttctccttgtctctccctaggtcaaaaactgagcaccattcccggtgccttgagtgcaaaccattcctcttagtactcagaccctccgttctccgtctgggtcccccaagttagagcaaggaagagattggcatatgacctgtcagaggtagggcgctgcatacagataagggggcttgggagttggggctagcttagagagggtagggacttccccagtgagtgttggaggaggcattgctgaaaccagaggcagaattgtagctggaaggaactgggaaacaccccagagaatgtgctgaagcagagtggcaatagaggtgccaggatactagggccatgactggagaatccgggtgggatgaaagaatttctacatctaaagctgttctctaaggtcagcaatcagaactacattcctgatccaagaacctgcgtggtccttgggccagcacaacatgatgccaataaagtcagaagctggtctttctgatgctgcaggggtcaagatttattttgttgtcatttgtttgttttttgagacagagtctcactttgttgcccaggctggtcttggactcctggcctaaagcaatcctcccacctcagcctcccagtgtagggattataggcatgaaccactgtgcccaactggtttcaagaactttaataggactttgcattgcaagatttcagtttataaggtctggcctgcctttgccagaatatactaggcgtactgaaccttttcaccaaagaaacactaaaatatttacattcgacaattatcatctgtggtcatggtgatgttagcccctagttttgaggtaatggcctcccccagcttcagaacatgctctaagcctgtttggaacatatctcaggctagggacagcttgagactaagtcagcccaggcaatacagtgatgcttctcatctgtttggtcagtgctgagtggagacagagtggatcagacgatcctaggagaccccttcctcatactgctctggttctatccctgaagtgatttctgaagatgttggccatcaggcataaaaactcaaattgggccaggaacagtggcttaatgcttgtaatcccagcactttgggaggccaaggcagccaatctcttgagcccaggagttcgagaccagcctggcaacatggcaaaaccctgtctctacaaacaatacaaaatttaactgggtgtggtagggaatgcctgtaatcccaggggaagtggtgtatgtaagggtggaagtgtagataggggtagccaggcagggatgggcttgggagaggagacaagcaaggtttggagggcttaagactaacttgggcagaggcaagagcatacagaaaggctcagagacggggctgggcgtcgtggctcacgcctgtgtaatcccagcacttttggaggccgaggcgggcagatcacgaggtcaggaacttgagaccatcctggctaacacggtgaaatctcatctctactaaaaatacaaaaaattagccgggtgtggtggcgagtgcctgtagtcccagctacttgggaggctgaggcgggagactagcgtgaacccaggaggtggagcttgcagtgagctgagatctcgccactgcgttccatccagcctgggtgacagagtgagactccgtctaaaaaaaaaaaagaaagaaagaaaggctcagagacagaagagaacatggcatctttgagaacctgaggaaagtttaatatggcccacgcattgggttcactggcggcagatggagcttgagaaggaggcagtgcaggataacaaagggcttcctaagccgtattaagaaggtaggattggacttccccttgaaggtaatggggagccactgaaagttctaaataggagaatgaagtaattagatttgtgctttagaaagatcattctagcttctcgagtggaggcaatagaggaagatattggagatgggggcagttaggaagctctgggggtgtgagatggtgggggattggacctgggcagtggtggtgataggaagaggaagaggaagtggggaggatgcctgaaagtctggaggctggaacgataagctaatccagactagaggccacgctccctcttccagcagagtgtctgggggcctgctgcattttcccatgcactgtagtctgttgtcagagaggaagacacctaagagaaggggttgtgtgggctggagctgtggaggaaagcctgtggcatgccattaacaggatgggcctcaggtcaacaggacttagcctctaggttaatccccttggaaggaggacgagactttgcttcctcctctaagcccccaggccagcctcagcctgtgacctcatgccttgcctattctcatatgagcttctttcttgcctgttggcctctgaggcttcccacctgaataagcccagccaccgcttatgcttcctgatcccctgatccagttcctcacactgtaagaaagtcctgagcctccccatggaatgtcatgctcctacctctaaggcagccacttgctctatgcctttgagcactcttggctctgaaagtcttctattcatggagagctggtgcctagtggaaccaagagaggctgagtccagaaaagtggcttctttaggagtgggttaaactctccacctcagacaaacccatcccagacccaagctataagatcaagccaaaggcccaagtcctggttcagggctcccaagggtatgggctataactcccagctcctcttctgcacataccccatgagccacaaaagttcttctcccattcttggtgaatattcacaccaaatattgatgtcagagtgcatatttcccctaaaatgctccatccatgagcattgtgagagaggaatatgagtgcagggtcgagaggctctcttagctctgtaggtgggaggcagggagcagagttcttaagccagcccctcccggcagccctaccactgcctctgagcactaattagagatgagctcaggcctgtggaacatatggtttgtcagttttgtttccaggtgaagccaagaaaaggagatggaaaggaaactcttggcagagggagaggctctgaggagggggtgcccagagggtcccctggccttttcctcatggactggtgattatcagagcgcatgcctctggctgtaggtcatccagcccaaacaagaaggagctttatcatctcacaggacaagaaacccagaggtggggcgggatccagggcacaaggtgggctgctttggctctgctgctcctccatcagctgcactctattctgagggagaccagctctcttcctgcaatgtttaaaaatcaatgtgagatcattattcatgcctcccagcagactttctctcacatctcattggccaggattattcaaagatccctttctaaaacaattagcaagggacataggactgttgtgaccatcccggggaagcccttcaccttccggaggaggcagttgtccctgagcccaatccaggatccgtggaatgggagaaacgattggtagggggcatggatactggataggtaaccaaggccaacagggtgagattgacaccagtctggactctttctctgcatcatttagaaagaaaaggcaatctttctaatagtaagaaagaaagagatgagagttgtggcagatcaggggctaaactggacatttgcactcagagttcttcccatctgtactttctgctgttcacagcacttttctgcccaaagtctggttcaataatcataatgaccctgtgagtaaggcagggaaatgattatcatctccccttgacaggtgagaaaaaggaaacacaaggagctaaagtgacttcccagaccccttccaggcatcctttagtcatgccacctagatatattggcatgtcatgtggcttatttttagatcttttaggaaaaagtttcattctcaccaatctcaccagaggtctgcctgaggagtcaagtatccagggattcaaggagcttccagaatatccatgacattttttctcttccaactcatggaaggagatacaaagacctccttcctgacgcagagcacaggccttttctattattctggaaacaggttgcttcctaaatcaacgttgctgtccagggagcagcgctgtccttggtactgggcactacttcctgtcattggccatcctcaattgtctttccttttcagcttcaaggctgaattcttaaaccaagatctagagggattacaggaactatagttaaccctaacatcacatcttgttgccccactgaggaattcttctatggtagtgtgttaggctgtttttttaatttttattcttattttttttatttttttttttgcattggtataaagaaatagctgaggctaagtaatttataagaaaagaggtttaattggctcatggttatgcaggctttacaggaagcatggtgctggcatctgcttctggtgaggggcccaggaaattttcactcatgatggaaggcaaagtgggagcagccatcttacatggcaaaagtgggagcaaggggcgggggtgccacacacttttaaacaaccagatctcatgagaactcactattgcaaggacagcaccaagccatgagggatccacccccatgacccaaacacctcctaccaggccccacctccaacattggggattatattccaacatgagattttggttgtacaaatatccaaatcgtatcaggtaggcaaggtaggaatggatttgcaagttccagacacatgctcttgggctctcctgttgtcttagcacatgtctacagcactagttcaggggctcgtaagctatggcccacagtcaaatctggcctgccacctgtttttgtaaataaagttttattggaactcagccatgtgtgtttacttattgtctgtggctgcttttgctctaccacagcagagctgggcagtggtgacagagaccgtatggcttaaaaaggctaaatatttactaactggtcctttacagaaagaaattgccaactcctgttcttgtttattctctttggggcagatttttgttctgagcacaagcctgtgttactcataattccctttatccctattgatccctatctacccccaaccccctagcttaggatccatgcaatcctgaaagacacaatcccaaatgtttaaatcctgaaagctgaattctgggaaagggattagtgcagtttgggttatagcagcatagttgcatcatattaattgcatcctgttaagcggaactattatcttcttattatatttgttggtttaagaagatgcatgtgggagccaggttgacaaggggtagacttggggagttaattttaggtgtcaatttgaccagattaaggaaaacctagaaacctggtaaagcattgttttgggtgtgtctgtggggtgtttccagaggagattagtgtgtgagttcagtggactaggtggaaaagatctgccctcagtgttagcaggcaccatcctcttgcccaggggcccaaagagaacacatacagagggtggactccgctctctgagagctgggacaggcttttcttctgctgccttggacatcagaactccaggcccaccagcctttgactccaggcccaccaagattgacaccagcggcctcccaagtcctgaggctttctgccttggactgagagttaccccatctgcttccctggttctgaggtctttggacataggctgagccatgctactgacatcccagggtctttagcttgtagacagactgccaagggacttatcagccaccatagttttgtgagccaattcccctagtaaatcacctctcatatgtctatatacatatcctattggttctgtctctctggagaaccctgattaatataaatttggtcttggggaagctgaatattatttcttcttactgtattccttacaacacaacagaagagatctgtaaaatttttccctcagaaaaaggctgtgataagttaagtgacaaggctacttaatggtgaaacataaaagtttaaagactaataattactggtgctgcaaaagcagaaaattgcttaatggcaatggtcaagcaataaccagactttctaatggacaacacatctttacaaaatttgtaaaccacaatcactctccaaatacaagtgcagtgagtgttctgaagatcatacatgaactgaaaatgcaggcgaaaaatacaagaaatctccaatgccaaattagtcaatcatgtgtgacttctgacccttcacgcatagcatctatttgctatgctatgtatttcatctttgcatcatcttcaatattggaggtagaaattgtgtagacctttagagaattctaatttgttgtatgcattttttttcaagtttgactccataaaagtgcattatcacaatgttggctttgtgtgtaagtattgtgtatgtatataaaaatgtctaaacttcctcaagaaatgaagagatggctgagcgcggtggctcacgcctgtaatcccagtactttgggaggccaaggcaggcagatcacgaggtcaggagatcgagaccatcctggctaacatggtgaaaacccgtctctcctaaaaatacaaaaaattagccaggtgtggtggcaggcacctgtagtcccagctacttgggaggctgaggcaggagaatggcgtgaacccgggaggcagagcttgcagtcagccgagactgcaccactgcactccagcctgggcgacagagcgagactccatctcaaaaaaaaaaaaaaaaagaaatgaagagatgtcctccctgtatatctgcatttatgaaagataaaatttctagagattttaactctttgggtggctgtacccattgtagtttcagatcagtctcatcgaaagacttagggtgtccatcacggtccttaagatgacctcagttataaagctgggtgcacacaattaccaaacatagtgatacgcatgtacagcttttgctttttgacctatttctttatcaatgtgactcctctgctcataactgttatacccatgtgactgtcgttaggatactgaatgtttatgattacaaaaatacatatgccatcattgcctgtgttgttgtgtaaaggtgtcaatgaagtgttctgtcatgtttttatatgtttcccaaataatccattttaaaaatgtaagtaaatattttttaaagcattaaatttttttcagagttatattttcagggttttcatctttcaagaatgtgaatgtggggattttagactttagggattttgatattttaggattttgacatccaggattatggcatttgggatgtgtctttcaggactatggcccggaccatttaggaaggggtcttttcccagctttctcagttgctgggtaaactggcttcctgacctaaacgggtcctaggtccatctcatctctttaaattcaaactgctctcaaatacaaactcagtggtcctctctggcctcttcccacagatgtttctcaaacccattcatctaaggctgagcacacagcctacttagcttccccgagcaaagcctctagtctagacaaggccacagttaatacaggagtcacccctatgagacatacttctttataatctttctcagtgtgttaggactttttcagatgcaaataacagaaacctgatccaaattagcttaataaagaaaaaataactctgcagaaaattccagaaatagatctcactgctcccagcacacaggtgatgccatcagaactcagcctcatgttccatcttgactctgcattcctcaatattggctttgtttagacaggcctccaaatagctttggctcgtgtcctcagcagaaagagagatccccttcattctaacataagagcccagagctgagtctcagagctcaggtggatcacatgatcacctctgaaccaatcactatggcctgggggatgggatgttaggattggccaggcttggaccacatggtaatgcgaatattggggaggtaacgccactggacagacagagtggcagaggggtgatccagagtggagaatgctcctacctaccaggtggagggccaatgcaggctggccaggcaaggacaataggtggacacctcacctcacttgcctggtttgtttgacttctcacttacagattgtcattttcttcttctctgctgtcttctcaaggggctgtatcagcgttcaagtctctctcagcctacatgataaagtctgtgctgcttcttaggctgaaatacaccctcccttctgtctacccataagccttgcctcccaccatctcctttatctcacgagctctggcaatattgagcttccaccagcagtgccccagtggccccaggtctacagtctagttttgcactttccattccttttgcctttcccattttgtctgcatggcacacttctgatctactgcccagatcaagagtcctctcctctgggaagtcacatcctcacctctaggacagaagaaagcaccccctcatctgtgctatcactgccctgtactactgtcccatggggtctatctctctgtctctttctgtttatctttgtcttctgttttagacaatgagctcctcaaggtcagagatgttttcaggcaatgtttgttgagtgaaaacctttccctgggggttggcctttgtgtggcttctccaactccagccttagagcaatgctagatcctctaaaatcccataagattagtgggagactataggctaaaaagggggataaagccaagtagatgcattactaattaattcagcagacatctagtgaatactttcagtgccaagcactgtgctaagtgatgggaccacagaggtgattcgggcatattcccaatctcaagaaattcactgtggaatagagaaatgaagttatctaagctgcttgcgtttccctcattctctggccgatatctaacctagtatctgacacatagtcaatgtttaataaacagttactgaacaaataaatgaataaatgagcaagtgagggaacaaatgctatggagggtacacataaggctgtgtcagagtatggggaagaaaagagtgctgggaatatcctttcatcatctctcatttactgaggcatatgctggttgttggggattcagagagaaggggcgcttgtcccctgttcttgaagatcctgcagcccaggggacagaaaaaatcaatgtttacaagacagtgtgagaattactgagcagagatatgctgagaactgtgataagacagcatggtggggggatgcatggaagagaaaccaatgaattaattgattgtccaatcagtgtcctctgtaatgacatctctatgttctctgccctttcctggtttttctgtgggagctccaagaaaatactaattcatttggtcaaggagatcctaatcaatatgggggaggaccactcatgaaacactaagtgaagagtcaaaatattggacagtggttccatgctaaatcatgacacagaaagtcacagaagggagagctcaggttcctagtgggcctaagtggtcaggaaaggcttcctgcaggagaggcattctgaaaggcaggctctggggctacagatcttcgacagtcttcagtgccgggctggggaccttttatacttttttttttgagagagcctcgctctgttgccaggctggagtgcagtgacatgatctcagctcactgcaacctccgcctcccgggttcaagcgattctcctgcctcagcctcccaagtagttgggactacaggtgtgtgccaccacgcccggctaatttttgtatttttagcagagatggggtttcaccacgtttgccaggatggtctcgatctcttgacctcatgatccgcccgcctcagcctcccaaagtgctgggattacaggtgtgagccactgcacccggcctttttatacttttatagtttactccacaggcagcaaagaatcatggaagagtagtgagctggggaggggtatgttcaaatatggattttacaaaaattactttgggcataatatagagaatgggggagggagatggggaatgcaatataggatataggggaacaacctgggggctttgtcatagaactagtgaaagattatgacagcctcagcctcatccttcaattgagataacctggcttccagtaataggaaggtcattccaaacagtttctttcccttggctcatggccaagttaaggtttcttgggggttccagtccatttaacaaatatttattgcactaggcaggaatggagctagacactgaggatagaactgtgaacaaaacaacattgcctgtcttcaaggaacttccattctaatagtcatctctatggctgcaggtggctcccagggagagaggaaagctggttcaaagttgcctttcaggatggcagaactgggagatactcttagcagtcagtccacacatccccccacctacagccccatggctaataagccatgtgtttcttccattttatcccatttaatcccgatccccagcagagcctaatgaggcagatgttggtgcccattatgcaatgataatgagggggcaaggactccctgggataccactgacaatgacttcccttagagggtactaaggcagctatgggaagatgcttttgaggatcaggtggggagtgtgcagggaggcccagtctcaggaagacggggcagtccctcagtgcctgtgttggtccctaggactcctggggagggctgcaccactcaccaaagcaacactgagagccacagaatgctaatcagactcagacatcaggatctcagacaataactgcgatactgaaaatacacaaaataaccaggcagcctttgtaattaacttccgctcccttccagcagtcatttggagttaatggtttcttaattcagtgctcatttggtgactttaatttccaattaattttgccgattttcctccgaggtgctcatggtgtgatagaaaattcctatatggtgaaatccccaccacagggacctggagtgggtggggaagaaaggggctagggtcaagctgccaccagaagaccagactcctgcctgagtgtcaggaatcagcatctcctgggttcaggaggtccttggggagttcaggggtccatgagagactcctcccctaagagggggctggtgagagctgataaagtggtgcaggggttgaaggtacccctgaatttttctagctctggagagttttgagtcatagtggatggggcaggagaggaagcccagctctcctggaagcatcagggaaggggtcaggaccaagcacagtgccctcccttccatcaagcagaggcatttaagaggtcttggtccagatcccctttgctgggccaatgccctcattgcccagctgctgcagatgtcagctgctatcatctcacagcctcccccttctctagagttgcctttggccagtgagattcacctcttctggaaagttacattacccatggctcgggacatcctgtacacaaggactgagtggtatagacagaaggctgcatcccttctccttaatctccctcccttttgcctcaaggtgagtctgccactgtgatgagctagtgttccagagtggtgcagccagacccagatgaggccacatccttgcttaagtccttccctccctttctgctgccagaactccctcagtaaatcccatgcacctgaatctctgtcttgggcttagcttctggggaacccaaatgacaccaatagtttatatattaaactcttgtcctcctcttgcagtgtgccagaggctgttctaagtcctttactcaaagaaatccatgtcatcctcatagcaaccctacaagctaagcattgttagtgtccctattttgaaataagaaaacagacagcaaaagattaaggaattttcccaggggcagcatagactgtaagtgcagaacaggaacttgaacccggggactctagttccagactctgtgcccttaaccattatgctgcccaagatggaaccactgacctccagcaacttccctaaaggcatggatgatgtaattcaagagcctgagccactaaagtgtgagggagagcttttctccaggtcctttttcagaaggactgaggaacaggggggtctggaatcctggagctctggccccatgataaccaagcactctttttttgagacagagtctcactctgtcgcccaggctggaatgaagtggtgcaatctcagctcactgcaacctccgcccccagggttcaagcaattctcctgcctcagcctcttgagtagttgggattataggtgcctgccaccatggccagctaattttgtattttttgatttttttagtagagatggggttttgccatgttggccaggctggtctcaaactcctgacttcaggtgatccacttgcctcagcctcccacagtgctacgattacaggcgtgagccactgcaccgggcctagagcactcttttaggcaaactttcccctctggggatgctcctgaagatcaatagcatcgtgcaacagacaagtgctggtgagtgaaagtcagacatcagattctagtgctcactgtgtctctgactctctttgtgacttgggatgagtcattttccaccggtgggccctcgcttctccagctctactatgtgaatgagagttagtgacaaagacttgaagagccccagctataatgttttggctttatgaagtggagacactttatgaagtggtccttcctaggggatcccccattagaggatgagaacagatgtccatggaaggcagaggagctactttccatgacctgtgggcatcaatggctctgttcccaaaggattgaggaggggatccacagggccacagaagaacgtaagtcacagtgactgctcagtggccatatatggaacattcattcatcagcaagcacttatagggtgcctacctcatgccagggaccctgcacatgtaactcatgtttccttaagctagggaacaatgaggtacaatcataacaattgccatcaattcattgaccctttccctacttaccattgaaggaccaaccccatgtaaagtcaccccacttccacacacacagtgatttttggaatttccatgggtatctccattgtacacagggataaatattttctgttattaaatggggggtgtgctgtgtccttgctctcccttcctgagaccctcacagtgatgctcactgtctgtgaagtcataggaggggaccccgctgctgaagccttttatgagaaagccatattccctctgctcccaaagctgccagtccacaagtgccatgaagtgtgatggtttctctgacctttattgctcctcaaaggaagaggagaaccccctcagtctcctgaagcagggctaggccagggggacggcagtgagggagggtgaacaggactggtataaatattgcttcttttcttctcccccatcctgacttcctccttctccaaaccttagggataccatgtccaggggcagcttcctcccacagaccagggaggcagggaggtgcagggcagcattccatctgccttcttcccctctgtgagtcccacctacctcacctgcccccaaatcccaatcctcagaagtgtccacagcacagctgctgtcagatcaaaacctctgctggacagctccgctgaggcccttgttggggaactggagctgtcatggctatgtctgccacaggtcccaatccacagctggtaggagctgcaaagtccagccagccaggactggttttttatttttctaatgaaaaataaaaacagacacctttgcagggaagaagaccaaccttactcttagagccagggcattatgccacaaagtggccttgtgcaaccccagggcttggctgtgtgactggaagagtcagccctgacggaagcttccttgctatgctttcagcttacctccactcttcatcttacccaagcacagctatgaccatgcccctctccggtcaaaagccttcagaggccttcagacatctgctgggtgaaatctgaatgggcttcttggcatcaaagggctgccatactctggttctaagccatcttcactcctatcacagattacagccacacctagaaacccactctttcccatacttgccccttgctgccaatcctcaggacctttgcacaacatttgttctgtgtggagcactccacacttccccatctccacctgtagaaactcactctttccctgggggacctgggattcaaggaggaccatggccatgggggtctgacaccacatctgccaatgctctcctctctaattttctctctcctgtctccctgtgccctcattccctccgccactcctttggcttcattttcctggattccatgaacacaattgaattatagtcattaggttggaagggacgcgagagctccatgttctctcacctccacctagatcagtgattctcaaactttgggagaaatcaaatcagctggatagcttgttgaaacatagattgctggaccccaccctcagaatttctgatttgagcggcctagagtggagtccaagaatgtgtatttctaacaagctatcaggtaatgccaatgctgttggtccaaggagcacactctaggaactgctgacctgggtttgggctcagaaattaaccttgtatctctgtttcccccgaaacaaagggtccaatgccagcacacttactctcttggtttggtacccactgatggttgttgtggctcttttatctatctattttttttttttttttttgacagagtcttgcttttcgcccagcctggagtgcagtggtgcaatcttggctcagtgcaacctccgcctcctgggctcaattgatcctcccatctcagcctgccatgtagctggaaccacaggctgtgtgccaccatgcctgcctaatttttgtattttttgtagagacggggtttctccatgttggccagtctggtctcaaactcctgacctcaagtgatctgcccgccttggcctcccaaagtgctgggattacaggtatgaaccactgctcccgggtggatgtggttcttgataggaaggtagggcttccaggcacctgccactcagagccctggggaaagtcttgggtttcattattacaataaattcactgacaagaacacaaaattctttgcagggaaaataatcatagtgattcataaagaaacatactgtaacaacatcaagagtggtaataatagtaataacatgattgtaatataatgtcatcttccctaatgtgctaaatccagattggtctgagcaatataaaagaattactgacatacacaaatgctcagaaagtctagctcagacgtatttggggctatttaggtgatggcaatggtgatgatgactgtaataacaaaccacatttgtacacagctttagtgtttctaaagcactttttaccagttttattttagctgccactctggaaagtaagcgaggtgggtaaagcttctttggttcatacatgaggctcccatgtgttcctcctttcaggcctcattcaacaaacatgtgttgtgtgcaggttaggtacaggacagggtctgggatagggttgtagacaaaatgcaaattaaatataaattcagggttgggtgcagtcactcacgtgtataatcccagcattttgggaggccaaggtgggaggagggttggagttcaagatcagcctgggcaacatagcaagacccccatctctacgaagagaaattttattttcattgatttttagttttttctggcacttagttctgcttcacacaaagaaattttaaaaaataaataaactcaatgcagattcaaatatccattaaaatgaaatttgaatttcagagaaacaacaaatcattttgtagtataaccatgtcagaaatattgcatgggacatacttaaactaaaattgtctgttgttcttctgaaattcacatttaagtgggtgtgctgtgtttttatttgctaagtgtgtggtaccctactggggaaggaaggaggggataaaaagaataagaaatgtttcttgccctcagaacaatctcacagtctggttggacatcacagagctcaaatgattccaacccatgtagtcagtggtctggtagcagcgtttctcaacacgatgcgcacaggtggcacctggggatcttgtgaaactgcatactctgattccgcaggtctggggtggagcctgagagtctgcatttcctacaagtacccaggtggggttgacgatgctagtccctgaccacactctgaatagggacagtgtagcaaggagcaaagaggctgtgggggcttagaggagttgctcagcccacctttgggggtcagggaaaagcttcttggagaaggtgataggtaactggtgggtcttggctggtaaacacttggggagggaggtggagaaagtgtcccaggaggaggaagcacgatttttggagtctcagaggtgtgagaaactactgcaaatctgggaagggtgtgggtgagtgtggatggaggctagatttggggttgcaagcagtgctggagtctgggcatcagaaattcatcagacagatggggtccttgtcatcacagaccccaccaagcccatcaagtggcagagccagggccatggatagaccagcaccatccagtgtggccggggatgaattggaaccaatcactggagtgggggagcccagggagggagccatgtactctgcctgggagttggagaaggtgtcctcctgcgcagcagggtatttggggacagggtcttggaggtgaaagggacttttttttttttcaagggctgagaggaagagaggtgaatgtcttacaagaggggccaaaatggagatgaaaaagtttgctatgtttcggaagagtggcttccttgaggacagcaaccatgtcgagtccttcttctctggattcccggtgctcagcatgaggctttgtcagcatggggcagaaggctagatcagctggcaaggtagcccagagcctctactccaagccctcgttcattttgctttatctctccacaccatggtcagaacatcagtggcggaggaacttgtcatactggcagacttggattcacggctggggttctggaatctgtagtagttaaacggtcttggagtacttcagagttagcagagctggggtagtcactctcataaggcttgttctcatcttcttagggtttatcacagcacgcaggacagattgctagtgttcttctgcgtccgttctctccctcttccttggctaaatagattgcctgcattatagatgggtacgtggcatctcagaacaaaatctacatttcctagcttccctcggtgtggtcatggaaccaggttctggccagtagggtgtggtaggtgtcacttgagaatcagtctgggtgtagcacaggaagaaaatactattctaggtattccagacagaaagagatttaatagagggatctggttgcttacaaattccttggcaggactggaagcatgaaggttgtgggatgttgttagcgtttccagtcacatcacaggagctacaaaccagaggtcaggaagctccgggaaactgctgccaatgtcatagccacccccagctgcaatgaggccagacagtggactggaggatcccaggggccagaggctgcaggccaggtgcttctgccgcctaaggcagaacagcttcagccatctttctcccttgcaaatagcatgtgagtaaagctcattggctggaactagtgacatccagaatcctggtggcaggagtctgacaaacacagtactgaggcttccaggctctgtaatacagtgaaagcatagcaggcggggagggggagcaggctgaatgctacctggtgatattcactatcactccttcttgccagcgggggtaggatgcagtggcaaggacaacttcctaggatggcagagaatcatggtagcagtcacagaaatgccacccaggctggacctttgcatagataagaaataaacttctaccttgttgaagtcaccgagcagctgagcccatgtcctgtcacaccgctattaagtgtaaaatgaggtctgagaagtgttaatactctagcgtgcatcgtgttgatgttactgtagtttcaattgaacctgcccatcaggagtgcagcaataaaaactcattggcagacaaagcaatattcagggctgtgtgtagctgttgccaaatgagagccattgagtctatgctgagggaagctggagagagctcagaggatacaggggtgttggaagccttcctggaggaggcattgctggagatggagaggagaaaagctctccagtggaggccatttttctcttctctctccagagctgtatcagccagggagctgccccaccctgcctccaaccttggcctctcctggtcaaggctgtgaaaggccaggaggagggtggcagggtgcctgcggttaaccccgggagcagactcttaagctggggcaggatagagaccagaaggatggcctgggagatggggaggaaaggagaggttcagcattgctccagagggagaggcccgtgactctgagacagttctcagctgtatctacaagactctgaggacaaagatggggacagacacattcaaggaatggcctcaaggtcatgaagtggtgcctgattctgccttgccccctgtctcgtctgccttgcagctcctccccaggaagaaacactattcacccttcatacagggggcctcaagtaggcctgtgacctggggaacaagggccgtcctatgaacccatgacaggcacagggctagggatgcacccaaccagctattctctcttcacccatttctgtgagaagtaagtgattaggatgtggggatagacccaaactggccagggtcagggccgagtttcaatttatgaccaaggtttagactgttcaggatgagagagtggtccagggaaggatcagagattagacagccacagggaccaacctgtggccacagctttgtctgtgccagaaccatggttcagtctagtaccggagtctgttttttttttttttttttttgagacagtatttcactttgtcacccaggctggagtacagtagcatgatcatgactcactgcagcctccacttcccaaggtgcaagcaatcctccctcctcagcctcctgagtagctgggaccacaggcatgtgccaccatgcccagctgatttttaaaaattttttgtagtgatgggtctcactatgtggcccaggctgaaggattcacttttcatggggaaagagtgtttaacacagtggatgaattcaatttcattagttcccttggtaataaaccaaaatgaaaggctattataagtgtgatttattcccttatatcatagttaaccttcatttcacttccgggggccctctttactcttccccaaaacttgtggtttagaccttctgacactttggtagaagaggatatacagacacagaggaggaaaacgagctgcctgaattctcatgcaacttcagaaagggctagagccaggcgagaagccagttgagcaggtgcccagcacagggcagcctggtggactcacagcttcctgcagtgttttggagacaagccccaggtcaccctgaaacccatgggcaggcagtggacaggcaggccgacagccggctggaggagttggcagcagggaagtcccggatcagagccttgggccacagccaacgctgtctagttggggcagaggatcggggtggcgatttattcagcctgctctacagacagccccagggcaggagccagcaattttccagtcctgagtgatggagccgggaaccactgagtggcctggaagggcagggacccccccaggtcctcgtgggcatgctcagctgctgaaggaaatatgaagtgatggtaagtgacaaaattgaaaatgtaattaagacagatggaactaactggcggggatgataaaagccattccccaggctctgggatttaaagtgaggtcacaggatgaccctgtcctggccacacatctggcaaagaggaggcgagggaatgagcttgaggacaggagccaagctctgtggaggacactgagcaaactgggcttttgccgcactgaaagagctaggtcagatacaggatgaacttcctggagaggagggtggttaaacattggcataagtgagacatcttctccttttcccaaggacatatatatccctcctgcgcagacttggacacaggaacctgggcaacctgaccttgccaagatctgtgggaatgtgaaatagctccattaccaaatgagaaggctgcacaggtggaggtgggtggcatttgggaagagaacaaagggaagtgggctcaatgtgtagcaagccccagacagcttcctgctggccagagctgggagagtaggagtcagccaggcaccatgcaggtgggtatcacagaggcagcagcactgaaggagaagaaagtgtcccttcgagacctcctcacgaagagttgcaccaggagtgagggggcatggtggccactccctgaatccacagaagcagcagccaggcagcctgaccccaggttctgcaaggccctgatggagggaaaccaagggcccacaggagagcctgtgtagaccctcacagggggtaggatggctgggatctgtggcaagattcatgcaagaatcagggagctcagcaccgacatccggggcagccttgctttgccaaccacaatggagagagccagtttagcttcaccatgatggattgcactggccagctttatcagcccccattctttcaatatcctgtgccagttccccatgacaggcaatgggtgggccaagaaagtggcttctttatattcagcgagctcccagattggcgggaaagaagaaactcaggctcccattcaaggcggtcattcactccccatttgttaagcacctgctctgtgctaaacaatagcagggcagaggctcactgtgatgcttaaagcaatactttaagaagtttacagtttttgtatgaattaaaatatacgaagcagtcagatatgaaggaaatacttaggtattcattcaagatgatgtgtggctcacatggtaagggcataggagctgagggaaggaagaatttggtgcaggctggagaagtcagtgcaggattcttagaggaggcagagtttgagcctagcctttgcaggatgaagaagagtagcttaaaagattaaagaggagcatgcatcttgggtgggtttaatgcacaagtaaatatgtagaggtgagaaagagtattcaggaagaattttctgaactttaggatagaactaaggttgggctggaaaatagatccttgggtgatcccagcagatccaaggccactctggggtcaaacatttctctatgagaagagcttgtgcccggggatgacttactgtccccaagtggacagaaccatcagcaggaggtcagtcccagatctgaatggccaagggcttaggcttcccccgactcttgggtctgtggaacagctgtcctaaaccccacctccccaagccacagaaaatgaagccagattggaataaaggatgcccttctgctatgctgatggcgagggatcaatgtcattctgcacccttcccccaccacggccaagaggtggcaagacgcgtgcaatgggcaaggagacctgtgctccatgtactgtccttccaccaggagctggaccacgggctcctctggctctgaggctgatcgtgtggtccttccttgccatggaaaaagcaatggagacaggttggtcttgccatctgcggaccatctttcattataggacatgtctttgttatggatcctgagcatagaacaggccagcattatctgagagatgggagagatgctccgtcacttcaagcacactatccatctatctgtcatgggcccagcatttatgcctgcagccaggacactggaatagcacatcaggatttatggggggcattaagtcataatttatgtcactttctctcccttttcaagacagtctttctgaaacatctctgtctccctggctcaccattcctaatgacccaagatgtgtgtttcttcccgcctacctgcagcctgcttttgggggtgctttctctgttacctccccaatcccatgggtcagcctcttgctcttagcaagtccctgcccctgacctgggagaaaggatctccagaagtgtaaactagctgataaggaggagacaggcccctatcctggtttgctgttggatcccctgaggatatgggagttccagaggcgccccaaatccctcacccgtgatggctgtaggggagcaaacagctattccaagtcccaggtgtgtagccatggagaaatcactttcttcactcgggtctttcaccttctcctccacaaacaaaggggctcacagatgacctgtacaacttctcccccctctaaaatggaggaaccacatgtcctagacaccttcgctcattcagagctaagcctggcaaagggcaggcattctactgttccagagacaagtcagagccaactacggaggctgggctgtgaagtgaatgctcctagtcaccctcacgctggagggatcccagtgggagctgttcctttgcagggggtgctggggtgccactgctggctttacctcccaccttttcctcggctctcttatttcattcctttcccttccttcctcctttcctcatcctctctttcccctctctcttctttctcatctgacttatgtctgcctggaactttgccaccctgctttaccaccaactgcttacttcaaaccacattttgccggaccagaaatagtgccagcattgaccccgacctgagccaagatttgaatcgaaagccccagtccttgaactctgactgttatcggctgatttgtgtcctctcaaattcacatgtgaagccctaacccccggtacctcgaatgtgactgtattcggagataggatctttaaagaggtcattaacgtggactgaggctattagggtcggccttaatctagtctgactggtgtccttataagaggaaatttggactctcagagacacaacagggctgagcacccacagagaaaaggccctgaaaagaggcagcaagagggcggccatctgtgagccaaggagagagacagaggaaaccacccctgccgtcgctttgatctcagatttcagcctccatttcagttgtttgaggccccagtgtgtggtactttgttatggcagcccaggcaaactcatccattgacactgaatgaccctggtatctgtctcagtaagatatccctttgggcaggcagcaatggtggagaatcattcttgatccggagcattgaacattgaatgttctcagaaactgaagcactttcactccgatttcctcagtctgcttggcactattctgaggttgtagctggttctgtccgaagccatgagctgcaggggccctttcagaggcagtggtcatgtgataaaatcgtatgatgtatgtctcgacataggaaaaaactgtgtggctccaaacactggtgttaataaaacagtttacatggttgtgaccaagtagagactcttttgatcagatatatacatcatatatatatatgtatgtgtgtgtataatatatattatatacttacacatattagaatttttaaaaatttttaaaaatctgaaatatattcacatggttcaaaagtaaaaagcataaaaggtatatagtgaaaagttttctttcactcctggctaagattcacccagttcccaccaccctctgacagaaactcctattaatctcttgtgaagccttctagagatttttaaaaaatttattcttgagacacggactcactccattgtccaggctggggtgcagtgacaccatcatggctcattgcagcctcgacctccctgggctcaagtgaccctcccaactcagcctcctgagtagctgggactacaggcgtgtgccaccatgcctggctaatttttacttttttaaagagatggggctgggcgcggtggctcatgcctgtaatcccagcactttgggaggccgaggcgggtggatcacctgaggtcaggtgtttgagaccagcctgaccaacatggtgaaaccccatctctactaaaaatacaaaattagctgggcatggtggcacatgcctgtaatcccagctacttgggaggctgaggcaggagaatcgcttgaacccgggaggcagaggttccagtgagctgagatcgcaccattgcactccagcctgggcaacaagagtgagactctgtctcgaaaaaaaaaaaaaagagaaagaaaaaagagaggtggagtctcgctatgatgcccaggctggtctcaagctcctaggctcatgcaatcttactgcctctacctctcaatgtgctgggattataggtgtgagctaccacatctggcctagagtttctgtataactgtataagcaaaaccaaatatttcttcatacttccccctatttttcacaaaagttagtatcctatacacactattttgctcctttcttttttcacctaatgaaatatcctgaagacttgtttatttcttaataagctccctcattcattgttcacagctgcgtagtattccattggaggatttacctacaattcaaaatcctcctacctcctgttgcagaaatgcataacataggaagttagactcactcaagtaccattgtccagaggaagccactggtaacaagatgatgcatttttatctgactttttaggaatagtcattatggtttttcacagaaaatttaaagtaacagtttctaattcctcgtaactttttaatgatgaggtttaaaaatttttcttatttaaggctcaggatgcattttaaatttataatttatttctatatttaatcctgtcatcaatcatttattcttataatggttttcaagtactatgtgtagaggtttaatattatcacttctatatttattttaacacatataattaaacatataattaaatgtatattatatgtaaaaaaatcttcctgcatccaaatacattttgaggttaaggagagcatatcttcactagaggatgtctgagataaatgatcagtatgactcactgcaggggatctcagacttcggcttgcataagaattgactagggatgcataagacaccccccagccccaccacaggattctgacctcagtagctctgagatcagaccagtcagctgcactggagcaagttgattctgttgcaggcatctacagccctctctctgaggagccctggtcaatgggaaaggaagttaaactacatcctgcactgaaaatattaaggttgttgcaattaatcattaaacttagctctcaggtttctggcagctcagaccaaagtagaaccaaaaggatgtagtgttcttctccctgccagaacaaaaggccagttcttcaggagacataaatgttttcctgacattaaattctaagcagcatttatcatgggggtcattatttgagataccctaagctacacaatgggcagcatcttcctcaacagccccatggaaaacatagacacagtcgccactgttcctctgcagaagtcatggcccatccctaaacccagctcaggacaaaattctgcaggaagctcagccaatgtgagccagaggcattgagaagactcaggctacctcagagtaaaagtataggcctcttgtgacaccgtcaggaaatctgaatggggatgctcaatgtgaccgagagaacaccaaggcacaccccatacctatggcttctgaactcaagggaagacagggtctctgtccctgaccatgcccagtgtgaagaaggaggcctctcaccttaccttaagaagctcctggaacaatgtggcaggaggaaaaggaggatagacagctgtttccccattctcccacctaaagctttgagtattttctgaaccttcagcaattggggccactctctcattaagcatacagttcaggaactggaacacggtaaatattcatgaagagagaggggcagtaaccagtgtgttccccatcctgctgttcctaggatatcttgaaaacctctagtgttctatggattccaagggacaggtggaagtatatatgcctaatatcctaaacaaggtcctcaaccccagccactgtgtgcttaaacttaggcaagccaagacattgtaaagcccgttcttcctctctctcttaggctctccctcattccaaactggagaatgaccttggactcctgattgccaacagtatgttcaggaagctatgtcactgaggctagagctaagttgggatagatgactgcatgcctctggggtgcattcagctgatgaaatgaggcctgtgagccaggacagatgcaagaaattattgttcctctaagatggatgagaccttggcaatgatggtggagactgctggttatacaccaaaatccatcctccccttcttccataatgatagagttgtagctagccacgtggctgctcagctagggactatgcttcccagccccccttgcaactaagtatggtcatgggaccaggttctcaacaacagagtgagcacattatatgccatttccaggcctgcctcacaaaaccttgggaatgtgttctactgtgctcgcttcccatgagtccaaactcagataggcctgggccccagctgcaaccaagcagataagtgcaatgccctagagcagtggttcttcatctttaatgtgcatcagaatcgcctggagaaattcttagctcatggatggctgggccccagcccaagaatctctgattcaatatctctgtgggtgagagctaagaatttccatttctagtgtgctccaaggtgatgctgatgctgtcggtccagggaccacactttgagtagcaagtccctgagttacaacagagggatgagatgaaaatcacctccatccctgaatgaccacatggagcacagcctttgtacacccagaatgttcatcttggattgatgtatcagactgtcttttttaaagcaactgagttcttgctgggtctctatggttcagagctcaactttacactaatgaatacagcagtcatctagcccacttgtttaaatacagaaggggatgctggggtccaggaggaaaaggacctgcccaaggcggcaaacgaaaatgagaacaccaagctccagctcccaaatgggagcctgagccccgtgtgtagatgtgggagcactacagtcccttttactcggtgtgagaggtagaataataccccccattccccggccaaatgtccatattctaatccctgaatcctgtgaataggttaaatgatgtggcacagagaaaatgagattgcagactgaatttaggttgcccatcagccgactttttaaaatagagaggttataaagtttggcccaatgtaatcataagggtccctaaaggtgggagaaggaggcagaagaacagtccatgtcagagtgacacaatgttagaaagactcagttggccactggaggctttgccaaggaatgtagcagcctctagaagccagaggtgtcaaggaaacagagtcttccctggagcctcctgcagggaacacagccccaccagcaccttgatttcagctctgtgagccctcaccagacttctgatgtcagaactgtaagaatattaatttgtgctgtcttaaaccaccaaatttgtggtaatttgttatggcagctacagaaaactcctgtgtgaggaaactgttccctgtgtgaggcaggtctggcccttaggctgggggccttttcttcctccacctcccccacagcacctggctcagggctgggtcccaagggatgggggagagagaggacacacaataaagcatgtggatagggacataggtccttttccccaaaaccaaagggaaggaatgtgcttgtatcactctttgggatgcaccctgatatgatctggctctgtgtccccacccaaatctcatcttgaatggtaatctgaattgtaatctccacgtgttgggggaaggaactcatgggaggtgattagatcatggaggcagtctccccatgctgttctcatgatagtgagtgagttctcatgagatctgatggttttataaggggcttttccccgctttgctctgcacttctctctcctgcagcaatgtgaaggaggacatgtttgccatccccttctgccatgattgtaagtttcctgaggcctctccagccctgcagaactatgagttgattaaacctctttcttttataaattatccagtctcaggtatgtccttatagcagtgtgagaatggaccaatacacaccttatctcttataactaaaccctcactctgtccaagattgaacttaatttagggcccagcctgagtcttcactccagtaaacattttggaaaaatatgttgacccctcagggggaagcttagggtgtgggtggcacaaattggccctgctcccatagtccagctcatcaggtcttatcaaggccactggggactgggggagaggcagaggctgctggtgacagggcaggctcccaggcaaggggggaagtggggaatgagagtcctgggggaaagaggggaaagggtgaggatgggttccaggctcccactggaggcctcagtctttggaaatcttcagaaatggcaggctgtgggggcagcttgtaagcccagaaagggcatttgtcctctgggatggaagcatcacttttgaccaggtcctctgtaggtctggaggacctaagaggtggtctgaggacactgctgagtgaggggttgtgcagttgaagaagcaaatgtctaccagtgtgagggactgattcaaaatcttccctgggcctcccagctaccccgtttcccaaaaggagcccgtcacctcactggcactcctctcacagagctgccctgatcccacagtgagctgcaagccctccccaggtgcttttacccaggaaggcctccctgactcccagcctgccttgatctccatgctctgaccccttcagccctgccttgctgcatctccctgctccctgggccacacccctgtctgtccactctaacaggagcatcctgagaacaaagccctgtttcttcctgaaaataggcacttacattcaagctggaagacctggaggtaaaggacagtggctgaggatgctgctgcaggtggcatttgctggtaaactataaaggcaagttaggggctcaggaacccagagccaagtgcaggagcagaaattaggaatcctgggatggagactcagccttgactctgtctcactgtgcgaccttaggcaagtgtttttacctcacctgcagagccttactttccttatctataaaataagaatattcattcatacaagttcaaccatggggatgatttttggggtggggccttaaaaatgtaaggaattctgattcagctttcaaattaggaatagacagagggagcgaagcctgcacacctggttggatttcccatccattctgggctagaatgagggaaattatgccaaataagggaaatgtgaattaaacccaataatcctacactaaaataaagttctgaggcttaaagaggctggaatgttgtggccaagaggagagaacattagaaatgtgtgatctatccatctggccaaacagctctggggggaagaactgcatggaatggctcctgagagcaggccaggcattgttcagatcggaaagaacctagcctgtcaatcatttacaatttggtgtgaattctgtggctggtctatccctccccaaggactaacctactagctggaaccctccaggcaaatgcaagattccgtctcctagtaaaagactcttgaaactaccaccttaactatgaaactaccactttaactgctctttcagcttgactcaaacacctctggattccaggatgctggaatagtccatcatgcccttccaaccagggtaagcagagaatgcccctatgctggtgaggcagtgagttccccaccccctggggagttcaagcctaggaatagccttctggagcttgcactgacaacatgcaggctccctcacatttttgaaaggctgagattctaagattctgtgtgagggacaaacagacagggactgtaaagccctattcccctttccccaaaggtgggtgtcccacaggcccccctggactccctgaaccctttgtatgaggtgacattgtgggagaacaccaggctataggcccagcccctgaagcttactctccaggccctctggaaaaggaaccgctaagcagcccccacccaggtagctggtctacacagccttccccagccctgcccagtcacaagcctgagaatgagtccaggtgcagaagaaggctcagcctgggtatgcctctgccccatgccaaaactctcaaactgcaggtggcacatttttcttcctttggaaccagaaggaactggcagcttctctaccattctggcactgttcggatgaggattcatgccagaaagggctggggtagaaggaagaagatgagaagggcaggaaactaggaaggaattaacatttagagagcttctcctctgtgctcagaactgtgggggcactttgcaagcatttgttcattctttcaattacgaattcattcacagattacttctacagacacatagtgaacatccacatgttaggcctggtcctttgaggacctgcctttgaggaatccacaggataacaaatgctatgaagtttacttcatttatttattttacaaaatccgggagagacatattatttttcccacattacagatgaagaaagggaagatcagagaggttaagcaactggcctaaagttacaccattttatgtggcaaaggtgagaagcagaacttggttttcaattctgttattaccatcccttcctactgtgtgtctgtctttatctttaaaatgggagtgcagctccttctttgcaaggtgttgatgaagattagatacagcacatgttaaccactgcatgacatgggtactcaataagcagttcatgatgcagtgtctcttgtggctccaagccctctattctctcacttcctcacatggtttttggagacatgttgctatagagctggacttaggagttggggaagcaaggaagcaattaagggcttgagaaagcctgggtcctgtgggaggcagtatatttatcagtctgcctgataattgagcaccagctgtgtatcctcgggatctgagaaggagatggaagacccagaagatacaacccctaccttgtgggaattctcagcatggtaggggaggcaagattgacaaataaaaacaacataggagagaggcccggctgtgtgctcacagtataagtgctatagggacccaaagtgggcatggactatcaggaagcttcctggaaaagggcaaatttgagctgggcctccacatgttctgaatatgtgaagagcaggcagctgataagaggctcataagcaggccactgggttccccgtttttaattttgaaataagtgtagacttcaagaagttgcacaaatagtacaaagagtcctcaagtacccatcaccaatcttcccctagtgacatgtgggaatgtggggatagctgcagcacaatattaaaaccaggagattgactttgcataatatgattaactaatctatagatcttactttgctgttaccagttttttgcaggcactcttttttgtatgtgtatatgtatagttctagaagtttatcacatccatattgccaccactacaatcaaggcatagaatgactgatcaccacataggagttccctctagagcacatttttttgtttgtttgttttttgaaacagggtcttgctctgctgcccaggctggagtgcagtagcacagtcacaacttgcttcagcctcaaccttctggactcaagcgatcctcccacctcagcctcccaagtagctgggactagagactaccaccatgcccagttaatgtttgtattttttgtagagacagagttttgccatgtttcccaggctggtctcgaactcttgggctcaagcaatccacctgcctcggcctctcaaagtgctggaattacaggtgtgagccaccaccccacattgaatttaaattgcccacattatgccctgcacaggcactaaggatgtgtgcctgctcatcactctaggaaagcctacctatcccatcttgctctgcacaaagaggcctttccagggaaagcaagttggtgactgagtgtccatggagagatcttcctcggttgcctgaagccccctgcacaaaccctctgtgaagaggctcaccttatcacgttcctgcagaagaagaaactgaaaccctgaagacctggtcctcccaaggtgagtcttgaacaagctccttgaggttcagcaccacggacagatccagggcacaggggaagacaaagagtgttcataaagacaagagagagggctgggtgcttctctgggtcacctcatagtctggagatagagaaaccctaagtgagcatatgacccactgcccccctcccccaacaaacaagggcgcagggcaaggaagaggggtgcatttcaggagagagatccctgcttgcctgactcttccccattattcaaagcttatcctcaatctcctctgttctgagaatctctccttgactttcccaccttgctggctcccttctctgaattaatttaccccaaaagctggcagcaccatccaagacagccgggagcacatcatgtgcttttctctgcctgctcccacatatgaagccgcacccccagccagaatgtgaaggcctggaggaaagaccaacttgtccttcacttctctcttccattttctcccttttttcttcccacccaatgtagctccacacagggttaggaactcagggtctttctgggggacttgttagccaaggggtggctctgtccttatttgattcaccttccagaatcccaccttggacatcttttctgcctggcactattggggcagggagcagagggagcatattcaaacctcagtttgccttccagaacttctcagccaagcttccttccccttttcccataaactgtaaggcccttgccccttgggaatcctcattcacggtatttttcctggaattatctgtgcatcctggagttagcctcaccaagcctggagaacaccatccccggccacctccccactggcagcattatcatgggtgccgtgctgcaccacccatatgcccccttcagaactaaagggcttactctcccagctgccaggaaaacgattttttgacgcttctcatttctcagcccctctgggaattgtctcagctgaagaaagcatccatgcctaaggtaacacccccttcccagggcagtccacatccaatgacagggtattagggcccagctccctcaccccactctgaagggtcctcccaacctcagagttcctatggaatcattggaggctctcatgggaactgcattgctgcccaacttctccctctgcccaatcctgcttcctcccctcccctacaggcattggtcctgagaccccttcctgatgctttctgcatactagttttctcagagtatgcttccaggggaacccaacctctgacatctctaaagtcttggccctgtgggatgagggttctactagccaccaggctggctactcagatgaggcccaacaaggctgagtggagcagccctgtttattaatttcccacaactcttcagaaagactctgttcactccacattctatgacagtcttcagccttgctcttagaagcagccctgccaccccgaggtcctctgggtcttctggcatagtgaaacaaactctgaaggcaggcagatcagcctccagtgcctccaggtactaggtaggtacccttgggcaagttccctcatctccccgagccactgttcccagatctggaagcagaaatgataatgaaatgataatgaagacatcatagaagtcatacaacacaagtaaaaatgtttacaaagcacagttcctgacatataaatatgtgctcaacaaatataaattcccttcccttcttttgagtctgagggcattttgtaacaaattgccaattaatatttttaatattgaaatatgacattttaatagtattgagtatcacaagtgtaatataaatctatagaaaacgttgcaaatttttcatgtgatggatcagggaggcaggaaggtggtcattcaactgaattctccctgtatactggtcttcttcttcacatcattggaaaattcttggcatctaaagaggattcctcacagtgtaaagactatcaggtgttttctttgtatcctaaagggaaatggagcccaagcaggccacctctatacctggctggagcagagaatgtgtccccataagaaagcagaatcagcccttcttcctaagcaataggtaaatggattggagaggaggtggtaccttaaattatggctgctttggccacacaactgggtgctagcatctggaagagaggatgtgagaagacaatcagcctgttaagagagttttatgaaagtataagttgtccctaaaataacaacgctaagtatccaactctgacaatgatctcttcccaaaatgcaatgatcatccactccctgaagcatcttcctgctccctcagacttacttcccccaaatccttcttcccctctccccaggcaagctggagaagccctgaccaccccagaacaggtgctgctccctcactgtggcatctgtggcctgggtgtgtagagtgggagctggagggggcttggggagcccagggagggaagccacaccccgggcacacattttactccagctgggccttttctgacaaccttggaccagcacacagctacacccacacacaagcactgggctcagagagtgctgaattcagccccaattaaagggccatctcagggcaggctgccggcaccagcagctgctattttgggactcagtgaaggcagtatcttctctgttgctctctcctccatctcggttttatttttctcctctctctcccttctccatttccgttctctctcttggattttctacctgagtatgcatttcttttcacctctcagctcctctgtctctccagctgcccccatctctgtggctggatgtcactctagatctctcttatcaaatcaacttgacacatacttattccccgctccactgtaccagaccctggctgggctctggagaagaagcgatctgcaggtccctgactttgaagagccctgaagtgtggtctgcctttctctgcttctctctgcccatttctgcatcttgacctgccctgctcaccctgcccaggaacccaaggattgcttctaaagtccaaagagaggattcacgttccagccgtcctatctgctggtccacttgcagtttctgtacccccgggttctgtgccccaggttcccagtcctggctttagaggctggggacttctctcttcctcctccaggcttccagtttcagcaggaaaagaagggctggcatttccagggtgaatctgtggcagcaacggctctagaatgtcccagaggcccacggccaggcctccccaccatcctggccccaaggagacctggccctgtgcctgcagcgtagaaccatttggtctcccttgtatggtgattttcactgtaatttggtctccaggtctgtctcttgagattggccataagccaagatagctactctccaggagagccctgaaggggggaaagttaggtttgggtgtgtgagacacaaagaagaaatgaaagtaaaatgcagaaggacaagaaatttattactctgaggtcccacataggttaggggtgtcaatggtgtccaaaggaagtccaaaagtgacagggagttcaacttggggcagggggaagagagagaaagaggggacctgtgggactttgcctttcttaaagccttagcgttatcatttgggctttcccacaggggttgttgattggctggttcagagaaaagatacttgaaggggggactcatttacatgactctggtgttgaccattaggtttcatcatggtcagaagctgtgggatcagcggtattgggtcagtgggatgaggaacaagcaggctatattgcaaacaactacatggggaagggaagtgttttgggctttaaataatttatattaaaccttaaaatggatgctgagacatcaactacattaaaacaaatttatgacactgggtcagaccagcaggccgtgctccttgtcagtcgagagattcaggattcatagaccaaagcctcttctctgtcttctccttctcattccagaggagcccactccactatctcctgccccagcccctgcagccctggtacactatcctgtactcatgggaccaagctctcccaccatggtacctgctggctgggtttaacctgactgtgctctttgacactgagtgtggagtaggggctgataataggacctgcctgcaaactctccgaggtccttcccctcaatggattcccttcttaggtttccccctgtactggaaatagggggtacatggtaacgtcttatgggtattattgaattaataaatttaaaaacttagccagacacatgagtattttcagatgtattgtcttattcaattcatagaccagtcttattaatctcattttagagttgcaagaacagaagcccaaagaggttacccaaagtcaaatcaccagggctagggtaggaagccaggccccctgatgccccagtcagggcttgctctgaaacacagctcttgcctgtaaataaaagaaggggaaaaaaacacttctacacagcacagttcttcctcagagagttcttcatctgagatcccagggcctcaatgtccttagcagctgcttgagagatagaaccaactcttcaggagagacagtacaaggcacccgcacactgagccagactcaacctggctgggacctcggcagagcagagaagccctggctctgggccagttgggcacagctggtaacaagttctcagtcaatgggagcccaggggcgagaggaagctttagggaggaaggaatgttctttgaagtggtgtcaaccagaggctcagaggtgaaaacgtcaaaaactcccaggtggccggcaggactgagacccccatctcccagcaggaaacaggaggctggcttggcggggccacctttgaagctccccaggggacggacatgccactcagggcctccctggtgaacaatcatgcccctaaggcctatggcagaagcggcctctgaagccggctttggggctggggaaagtactgcctgtctttggtggctttttcaagctcgccctgctctttttcagcagtaccacatcagggtgtgccagacgaagaggaaggaggtggtggagcccaggtgtgccaggctgccctggcccagagttgccgtgcggagtcaaggaccccaagcctgttgggaccttgacctctagggacccctggctctaggctggcctgccccatatctccctgacttctaaccagtagactcccagagccagccattagactccaggggacccccaaaccccgaaccctgggccttgagtgccatatcctgcaggtcaccaaggcctgaagagttggaatcccttctctaatccactctctcttcttcatttccagcacctctgctggattctggccttcctcatctcccctggactgttgttgcccacgatctggcttctgttctgccctagccacccagagccggctctgacatgcagatcaggccctgcagtctcacattcttgcttctgctcatccttcacccgacacccagggctccatgacttggctcctatccacctctccagcttcctcccacctctgcctccaaggtgccctcctgagctcagctgcaggcagccacggccgctcctcagacatgtccacctgttctcaccattgtacctgtgccatgctgtccccagctacgacagaatcctcccactctagcctacaggcactggtctatcttaactttttactcaacttctagacttcattccagcttcaccttctcagaaagcctttcctggaggctgggctgggcctgtgcctcccttgggctgtctctgtgccctatgtgcctgatctcactacttgccatgctggactgtcactgctggcaggtgtgtctcctacaggaaactgggcttcacggagggcaggggtcatttccaagtcacccatgtggctccacaacccagcatgtagggtgataaatagacaaccctgtaccagttcccaccatctggttgaggcagacatacacacacatgcacacacacacacacacacacacacacaaactactgagctctcacaggattgggtagtgtaagctcaactgagggcagagtcagcaaggagggttcccttgagaaggcaggatttgagctgggttcctttgagctaggttccagaggcatgctctgcacctatctggggatgtgagtgcagacacccgagccaaagctgggtggccaacgactggtggattgcattgcattgatggcccagtgcttcctgctccctgtgtcctggccctctgcggtgtgcttttgtattgtcctcccactatgaacagaggttacgtcactacctcacccttgagttgacccagccatgtgacttcttttggccaatgggatactagcagacatgctgcaaacggaagtttgaaatgagctttcacattggagcctgccgtcttgtgtctgtgcttttggctagcttaggtcagccaatagccagctgacctccagagtgagtgaccccatctgagaactgaagaatcacccagcagaacccagactaaatttctgacccacaggataataagttaaatgaatattatgttaagccactgaattttggggactttgttatacaacaacagtgactgaggccaaggtgaccagccttttgaagggcaggctcatccacaatggttcccacgatgggctggccatctgaacaggaccatcactccttcagcatttccactgccccctctgcctcagccaccttgggctctacgagacctcacacatgtcctgtgtctttacacaacctgttccttcctcctggaagacccatcctcatcttgtcctctgaatcctgttcactctttaagaccagctcataccctgaaacctttgtaggttcacagcctctctgccaccatcaatcttttgggaatgaagtaaggtataagtgagtaaaatccctccccttctgtctcctgtcttcctgtatccccctttgctctgctggtagctttattgcagcacatcccctttcatagttaccaacccatgccgtggctcctgaacactaagtagggaggaaggcccaactgagagagtggctctcacgtaatcctgggtctccccaagcctcagcactagccgggtacccaaaagtatcctgggagggggcaatgaataaagatgaacaaactttccatctactgattttagaacaatgagacatggtactatgtaaaaaacccacattgaaattcaaagacctgttttcagtccctaccttgccctgcaacatttgccaggggcttgcccccctccgagcctcagtttcccatctgtataatgaggggctgtgctgactcatttcccaccccccccgccccccccacccccgtcagggctgagcatctgtggagtgtgctcaggtatccggtcctccggttgccagctctggcctggttcctcactggcctgggttgtgtgacaaagcttcccacctgccagcagcctggccagtcctttggatagtggtggctaatgagctggcctgggttcttttgactgccagcatcttccactttctgaacctgccagtgggataaggaggccttggtgttgggagacatctcttctgaaagctctgctggtcaaggctgggtccctgcctgtctgattggggaggcctggccagtcttcaggaaattcacacacacacacacacacacacacacacacacacacatcatccaaggctctctcctggaagcttctgatgggctcctaggaaggaatgctgactggctgtgtcttcctcccttggcatcccctagagtcaggtaagaagaggacagagaaagggaaaatgggccagtgcaaaattaaccacacagagaaagacttttccactccagctcactgaaaaccaggatgaaagatctcagaagctggaatccagccaggttcacacctagggagcaaagcttcctggggtacagtgcaggaagggaggctagatctgaactagagcttctcctccagccagtattatcactgcttactcaaggaggtgggaaagctccaaagatgctcacctcatgcatctccctggcataccaggaagaagcctggggcagaagtccatggtgtctctgtggccctagggtagggctctactgcagccctagggtagagagctaggccactggggcttccagattgcacccatcacagacagtgagcggctgacgcgatgcctctctggctctacctcctccctcgtctacccctctttccagcagataaacttgaaggaagcagggagaggctgtttgtggatgcagagtggctgctcactcactgctctgttctcacactatctcctcgaaccccacccctgtgaatgctagaggcaaagactaagaggctgaaagtccggagccttggcttctagtctgggtgttttcccttgatatctttgtgaccttggaaggtacagtgcttcttttggacccctggatatttcttctgcaggtaagaggtaataactcccactgtcaaatggccgcaggatggaaaccttctgaaaccatcaagttctttatacagatgttttcattattgagtccagagaggtggtccccaatgtgcttgaggcctcactgtcccctctttgctggcctctttgcagcctaggctttgagaaacatggccaggacctggcctctcctccccgcctcatgttccccggccagctgccccagtggtccctgcacaggttcagcacctgctctgagcccatcctggagcagggctgtcaggggagggaccttccctccagctctcttcctgggtacagaaccacccagagaagagcgacaggctagagcaggacagagtgtgagcaggagctgttgtgtggagagtagatgctcagagaagggagagggtggcacagaggagtaaagttcctctccaatctgtctccaaatgcttgtatcttctacagtctatactacccatggatttcaggtggagagaaagacatctttctgacagtgagagttgcctgggagtggtggaaggaagcatcctgtcgatgaggcttttttgctgagtgtgtgggggcttgtgcacacagaaatactatttatagctaccttttaaaatttaataggcaatttattaaggatacacatataaaaacatagctttttagaaggattaagctccacttaccaatcttattgttctatgcataaatgcaataaaataagaacaagaccttcactttttcttcaattaaagtttgattaactcaggttgaaaaaactactcctttaaacaatcagtgccttttacaactcaattaaatttgcttaaacaatttcagctacatttaaacatttaatatatttgattttcctacgtaacttaaatatctaatggaataagcaaaatctttttatcacgtacttgaaaatccattgtaaatacaataaattaaatttataaaaatactgcctgggtgtggtggctcatgcctgtaatcccagcattttgggaggccaaggtgggcagatcacttgaggtcaggagttcaagaacaacctggtcaacatggtgaaactccatctctactaaaaatacaaaaattagccaggcatggtggtggatgcctgtaatccccgctactcgggaggctgaggcaggagaatcacttgaacctgggaggcagaggctgcagtgagctgagatcataccactgtactcccgcctaggcaacagagtgagtgagattccgtctcaaaaaaaaaaaaaaaaagaaagaaagaaaataaataaataaataaatttataaatagaataacttttacattctcttaaatattgcaatactgtttccaaaatttgttacattctcccatacctttcaactaaaaattacatgtctacaggcttctgattacagctaagatggagtaagcaaatttcatcctctctctcccactgcttacaaataaaatccctggaatgaatgcatgcaacactgtttaagaatactgaaaaaaaaataatagcaggtggatttgcaggaaataaatgctcaaagaatgatcaatatgaccgtgagttttctggtattttccctccaatatctcctgacttggatgctagagggcccaaatgccactgcacagtgggcacaaacaaaaaagctccaagaggaactcttccttctagccacaggactgggaacagggaccctgcaggtcagagagtgaccccaattgttctctcttttactctcctgggtatgtcccaaggaaagccccaatcatgaaactatactcctgtaatgttggtagtgcaggatctaaaaccatgaggaaaatccttctctctggtcagaggaattgggaaagggaacccctatgaaggtgtgggggaaattctgttgatttttctttctttctttgtctttttgcttcacccaggaggtggaccccaggcaggggaaatatgcaacagttaggggagggtaaaactccagcgttgcagcacaaagacccggaaaagggcctctgggcgccagagagtgtaagggaaatcgcggtgtgctaaagaaaagacttccttaaatccgtgggtgaagtcctggactcttccttgagcagggcatgtgtagaactgatccaaagcaggtcaggacttgtggtctgaactagatagggttgatcatataatattcaaaatgccccaaattactccatacacaaagaaccaggaaaatctcaattactttcaaaggaaaagataattaactgatgccggccctgagataatccagatgatggagttatcacacaaaaactttaaagcagatattatcactatagttcataaagtaagaaaaaatgatcttgaaatgaatggaaggatagaagctgtcaaaaaagaacctgaaaatcattttaaaaagaacaaaatggacattttgttgctagaaaatacaataactgaaattttaaaaatcacctcagggcttcaattgcaaaacaaagatgacagaaaaaagaatcaataaacttgaaaataaatcaatagaaattatctaatctgaacaacatagaaaaaaagattgaaaagaaagaatagagtttcagggacttgtgagacaatatcaaaatgtctaatattcatgtcattggagttcaatagaaagagaagaaaaggcttgcttggtgcagaaaaaaaacttgaagaaatcatggctgaaaacgtcccaaatttggtaaaaagacataaatgtattgattcatggatctcagtatattcagaaacccccaaaacaataaattcaaagacaacctcacccaaagacatcttaaacagctgaaaaccaaggataaagaaaaaagttaaaagcagccagaggaaagcaatacaatacatatagaggaagaacaattaaattgcctacagatttgtcatcagaaaccatcaaagccagaagacaatggaaaaaattctctaaaatgctggaagagctgtcaacccagaattccatacccagttaaaaaacaaaacaaaacaaacaaacaaacaaaaacccaaaacctttttaaaaggcaaagtaaagatatttttatatgaagaaaaactaagaaaatttattgctggcatgccagctgcaaaagaaacgctacaggaaattcttcaggagaaagacaaatgataccaatatttgggagatttttccagatgtctttctcttactcattttgagttgctcctgtagccactgctgctgctactctcttgaagaaggccacactcccactcaaaacttggaacttaaggagtaaaggaagatgacaaaattataaaactaggtaaatataataaattattttctccttaagtactttaaaatatgtactatagaaagagaagaaaaggcttgcttggtgcggaaaaaaaactggaagaaatcatggctgaaaacgtcccaaatttggtaaaaagacgtaaatgtattgattcatggatctcagtatattcagaaatccccaaaacaataaattcaaagacaacctcacccaaagacatcttaaacagctgaaaactgtttaagctgaaagcaaaagttataacattgtataatgaggttttcaatgtctatagatgtatataacgagtacagcatgaaggagggaaaaggacctatatggctgcaaggtttctatatttcacttgaagcggtaaaatagtaactctagatagaccatgaagaattaggtatttgtattataatccctagaataaccacttaaaaaatacaaaaagatatagtaaaaaaggcaacagagaaagaaaaatggaatgctaaaacaatattcaaataatccaaaggaagacagaaaaggggaaacaaagaaataaaagatttgggacaaaccaaaaccaaacaataaaatggtagacctaaatccaaccatatcaacgaatgtattaagtataaatggtttaaacatatcaattaaaagacagagatagtcagattagatttttttaaaataagaccaactctatgctatatataagaaactcacattaaatatgatatagataggttaaaaattaaatgatttttaaaactaccatgaaactttttttagaaagctggaatggctatattaatttaaagcaaactagacttctaaagaaggaaatttatcagagattaagaggaatattacacaatgaaaaaaggattaattcatctagaagttgtcacaatcctcaatgtatatgtatccaacaatagagcttcaaaacacatgaagcaaaaaattgagagaagtaaaagtagaaataaacaaacccagttatacttggagactttaacaaaactcatctttcactaactgatggaaaagtagacagaaaatcagtgaggacgtagaagacctgaacaacactaccaatgaacttgatctaattgatatttgtagaacactccacccccaacagcagaatgcacattcttttcaagttgctccaatatagaccatattctataggtcataaaacaaaccttaacaaacttaaaagaattgaaatcatacagagtatgttctctgattgtaatgaagtcaaatgaaatgaacgaaagagagatatctggaaaatctctcaaatactggaaattaagccacacataaaaaattcatgggctaaagaaaggtgaggttgaggagctgggatgctagcctgggaagtttgcccatgctcttaaccagtaggccacatggcctctcaaggtttttcggagccttgaatgcccagctaaggactttgaaatttgcacttattcaatggataagcatttaaggattttcacgtataagacaaagcactatttgcaaacagatggagttgggtatagcttgtgaaggggcaggagaaggggcaagacaaatctgttctgccccaccagggaggcaaagtgaaattaaagatttggatttttcaagattttttaaagaagacatttttgaaacagagcccatccctcctttttcacagaggttatttccatagtccttttgggttgtacatatgttacatgagctggcagctctagagggaggagcctatctctaccatcagacaggggctttcagacaaaggccatgtaaccctgcaataatgggggtttcccaagagataattagcttgtggctctagacaagttgcttaacctccctatgcctcagtttctcatctgtatgatggggatgatatcagttcctactgactgttccctggccttgggctaagctgcctgggaaaaaggctagaaaggagtttgaactcctggcttctggtagctgcagtgggaccctagctggaaggtaggtgggaaggtgtctctctagtttgcagtaaggcttggaggaaggtctcagcatgacaagaagtgggactcctacctccagggaccccaagtcggagcagggtagggcatattaaatatcctctgcagagactttgatcaacagccatgacagggagggtttctgttctctttgaagcagcaaaaagatcaatcctccttcttatctcagcctctttgcacagtggcatcacgtgctcctgcaaccactgaggctgctactctctcaaagacgggaacagaggaggcaaagcccaacccagccctgtctcctccccgccgtctccctgcctccctgtacccctccatcccagggataaacagaatctgccactttctagccttcatttggcccagccccggaaggaaagaggaggaaaacaaaagaatacctatgcaccaggaaataagaccttccagggctccttcatcaaactagctaacctgggcactcctcttttcctcaaaatctggcttttaaaacatcgccttttgctgccatctaaagataaccaggataggaggcaggagactggattctagttacaggtattcctttgatttgctgtgtgactttaagtaagctgctgcccctctctggagcttaatttctcacctacgaagcaaagttgctgcatatgtttttcaggactcaatttaaaactctgtagtcaagaccaggctgtggccagggccagatttccatgtgtgttcaggttgtagaattgtctttctcagatcctctcacaaaggaattgcccccataaccttgacctcactgactccttcctatcttggccaaatgtttttctacacaatctattagtggaaagagctgcttggctagtggagcagcatcctgagtctgcaggctctgcccatgaggggcaggaacaattcccatcagtgctgcctccagcttggtcaaggactgaagacagcagaggagagggtttgcagggtcactctgcctttgaaaggctgggagaagaagagaatagggcacggggcaggatagggaggagttgaggtgggaataaggggtcgtgggagaaatgtcctggacctcctgcctctgggtgttgtgtgtttatgaccataccagcctggtgagtttgggtaggggtcaggggtttaccccatgcgagtatagcgcctccccatttcattgggtgaatgaaagtttcagacccagaggaagtaagatcctccacctgtctcctgccccctagaggaggtcccaaagacaaagggcaaaggccgcaagagtcctgctcctccaagccaacccagtgagctgatgctgcttccgggcatcaggctttggagagctcagtaataagcttcctgtatctggtctccaggatactgacaggtctactttctggccagatccaggccccagtcagagtctcccagggtgtagaggatggaatagctccagaaaagggaaaaaatgaggaatgaagtgagaaagaagtaattccagtctccctgcttctgcccaacactggaacgcaccaggccagatctgaacctcttctctgcctctaggactgagggtgtcagtgtagatctccatcctcctgcttttcctcccccagccccagcttcgtctgtctcttccatcactccaggcccctggggtctcctgctctgccctcatgaaccctgacccctaataagtccccagggtcagccctttgcccactgcccagccccctcggtggcccccagcttgggatctctccagggagaagggaatcatctgtgaattgctgccatgactggcaaggcccaggggtgccattcctggcatgctgcccaggcatttggacctacagggtaggtgtatttgtgtgtgtgcacaaatgttcacacttcagagagcaagttttccatagaagtgaggtgcccagattgatttcatgctgttttgggggaaacgtgtaagtgtgggcatgttgcagcatgatatagatgtgtttgtatgcacattacgcggggctatttgtgtttctgtggatctgaatatgttggaaagtgaatattgaagcatgtggtcctacattttgtgggggcttgtgtactcctgaatttcaggggtttcgtgtatagtttgcagagtgatatgtgtgcccatgggcaatgtgtgctaggtacctgtgagctcttgagtatctttgccactttccctttgcctggaggaacttcttgctggctcctgcctccctgcctcctctacattggagggagagctgggcccttggccaaatagcccatctgaggtcaagagtcagcagcaaacttagtgcccctgtggtccttgctgtctgacccatgtagcaaccgcaggcaagtgggggtgggggatgctgattgcagctggagaatcccaggagcaagcatcttgaggagttcaaggtcagccttcttgtgctctgaaacaaatgataacacaaaaaactgctgtttactgaatgcttgagtatactagatactagatactgtgaaaagcactttgcagacattatttaaaccacacaataattttacaaagcacccccttttacagataaggaaaatgagtctgggaaactaaatgacttaacctgggtcaaataacaagtaagttataagactaggatctgaacccaagtctgtttgactctaaaactcatgattctctctccctattctggtctacagattatgctagaaagaggggagagtggaggagctcctcttctccaaaacccacacttaccaaacagatctgtttggcttgttagaggtgagccttcatttcacagaaggacctcaactttatacccatagatttaagatctggaactccctgatggagagaatggaaaggagaggtgggcggaggaaaataaccagagaaggcctcctggagctgttggagagaaacatcgcaagctttggtgggggagggagttggatttacagaccttggtctgcccctggtgtcctggagcctagttgcttggtgtgtgaggttcccatggctcactcctgtggcttccctgggaagactgctgtgtggtcaccctcaggatgaggacgctggggaagcaactcatcaaggtgagacggtcagaggcaaccctgcacatgcacagctactctagtgcccactgggagactctgctcattctcttcactcccagatttaagttgcagggaaaatgcattattttttcattaaacatttattttggaatggatagccttcagagatgtaattagccatgttatttctctccattagcagtccctggcatttgctggagtttcttgtcctttttcctctccatttcactctttccatcatctttataatctaggttgcaatacttccccacccccacctccaaccagcaccacatagtctgtttttagactgaataactattttaaaacctggagagggagttatagcaaactcccccccctccccactgggctgtaggattacagtcccctgagccagctaggagctccacgatgcccaccactgccaacaggaagggggaggcagctccacgtgacactgtgacggcctggctagtggcaaagctaggcagagctaggaaggttgttggctccccatgttctggctggatgatcccaggtaagttacttaacctttctgagcttctgttgacttcatagtgttcaaggctggcactcacttaggtaaagcacttcaccggaggtatatagcaagtgcccagtaaaaggcagctgtggtggggaggtccacaggcaagagggagacttggggactaaatgaacaggagacatgggtagcaggaaaggcatagcctgggcttggtgagtccgagctacctgctttggtggtgacccaggagcctgggctgggggacaggtgacaggtagaaccatgaggaagacccctcacggagcaggactgggtggaaagagtagtcaggagctctgcctcagctgcccatggctgagtgtccctcttttgtccagagttgctcctatgggttatttctggaatgcaagagagctacctaggaggtgggctccccaagaccttagagatggcccaaagtgcagtaactccttagccctccaactaggttaggggatttctagggtgactgggctggttattgctctggggaatccaactaccttggtgctcagaagggagctgtctccaccactccccgtccctgctatcctcacgctagtgacacatgacgtgcagccatctccagcattgtcagaaatgccatgctccatggagttgagggcagaaagcctgaagccaaaaatctaaacttaccctggtcctccacaaagaggggtaaagagaaaagtgcagctttggcatggaagatccttggcattttgcaatgaaataaaatcagaatgcgtgtgatttctatcaagatctagagtgccgcagactgagacagtcatgggtaggtatcctttgaaggggttgatacttgttaacagggatacagttgcatggcatttcacaaagttgtgtcttgttgcattgacatgaagggaactggagtgaacctgctttttaatactggccttacctgcttttatagtaatcctggtcccctaggtccccagagacatgcagagaagtggaaattggctcagagggtctttgaacttgtacatggatgtcactacaagcctcatggaagcaggcagcattttgatgtgagtctagttcacagaagtaaattttcatagtgatttttgtggacaagtcctaggcattagtaataatactggcgatgctgaagataataataactaccacacattgggtgcctcctgcgctccagggccatgcttcaattaccttcagttctgtaaagcattaccatcctcatggcacatgtggagatgccgagactcgggcagggtagagaagattcgcactgtgtagaggacggcaaacagcacaacaatgcccgccaccaggagcagcagaaccaggatgtcagcccactccatggtttataggtgtcgccacgaaagacacgactcacacaggcactagatggaacaacactttactcacacagagaagagacagagtaagatcagctgcaatcatgggttcagtcccgcatggccaggggtctcctgctacagcagacacaaggtgacggtctgcacacacccctcttgtgcagcagcgggtggaccctgtttcctccccacctggaacagatataacagtggggttggccaggtgcctgccacatgacgcacaagcttaagcagaacaaagagtacacgctgagtctgaaacaggaaaaagatattcccacgtaaggcgataagcccagcacaagctatgagagctccttatctgttggtaaggaagtgtttttggctcaaggccacttgtatggggctgagcagaggttaaaaaaccacatgcatgagactgcctttctcaacctaggtcatatcattggtgtgcagcagagccaggatttgaaccgggtctttttggcaccaaagcctatgagctttctcattgatgagaggtcttccccaggccactccaagtctcctctccctcctcatgccagccacatcagctaatggacagccagattcagcagagaaaaatgaactgagtgggtttctccctccttggacttctttaatgcaaacacctaaaataatattttccctgaagaatcctcacgtatagaagtttaaagcagaaagctggattcccatcagagatgagaaaatgcataacagaaaagcaatatatgggaaaccaaggcacttgggcaattatgtaaataaatggacatggtaaggatcattcagccctggaaaaaaatggacacatgtaattccctttcagaatctgaaaaaagaagaaagagggatggaataaaagccctttttgcttccgttacagagtcctgcagttctgtttgaatattaagcctccatgtggttgctatggggcttttgtaatatgactaaactgtattggctcatttggggaagggttatcacctacaattcacagataggatgccagaggttaaaagaagttcagtagttgatctatgttcaccatgttcgttttagaagccaggttgaattgagccctcagatgtttccaattcccgacctgatcctcatcttctcaaggaacaattgcagtgaatcctcagttgcctacgtggttaatgtggaagaacagagacatagataatcctaaatgatgtctatgtctcttgctctaaacatttgctttggaaacttcttgcagaccttagaatgaagccaccctaatgtgcaaggggccccatccttactccacaccttccctactcaacgttgcccacctcccactccatgaagacctaggggcagtagatcaaagggaagaggctcttaactctctcctaggttgagctagggtagtgggtagaggagagaggccgataataaggcattttgatttaaaaggccttctgcagtgccgcaggcaagcagaacagaaacagtaaatgagacaatgaattgtgtccgtggaagactccatatggacagtgattcattatgttaataaggaggtgaaagccagaggttgactgtattctgatttcatgtctggggaatctgtagctcagaagcggggagcatccaaatttgaggtcagagtccaaattccaacacccagctcctgattccaatttggttggtcgaattactatcatctcctaatgactaaggatgctttagagccagatgggacctgagtagaagtgcaagcaatgcttaaggtggagaagagtgatgctggagccaagcagagccaactccttgggtccatgcaacaaatattgagcacctaccaagtgccaagtgatggcagaactggcattgggagagggaaccacagaggaatctgatgttgaccctggcctaaaggaactcagggtaggaggtgatatggggcaggcacaaatctctgtcatacatacagagagggaagtgagatgaggtctaagacagcttcatttattctcccattcaattaaatcattaactcagctactcaggcacgatcgtaagtgctccaaataaaaagctaaacaaaactgatctccaccccagaagctaccattccaatgctgaagctaagtcaccccaggaggcatatcaaaacacattccccagccccccaggccccagcactgacatactgattctgaatctttataactggtacccaagacatctgaagcctggtttctagttattctccaactttgggcactggtctggtggaatagggagggagtccagctaagagagtccagaggaagagtcagagatagagagcaaggcttcatggcccacctctccctggaagccctccttgaccagcacagcccacactgatccccatgtcctctgaatccaacctccactgcgtgttctgcagttttgcatttttctgtttgttgttgttttttgtttttctttctttcttttcttttctttcctttttttttttttttccaaaactagcaggtttaatccctcttctcctgcttgtgtctcatctctaaaggtgggtgttcccgtgttccaggtcattgtgatgagagttccaggggacttgtgacacactgctggccggctctgttcaagtgtgggaggtcaggagcagccagttcctcctgggaatgcaacccatctccgaaaaggattaagcatcactagggctccaagtgagttctgatcagaggctgttcggaagacagcaggggccatgaccaccctctctcctgaaaacagcctctctgccagacagtcagcctccttcatcctggtgcgtgttctttgtcagctctgagtgcctccctccccagcctctggttggcactgggaccattttcccctgctgggtaggaaaagctagaaccctgagctaacatagaaggtggagcaagggcggttgtaccttactcttaccatcagcccaaggacaggactgagacatccaagccccctttcaccttctttccaagccagcaaaaccttctccacatatgtgctattctaactttattgagttgtaggtttgcaggtgcgaacctgaagatgctgatagattttcatcggtgctttttgccaacaattttggtatactgccaccaggtggcagtaatgcttttgttagtaggtagttctaaacccagtttacaagatacagctatttgttagaagtcggcttcagtcataaaaattttccacacggtattttttcaaaatcataactaattacaataactttagccaatcttaagtctcattaatcatagtgattaagagagtgatacataaaaatgcaaaatggacactcctctccctgagttttaaatgttactgctttatggcaaattatcaccaggccttgctttaaattttctttatatctttctcatttctctgagcttagagaaggctaataaaataaactgtcacatagcatttattatgtacgatgaatgttctaaatgctttatttatagtcattcattctcatcacaactctatgaagtgaataatgctgttgtcttccttttataaatgagaacatggagccacagagactttgtcacttgcctacagtcacacagcttgttaagtggcagaagttgtatttcgacccagacaggtggggtgcaaaactcagtattctcaaagtgtggcatccaaacctgcagcattagcaccaactgggaacttgtaagaatgcagactcttgggccccagatcttctgaaccaataaactggagacgaagcccagagatctgtgttttttgtaactcatccctccagggcactgtgatgcacaattagctttgtgaaccactgttttaaaccattttcttcatcacggtgctgtactgatgatacaccctccacacctgggttggtaataattgctgaagtgggaaccccttgttacggttgggagtctatcttgtcctcaggtgaactggagtagaaaagagaacctgtccaggtgcagtggctcacgcctgtaatcccagcactttgggaggccgaagcgggcagatcacctgaggtcgcgagttcaagaccagcctggccaatatggcaaaaccctgtctctactaaaaaatacaaaaaattagccaggcgtggtagtgagtccctgtaatcccagctacttaagagactgaggcaggagaatcacttgaaccagggaggtggaggttgcagtgagctgagattgcgccactgcactccagcctgggcgacagagtgagactccatcaaaaaaaaaaaaaaagaagaagaagaagaagaaagaaggaaggaaggagggaaggagggaagaagggaaggaaggaagggagggagggagggagggagggaagcttaagcaaagtcaatgaccttccctgggctttattggaggttctgtggctatgagtattcagagaaacttggcattaaaaccctcataaaaagtttttcttgtcctccaaaggctttctttttttactgaaaatatgggagaaaacccctaacccaatgatgcagtggggagaggagatttatgcctgaagccaaggcctctagcagcaggaaacttttagagggactgagccacttagggctcccacttctggtccccttccccaggggaagaatggccaaggcttcctcaggtttgctgatgtagaactttaacctgcctagatacaccctgaaggtgggagatttccatagctgctctatctagcagtacgcttcccaggacactaggaaaggcaccactgcagagctggagggtatccagccccctcgcaaactgcagacttcccctcccggattaccaggtcattatacccagtgtatggaaaagggtgttattaggttggttgagcaaagaacagaggaatatgggaagatgaaggttgatttgagaagccactgtgttgacaatctccgtcacattaaaggagcccagatacacattctctgatttctagcataggcaggtaggtggtgtgcatgtagagagagggcttctaagtgacatttccccctttgccttctgcgggtcaacagccttcttgttctggtccttggcttgctagcaagtgtctgagatagtcttgtgggtggcctatagtttgctgaagtttggagagatacagggaactggtgggtgtagagaaatggagtttcctagaaggaagaatcagtgactttttttgtgggttttttttttttttttttttttttttttttttttttttttttttttgagacggagtcttgctctgtcacccaggctggagtgcagtggtgcgatctcagctcactgcaagctccgcctcctgggttcacgtcattctcctgcctcagcctcccaagtagctgggaccacaggtgcccactacaacacccgggtaatttttgtttttttttttttgtattttttttagtagagaaggggtttcaccatgttggtcaggatggtctcgatctcttgacctcgtgatccacccgcctcggcctcccaaagtgctgggattacaggcgtgagccaccgcgcccggccgaagcagtgactttttataaacaaattcaaccacggcaaagtaggcagatggccaattgttacaggtagaggtttagaaatgcaaattctctgaatactcaacagatgtcttcttgtgatgtttctaattatttctgccttattgcgttgatgctgtatcttttgttacggtgtgcggtgcatattactttaatttcaatattacctctccattgtgtttgactttttttcgtatctttgttcgtcatttattttttaatcattgtagggcatttgattttaaggtatttcttttgttcacagcttgtgtaagatacatattttttatttgagtggaaaatccttgccttttaattccttcccactgcccctcccacccccagcatggcattagggttaagcctctgactgttgcatcaaacagcttagggttcaaactccagctctgatactttctgtatctaatctcagatatgctaattaaccctcctgtggtctcagttccctgatctgtaaaacagtacaagaactttaccacttcatagatatttgcgaagattaaatgggttgatatatgtaaagtgcttagaacagtgtctggcacatcatcaattgctttttaatgtttacagctaataagagaatgaaatgcatttattttcataattaattgctttgggtttctatcatttttatgctttatacttttattaattccttgttgtttcctatattgcttgcttttattttttaaagtgagttggaagatgtcctgttcctataaattcctaatttttaaagtaaaaaataaagcaatttcttttgactccatcctaatatctaataaagaaatagaatctgcaattaaaaactttcccacaaagaaaactttagcccagatggcttcactggttctaccaaatattttaaaaagaaataataccaattctatacaaacacttccagaaaactaaaaaaaaaaaaaaaaaaaaaaaaaaaaaaaaaaaagaaatccctactcattttatgaggccaacattaccctgataccaaaattagagatcttacaagaaaagaaactcacaggcaaatgattcttgtgaacatggatgcaaaaattctaaataaaattttagcaaatagaatacaacaatgtataaaaagcatagtatatcatcaccaagtggggcttatcccaggaatgtgaggcttacttaccattcaaaagtactcaatataatttaccatactaacaaactcaaaaaaagaaaaccatatgaccatttcaacagatgcagaacattatttgacaaaatccaacatccattcctaattaaaaactctcagcatgctagaactggaagggactgtcttcaacctgataaaaggcatctgtagaaagcctagagttcacatcatactgaactgtgaaagcctgaatgctgctcctctaagatgaggaacaaagcaagaatgtcttctctcaccacgtttattcaacattgcacttgagttctagccagtgcagtaaaacaagaaaaaataaataaaaggtattcatacttgaaaggaagaagttaaactgcctttactcacagatgaacatgctcatctatgtcagagttggcaaattttttctgcaaaggtcacaatagaatttttggctttatgtccacgcagtctctgttgcaactactcaactctgccatcatagcatgaaaacagccacagacaaaaatgagtgggtgtggctgtatcctaataaaactttatttagaaaaacagattggaggccacatttgatccatggatcataatttgctgacccctggtctatgtcaaaaatcccatggaatccacaagaaagccactacgactactaagtgagttttactaggttgcaggaatacaagattgatatatagaagtacattgtatttctattagaaatttaaattttaaaatgatactttttacagtagcatctgaaatatgaaatacttatggataaacttgacaaaatatatgaatgacctagacactgaaaactacaagacactgctgagagaaattttaaaagacctacataaacagagaaatatattgtgttcacaggtcagaggactcaataatgtcatcaattctcccaaactggcttacagattcaatacagtctccaccaaaatcacagctgcctttattatagaaatggacaaattgactaaaatccttatggaaatgcatttctaaagttaaagcatttccttttatagttaaggatcccgggacacagcccagctttgcctgttcccttctgcttcctgccacattgcatgctgagtgttgcagtttctgaatgagtgtaggttgggagaacatgatgacaatcagaggggcagaaagcttgctctgatgagtggcagtgtctatgcaggtggggaacacatcagggcagaccctgcttcccagggttaggcccacaccgagatttgtaacttcttggcccatgtgtcctattttggttcagatgacagggcatacatgagttattaaaaatgtgtttctcaatccatttccatcaaatatacagttagtagaaattatcccaatttggagcctgtaggctcttatttttagttaacaatgctgctttgccttcatttatttatttatctatttatttgagaaggagccttgctctgtcacccaggctggagtgcagtgccatgatcttggctcactgcaatctccgcctcccaggttcaagcgattcttctgcttcagcctcctgagtagctgggattacaggcaccccgccaccacacccagctaatttttgttttttgtttttttttagtagatatggggttttatcatgttggccaggctggtctcgaactcctgacctcaagtgatctgccagcttgggccttccaaagtgctgggattacaggcgtgagccaccatgcctggcctgttttgccttctaatactttactactcatgtggtttgtggactagcagcatcacctgttactcaggagcttgttagaaatgcatcatcttgggccccaccccaaaccctctgaatcaactctgcacctgcagaagatccttaagtgatttgtacgccaatttaattttgagtcacatattcagatgtatactaatgggaagttgggagtgtgtatatttacatgtctactcagctctgtccatcagcacatctttatgtctgcaatgtggcatttcaagatattcttctctccagcagaagagagtatcccaggaagaaaggaatcttctcttattccaacaggaaccctcactcctgttgttgttgttgttgttgttgttgttgttagagatattattattattatgtgctctgttgcccaggctggagtgcagtggtgagatctcggctgactgcaacctctgcctaccgggttcacgtagttctcctgcctcagcctccagagtagctgggattaccggcatgcgccaccatgcctagctaatttttgtatttttagtagagacagggtttcaccatgttgccccaggctggtctcgaactgacctcaagtgatccacctgccttggcctcccaaagtgctgggattacaagcatgagccactgcacctgaccctagttattattttataagcattttgaattactttgcatgcagtgcactcacctctctccaacacatacacacacacatgttcacatacacatagcacacagatatataccacacacacacacacacacacacacccttatcaaaagcagagactatctctcataatgaaccattctacatttccaggaaaggtaaagtggagctcataactgtgtctaattaatgcttattttatattttcctgtgatcaaagcagtgtacattattatagaaaattttaaaaatacaagaaaggccaggtgcggtgactaacgcctgtagtcccagcactttgggaggctgaggcaggtggatcacctgaggccaagagatcaagaccatcctggccgacatggtgaaaccccctctctactaaaaatacaaaaattagttgggtgtggtggcgcgtgcctatagtcccagctactcaggaagctgaagcaggagaatcgcttgaacctgggaggcagaggttgcagtgagccgagatccaccactgcactccagcctggcgacagagtgagactccgtctcgaaaaataaaaaatacaagaaaaaggataaaaagtacttatttcctatcactcagagataatcactgctgtttttagtgggggagaggaacttttttgtattttctcagtctttttctaacaactttatagtagtcaatgcattatatattagagtttatgtggggtattattataatatataacggacacaatacataggtattactatgagggccatagttgtactatatagtacatagagaaaatgctagatatacaattctgtattctgcttttttctgttaacatttgtattttttctgattattattcattccttgtaaacaacacttatatgcctcaaaatattccattaagcacataaaccacagtttacttaactacccccttattgcagaacatttagagtgcttgcatttttcatgttggtgagtaatgtgcatgaaaattattgtgcatacaggattttttctatatattttcagtaatgtcctcaagatagatttccgaagtaagtcaggctgtgcgctttgatacatattgcaaagtccagaacatattatttaaaatcacacttaaaagccgaagccttctaacataaggcagaactggttgctgcttttgccaggtgaagagaaaaccacccattgacaagacagaatgggacagcttctttgatgagagtggccacttggccaaatcacgggacttcatttgtgttaacatcctggaaagggtgggtccccaagctacccttggccttgccctggaactgggagcatggatgggcagggggcaggtgtggcgttggatgaagcccttttggtaggcatcgatagagcccatgacctccacctcccacccccaccccagggtctgcaccccttcgtgaggactgaagcctggaaattcctcacgggctacttctcatggcagagttcccaggatgagcggctcacggtggacagcatgaggaggtagaacactccagaccctgctgggacaggaggggggcctgcaggtggcaggtgctgcctccccagcctgcagactatcttctgcccccatgcaacttcttattccgagaggaaccccatgcctcctgacccaggcacagcacacaggaggtgcggccagttcgtgccagtgccttctctccctgagctccatttaccagcccatcaactgccaggcatgggcttggtcccagccactcctcttacccctgggccccaagtcccatccttccttatggcctatgcattcttcctctgaagcagcccttgaacagagtctgccaccctcttccctgggtgccaccccaactccacctcctccctgccccccatggctgagctgcctcccgggtctagtctccccactccctgcctgtgcccactgtttcctcccggtgcccaggggaaggtacaaaacccagtatgggctgcctgtgtccttagatgaaacactcccagtggtgtaactggtaacgtttcaaatagcacatcttctcttccaaaaacttcctgatcctagctccacatcgcccactatcccagagcctgacattccaaccacactgacagcctcactgactcctcatctgcccactcctgccccagcacagaccacgtttgcactcccctctgtccttggttcaccctttctcctccctccacaatggctttctatcatctgcctatcagtagcccacccttccttcaaggcccagatcccacagtatacctactccaagcagccctcccagatctcccaagggagccagggatgaggcactttgtttcagtagataacacaccatctttgaacttggaccgtcttggatttggaaaccgggttcaaatttcagcactctgatttacaccctgggtaaacttgcccatgaacttcagtgctgaagtctcagtctcctcctctataaaatgcaggtaacaatctatttcacagagtggttgtgggggctcaatcagataatacaggtaaggcaccttgcacaggggaggaatcagtagcttttatgattttgatgggaatcctccctccctgaagccggaggcccttgacttgcacttccatgaccctgggcacttggtcccacagtagtgagaacggagcctgtgtcttccctcccaggttgaatgcaaacaagggcagaggctgcagccagtttgcctttgtcttgggccctctcctgaccttgcctgtccatgggagggctccgtacacactggctgagtcagactgactccactgctgaaaatcttcccatcagaggaacggactcctttggattgtggctgcatgactatgtagcctgggctggactcacctgtctgggagcctgaagcaggggctaggcccagccccaagggagcatccagacagaatgtggaaaagattcacgtgtcggggccagccagagtgacccggggtgggacgggggtgtgagggctgggctagggagctcagagaggttcaggagctctgacaagagcccacctgtgttcatttcctgaggctgccttagcaagtaccacaaactgggtggcttccgacaacagaaacctgtcttctcgcagttctggagccagaagcccaaaatcaaggtgttggctccttccaaaggctctagggtagaacccttccttacctcccagcttgtgtggctcccggtgttcctcagctggtggctgcctcactccattccctgtccccatggtggtgagaccttctgctttctgtgtgttataagaacacatgtcattggatttggggtccacctggaaagtcttacggatctcgtccggagatccttgacttagtcacatctacaaagactcttttcccccacatggttacattcacaggtcctaggggttaggacatggatatgtctttttggaggccaccatgcggccagcaataccaactaatcatattctaataatgaggacaaaacaccgcctcactcagcacttccaattctgaggcacaggtgccagtattatgcccattctacagatggggaaactgaggcttagagatggaaagtcgtgtccccaagacttgcccccagtggcagacaccccgttattaagatgtagagccaggattcaggtgcagcgtttggagtacagagcccaagaagttaaactgtctctgttctgcagtccaggtgcatgttggaggacagttagggtggcacaggttgagatgagggacagcatcacaggtagggtgcatggctgggtgagggtgctgccctggatctgcctggggcctggtagctgcagctgctcattcaccacttatcagaaggggaaaagccaccttgttcagcctcagttctgttctcacaggaagaactacaaggccttatgccaaatgtatgagaagattcagccccttctggaaaacctgcaccggaacttcacagagactcgcaataacattggtgagcaaagtggggtggagagggctgggcagagggagggcttgaagccaaccctgcccccttctcagccacttccagggagggatggctccaggatcctgggagttgctttgacttgtgcctggagtttcgccagctgaaccttggttaatccaccccaccagtctctcctgggtggccctagatgccccataccatgttttcctgggtgcatgatgttcctgctgcctggtcttcctctctcctttctttggctttgaatgaggttggatttgaactggacagagaggaagggtgggggaggacattcctggccgagggtacggcctcgttagagggttggaggtgggaagaaacacagacagctcaaggtgtggtgaggaactgagcctggcaggggctgatgtacctttcacagctccctctccctccaggatgtcctagggcctgcccattggggtaggggaagaaattcacccatagacctgctggatgtgatctggtgccacctacttgccccttgcttccaacctagcacgtgacattcagaaaatctatgacaaagatcccctgggcaacgtcctcatcgacaagaagaggctagagaagatcctgctcctgagttacgtctgcaacacgcaggcaggtgagcctcagcctccccttgtcaatgccctcccaggacctggcccaacctaagccaagggtccaggctctcccacccagcccctcctccccaaccccctcttcgccacagagtaccagcagggcttccatgagatgatgatgctcttccagctgatggtggagcacgaccacgagaccttctggcttttccagttcttcctgcagaaaacggtgagggcaaggcctgagctcagggacgcccctccccaaccccccactactccccaaacaactctttgaggatgggcaggcattggccaccccagccattccttccaggcttctgggtctcagaggagcctgggagggtgacgctaaacccagtggttcaaagtagtggtggtggggaggcactgaagtggagaagggggatggagcaaagctctgggtccacctctcaacaaaccttgaaagagcatggctggccaggcccagggaaggtgccctctcctggcattttcttccccaagcacggttctcctccctcctcgctgcttcttcctcaatggctccctgtggcctccagaataaaatccaataaccttagccagtcattcagggctgttcccttcacataacctgaattccaggcacaccaggggactcaatagtccccaggggctccctcactgtccaagttgaggggttttgaaggtgcagctccctggaacacctccctggaaagcctttcctcatgatctgcgagaggctgcccagaaccctccctcatccctccctccaccccaccatccctgcacatgtgcttgctgcccttcccttgtcccagttggctctgccccaacactattgtgtgagggaagaactgggcaactgggctcactagactgtgagccacagttgagaatctctactacacacacatacacacacacacacacacacacacactacacagccacccagaggcgtacaacatatacagacaaacttgcatacacagatcacagtcacatagatatgtatgcacacactcacacacacacactcagactcatagagacatgggcccagcgcacagacagacacacagagcctccagaagtgaagctgggggaagcagagttgactcttccggtgccttgaagccaagggggactcagtctgtctcccaccatcgtgtgcaggaacacagctgtgtcatcaacattggcgtggccaagaacctagacatgctcagcaccctgatcaccttcctggaccccgtgtttgctgagcacctaagtgagtggttcccacctcctgccacctcacgcaccccccaggcatgggaagggggctgggacccaactgtcagtccctaatcatgggggggctggagagcagcagaatcatttgattgcttctccaggccctgggaagagggttatctggatggggttggagcctggacagttgaaagttgactctaaaccatctcccagggcagctggaaaaggggcggcaggctttttgtatttcccaagtgttttgcaggctctgtagtttggcctcatctgcatgtgtttgctgcatcatatgtgttttcccctgaccacagcctcaccttctctccccacagaagggaagggtgcaggggctgtgcagtccctcttcccctggttctgcttctgcttccagcgtgccttcaagtccttcgatgatgtctggaggctctgggaggtgaggtgtccagctagggatcatcaggctgggctccacccatcaggcagagtggaagctgcaagtcttccttgcctccccctttcttcctggcttggatggagttcagtatctcggggttttgttaggtcagcaaccctgctcccaccttgctggaggaagctggagcatcactttgtccatatgttcatttaacacaaaggccccactgactgtgccttctgctagcagttgacacaggagggccctatggcctgtgcagtgggagcctgggcctgcagctccacttccccgctgccctgcccaggtggcctccccacgctttcacttccccagctgtccccccaaccctggccttccccttccccagagtgctgctcctgtggaactctctcacagaaggtgggtccctaaggacacctgtagtcctgtgaccacaatcctcagggccatcagcagatgaaccctctgaggaatgccacccccacccatcaatgccctgcccatggccaccgctgcctgcagtgtccagcccaaccatccacctggcatgtagggccccacagatctattcccacctgcctcttggctggctggtctccatgcccaagtccatgaccacacccaggcctttggtgacatccttgggtcatttaattcccatcaacccttgcttgccaaaaccccactcaaattcgacagtttcctagtgtcttcccacccctcattgcctccctccccttcctctatctaatgaattccctgaagcctctatctctgaaacccccaggagacagcacaatgcctagaaccaggagtacctgtgagcacatgcctgagtgagtggatgagtgagtgagtgaatgaaggaatgattgaatgagcaagtcagcagcaaggcccaggaatggctgactccaggcacgtggttggtgggtacctcaccatcctcagggcatctgcagtctcagaccacagggcccagactgagacgtcctgacccacaggttctgctgacggggaagccctgcaggaacttccaggtgctggtggcctacagcatgctgcagatggtgcgggagcaggtgctgcaggaaagcatgggcggggatgacatcctcctggtgagagcaccctcgggcaagctaccacccctgctcctggaggccctgacaccccaccccaccccagctgaaagaccggggttcatggggtgctgggcaccagtgccaccttttccccccagacagaaagggcaatgagatctaaggtacggattaccgtgccaagggcttttaatagagcttgtttaagcctcaccacaagcttgacacagggaggctataaccatcatcatcacccctagttaacacatgaggaaatggaggccttgaacactccctaactattaagctctaccatctcgcagttaaccctgtggccctaggatattgctgaaacagaaggacctagagttttccaccattttaaaaaagctactgaagtctttgttggaagaaacaaatcttaggtgacaccctaattataaaccaagtcctccttcaaagcccctaagacacttggtggagccccaggactcctagagcctaacatgaaagctaacatttaccattgccccaaaatatcaaattttaggcattgagccaagcaggctggggagaggtcaggtggtccccagcgactgctgtgagcagcatccttcttccctgggtgctgcaggcagctgcatgtgcccaagagtgctgggagatgtttgccccagccccacccacaactgctcccacactcccatgcaggcctgcaacaacctcatcgaccttgatgctgatgagctgatctctgccgcctgcgtggtttatgctgagctcatccagaaggatgtaagttgccccaatgatgtgtcctcctcctcctcttcctcctcctcctcttcctcctcctcctcctcttcctcctcctcctcctcctcctcttcttcctcctcctcctcttcttcctcctcctcttcttcttcctcctcctcttcttcctcctcctcttcctcctcctcctcttcctcctcgtactcctcctcttcttccttctcctcctcctcttcttcctcctcctcctcctcctcatcagagcctatcctgatctcccaaacgcagcccatggcaggtgcattcaacttcagagacacagactgtgccacgttctctaccactgacccatgcatgttgctcctcatggtcttctcgttgtttgcacatgtagctccttcctccctgagcaggctgtactacttgagagcagggccctcatcccccattccctgtgtccatcccagtgggtctgggcacccagaggctcaggagaatgtcgctgcttagaagaaccgaagaatgaaagggacagaccaatgtctgtgcacctcccacctgcctcctccctaggttcctcagacattaaaggatttcttcctctgaggacaccaaagcccgcagtggactgatgccttcgatgggcaggatgaaggccaggggcactggagtgagggagtagataaaacagctgcaatataaacagtcctctggaataatggtttgtggtggatgctatgtctttgaccttaggggctgggacgcacatgagggctgagacagggtcgtacgataggaagagaggctggctggctgagagacacattctgagactagggagggtgcttgctggaagagactgggtcagtggctcctccttgatggagggttttccaaggctgcggtggatccatatctggatacaaatggttagagtagaaccagctctgaaaggcttccagacccctgtggaggacaaaactgagcacatttaataaggattagttcatctggacttaggtcctgagaggaaggctggtcctggggctctgcccccacccccactgctcccctgagtcctgtcacatcaatcacacaattaagtcattttttccagagatttcctgctagtctgtggaaggggctggcctggaagaactatctgatgagcaggcaattcccttcctggtttcaaagcctccctcataattgtgccttcatttatcagcctgcaaatgtgtcctcaagctacattttattttccagtcttgatcaatctttcttgagaatgcactctttgcccttggccaggcagtcagttgctctgtgaggaaaaggtgcatcacacctgctcccccaggctgtgccacagccctgagcccctgtccagcctgccccatgctctagctggcccctctgagggaagacatgtagatgggccagaaaggctgaaactgcagaagggttggggctggctgggtgcccccagagctgctcagcaacacacatacatacacacatacacacacacacgaatgcacacacatacacactgccctgcccagtgactacaagttttcaggagggctgacattacacatgggcaggagggatcccttgcttttgctgtgaactggtccttagaggtaaggcatggccatccctctcactcttcagccaactgtccctccctctgctcccatcctggcactcttagtgaccatcactccaaagccattatgtccccaatgagtgcttggtctccttcccctcaggcgacagtctcccatccaggaccagctctgagtctcttagctgctgtatctttgctggaaggttgagggggaatgctgaagaatgagggcctgtccccccagcaacaccttctctgcatggctaaagagctcatgtttgctgggcagggaggcacatgggtcaattcatatactacacttctcctttgcttttatgttcctaaggcagtttatttaaataagtgttcccgcatgaaagacagttctccaaggatgaaactgtgtttgcattttgccagagaggcagagaacaagagtaaaagacatcttgctgagctagttttggccttgggaagagaacaatcaatagaaacatcagatgaacattttctaatgcttcttttagactggtgacttcagatggccgattatttttggttgggacctacacacaatgccaaacatctatttcaaaacaaacatttaagaactcatcttctagaccacttgctgtcaaatctgttgttaaaagcactggagcccctttattacacagtccttcccaggagcccagcggatgaagtttgggtgcagatcccagagccctctcccccgaccacccctctcaagcccccctccttgaacctcacatcatttcctgtgttatctgcaaggagcctcttgtctactagggtgcatatttgaaaacctgttaggtcttaaggacgaggtggattcaatcttgacaccaaattgatccagattcagataaatcccaggtgatggagtgatgaaagtaacaatcttggaagagtggagcttctctcagctcatctgcagtactcccagcccagcagactgtagattaggatcttcccaccatgctgctatgcaggtccttaaaaataacactgggctgtataattcattcatttattcccccttctctggctcacttagtttatcatttatacagcccagtgttgtttttctctagtagggtccattctggagatagaactacaggaagcattgaaatcctagagcctaagtttgtgttatgacagtctagtttatttcagcatgcatttattcagtactgtcttagaccatttggactgctctaatgatggcagtggcagcccatctggagcagccactgccatgatgccagctgcagtgggggaggcgcagtgagggctgcatgctccatggagccagtgggagccagaaacaggcaggagccccgcccccttccaagttggaggggtgggagccccaccctccctggcacagctgcagccaccctgccatggctgtggacccaggcatctctgcactcttgggggcccttgaaacccccatgccctcacaggctcagaactgcctgctcccactgcctggcctctccccactcctggtgcccactctgatttcggagcaaagctgtggctgagaccaggtgctgtcacaacccggccaggtgtgctcacacctggggcagcacttacacaccagccccatgccttcttggcccccctctggactttgggcaccgacaagcatggaagagaggctgagggggtgggtgctaaggatggctcggcatgggccttcaggcacccctcatcatgaacagcctgggcaccgtggatggcaggttaatgacagcaggaggcaggcagatcctgggtggaaaggggcagatcctggtgaaccccaccttcaggccagggacagtctgaggactaggggccaggctgccagttccacagactggagtgacaacctatggggctttttctgggtctgcccatggccacccatggacaaatcagcatgcacttcctcccctctgaagcccataaaaatccccagactcagccagcctcaggcagactaccggatgacctgtctgtggagaggagctactcagggcgggtctcctccgagctgttctgttgctcaataaagcaactctttgccttgctcaccctccacttgtccacatacctcattcttcctggatgtgggacaaaacttgagacccaccgaatggcagggttgaaagagctataacacaaagagggctgaaacccaccccttgcttgccatgttgcaggtgacaggaaggagagaagagaggagagaagagctatagccttttggggatcccagacctaggagctccccaagccagggctgtgacatcgtctttggggctctgtggttcttggtgtctccaagcttccatgcaccgctgcgttcccttgtgccagccatggatgctgtttgtggtactcctggtccagctgcagccagcacccataccagcatctggagctgcccctcccaccacagctggcatgcttggctgtctgtgtgcagtggccagaccccacactcattcgttcacacacacttcaacactccatgtctggctctcccttggcaagtgtgggctccaggccaatagtgcgagccgaatgcctgccaggctgagtgggcaaacaagcccagtaggcccgagcaaaactcaggcaaaggcgtcactgtccacacaggtttcaagctggaaaggaatacctcaagaattccatgacaataacacaataatgtcagtgatgatggcggtgatggtgatggtgatgtcggcgacgtcagtgatggtggtagtaatgtcagtgatggtggtgaagctaattatatggcggtgttggtggcagaggtgtgatgtcatttatgatggtggaggtggtagtgatggtgacatcagtggcagaggtgatatagaatctggtggtggtaatgatgtcatcactggtggtggtgatgatagtgctgacttttcattctgccaacaaaaactgactgtctctaatggtactccttaaatagtgccagaggaaaagatgagattcaaggaagggactgaaggggattgcagtggggagggctctgatattgatgatggtgttggtggtgagggcaatcatggtggagatgaaaacagtgactaattcattctgaaaaaactagtgcccagcacacttccaatgagcaaggcctagacataatatctttaaatgaatcaccgtggccatgagcataaagaaaatggaagcagccaggccccatccaagctttccaaaacttggtcctgagccagatatgaaagcttggattggattggctgcatttcttccaagctctcaccctcacctctctttcactcttcttctaagcctcttccctggagaattcattcatttattccttcttctctggctacattgaatgaccccaaggccactttttgttcctggagttaggataatagctctctacccactaacaactgcacagaggcaccgtggataaaactccaagttctctgggccccagggtctgtgttacccccctcagagaggaagaaagaaggtgggcttttgcacctaccctcaggcttgccagcagaaccgagtcctggcctgaagccaccagacctttggtcagtggggaggaagggatactccctcctttcaggaggaagaacatagctactaggaagggcctccactgcccaggacccaaccccaaaggacagctggtgggctggagcttcaggaggtcacgaacaagggcacgtgacccctaccctcacaattatacagaagctgtactaattgggtaattaatatgttccacgccttgtgctaagcactcgcatgctttatctaacagaatcagaattctgattctgatttcaccctcatgactgaattcaaactcagaaacaggtgcagtcattaccctctcattaccagcgaggaacctgaggcactgggttacacagctagtgatttgccaagtccggatgtgaatgctgatgggcgaaccccagggccccactgttatgccatggtattggctcttgggcagcttccgttttcacctctttccctgcccacagcctcacttggcgtctgccatcctcccgcagcccacactgagtctcctgtctggtcctctgcagagcaggccctcatctcacaggccaccccacccttggcagctgaagccccaccgatgggccgagatggtccagggctggatgacaggggtggtgtgtgcaggaagctctgtcctacttccctcgtccctctctatgccttcgattaccccagtaagtgtgggagggcccagatgcagccatgtttactgcatcttgttttgaaacaaagctctgaacattccttgtgcattccttctccaggatggggagtgggctgggggtctggggttgcaggaagtcagtctgcaggggtgagtgtggggacccaagatggggctggcaggtcccgcatggaagcagcagcagcaaagcctgggcagctggggtgggccaagtgttgtgaggggagaggcgcgcagctctgggagacagggtggaggagggctgtgcaggagtagcctctctttcctatccctgcccctgccgacctttctctggaccagcccccatggcagagaccccctggatggaacaagaccaaggcagagaggagggaatttccagttggtgccaagtgccatcagccacactgctcaagagggaaaaggacttatttctgggacctcaaacaaaagcactagctccactgtcctgccagaccctggtgctcgctgagcttgtagtggggaagagattcacaaccagaaatgaaggaggctggtggcaggcacgggagggcggagtcacaagcaatagcatttagtctgggtgcacattagaatcaccaagggagctttttaaaaataaccaattcccagggcccaccaattaaaccagcatatctaggggtggggccagggcactggtctttttcaaaagctcccaggtggttctaaagtacggtcaggaatgagaacacctgagttcagaacaggagtttaatgaagggggattagtgatcagctggtttgactccttccttccacttagagggagttcaaggaagtcctcacagtgagtgattacggaccagagaggacaggagtgactgtgcagggcactgtccaggagcagagcttgtctccgcagtcgatctcctgttactctccttcctggaccacaccaatggctgccctctttccaggagctctggaatagacctccctaccctcccatcttagagcccttcagctgactgactctagaattaagcattccaagttctattctgagccggcacataaaagaatttctttagggagttagtaagagccaaagtctcaaaagtctgaccctcacctgcagtgatatgcaaattgtacccgaacaccggtagtgcagcattcagaggctgggagcaaataggatgcaaatgtatgcaatcattatgcaaacaagggcagcccagattaatggcctcaatctttcaactagacagcagctgtctctttacgtacgggcatggctgacatagaggactgaattgtctcctgtcagaagcatcctgaggaagggtcagctctcaggtcaagaggagggattgttcggacacctggcttgccgatgctctgctctgagaaatctgcgcaaagatgtctgtcagccaggcaggatattcttctctgcccgggctcctcactcaagtcccaggaacaatgctaggcactgaactttgtggggagagtagtggtgatagggatgatggaggtggtggaggtcatgggagaggtaatggtggaagtgatagagttggaaatagttgagaagacggcagaggtggaggtgagggtgatgaagttcctggtaatgatagtgacatgaacaacagagataatggcgacaacagaggtgaaaatgggcttggaggagatgagagccatggcggtagtgaggacaaatataatggaggtactggtagtggcagcagtggtgacagcgatagtggaggtgatactggatgtgattctgcagatgaagtggagatgacagaggtcatgttagtggcagtcatagtggagaggatggcaatgccgaggtgaggggtggaagtcatggcgaggaggaaaatagtgacgctgccatcacaaaggatagaaatgatgacaatggcaggtcgtggtggtaatggtgaagatcaaggtggcggctcaagtgctagaggccatggtagagtggtgggggcaatgaaggtcattgtagtgaccagtatgagatgagggtaacggagcagtggcggagaagatgaagatgatggtggggggagttggtgacaatgagttctcaaaactcctagctcaataggaaagggggctagagaacgtggcggaacaaaggcacaaggaggggcggtaaacttgaataagagatacaaggtctgttgtgttggggagaggaagcgtgaggcccccaaccacaggcctaaagaaggctcagaggcaacaccagacttctctctccttggcagactcggtatgcactccagtttaactcagtaagtggggtaggcctgaagtctgccagtgatcagtgggatggcctgagattggggaaatcccagcccccattagtcctcagtttccccctctgaaatggaggacaacatgaagtcccagtgcatgccccatggctgactagtggtgcatgtgtagtggaatggggctgccatatgtgtgtggggtaggggtgatgtcaagatgtcaagaaatagcccatgataactgggctggggagatattgacaaacgtcttctcagggcaactcaaagcaatggcctcttgtcacttccatcccatggcttggatcctctccatttctccatcatccccacctcatcttggtcgccgcactgaaggtcaccagagctgtttccctgaatgtcctcacacctctctttccctcctagaaggccagaccctaagtgggctgcagtgtgaattggttagtccttggactctggaatcgggccccaggtaatagttgtgtgaccgtggacaatatacttaacctctttgagcctctgttttctcacctagaaattagaaataacaatacctgccttacaggttgtaatatggctatgtctatgatgcatttagcccagcaaacttcgactcaaagaaatggtagctgttggaaagccacagaagtagtcaggttcagaattaacagttactctgtaacccaagaagctgtagccacaggagagaggacctctgcaggatctgtggcttcccacagccacaaggtgcagcctccagggtgagccacctcctctttcctgtggagcctgcacttgcgtgtgccagcctacagagggcgctcctcctcctccacaagcccaggactccatggggaggcctggctgccccagggaccaggcaccctgcccaggttgcaagagtcctgggcaatccctgtgctctggggcagaggtgttgccgagagggaggaagcctaactggctggcccagagctgctttgggtctgaaagggggacagggagaactctgttgttcatggctctcagaggccctacgccttgtactctagctgcaaatttgatggggaaggagcctgggaccaggggagcctcgggtttccccggaagcatttcccagcagccctaggaccctgtgagcaggtgcagtgggacccacgcgccgcctctactcctcctttcctggctgggaatccttcctgccccccagcacacacacacattctcagtgtagttccgtgtgattcactgtgagtggtcatcatcatggcccgcatcatggcctgaggagagcagggacctcagctgagtcatctccccgaatggtaatgagggcagtctggagaggatctgtccttcagcctcctccctgggttctcggtctccaacccctcaccatgcgcaggctcacccagggagctgctgcttcaccagcagggaactgctctgcctcaccaggcccgtgtggcacagggtgcagctgtgcaagccatgccctctggccacagggcaggtcattaggccagcactcatcccctgccacggtcagggctgtgtggggctggaatcagaggcctcctccgtttcctcaacctgattcctaaacattacctgtttcactgtgaaaaaccatccacggacctctcctgtggttttctacgcccaagaccagcagtgttcagtagaaacagaatgtgagtgaaccacaatgtattttaaaattttaatagccacatttaagaagaaaaagaaaacaggtgaaaaaaatgtgtttagcccaatatattcataatatattcataatatattgtttcaatgtgggctgggcacggtggctcatgtctgtaatcccagcactttgggaggctgaggtgggcggatcacttgaggtcaggtgttcaagaccagcctggccaacatgatgaaaccctgtctgtactaaaaacacaaaaattagccaggcgtggtggcatgtgcctgtaattccagccagttgggaggctgaggcaggagaatcacttgaacccgggaggtggaggttgcagtgagccaagattgcaccactgccctccagcctgggtgacagagtgagactccatctcaaaaaaaaaaaaaaaaaatatatatatatatatatatatacacacacactcatatatatacacacatatatatagtttcaatatggacccaatataaaataattaataaaaattttaccttttttggcacaatgtcttcaaaatctggcatatattttacacctttaacacattgtaattgggaacagcagcatttcaaatgctcagaagcgcgtgtggctagcagctcccatattagacttcactagcaattgttagctcctggtaccatctttacaggcaggtgagtctcctaggagcctgaagtagccgtggccgagaggtctgatgagcttcagtttctctacctgagagcccagcccttgagaacctcctgggaagcgggtgagccttgctccatggcccctggctcacagctggatgcaccctcaattcctgacctgagggctcccgctcacaggaagctgccatctggtgcagtccctctagaggacagaagaaggttcaggaggcgccctcctcaaatccagtcctccgggtcattcaaggccccaggctgcactcccagagctccttgccctgggccatgctcccacttgatgccagggctgtgcttccgctctgtgtgaggggaacctgaaaggaaagttaacatttagatagtggaaaggagagagtaaggaaggagatccaggaaggcaacagtctggccaagggtctggaggtgggaggtggcgggacaggagatgacagggagcccaggcggaatcagaggagagaaaagaggaacagccgtcgcccttggagaggggtgtgtgtatgaacgctaaatgccgagcctggacagaatggagccatagaagtctctgagccagggaaggaattcagtgagatcaggatttgaggcacattagtctgggggctgtacagaaaggactgggaagggaaagatgaatgggaaagtaagtggggtaattaaaaacataggcaggaacgcagagcacttggaccttctgtggttggccccagggagctcagcctgggatgcgggcctctgtgccagaagtctgcacaggggactgggccaagggctttgaggtgggcagcccaggagtcctggggccccgccccctctgcctgtctccaggagaaactggacagctcccacagagggacttgcagaatcagtggtttctggcgatgtgactgtgagttgggtgtgggtttgcttctccctcctatacatccatcaccacccgttctctgccctgaatgccagggtctgagggctgagctgccagccctgggctcctgcaaagccaacatataattccgggccactgagaacccaggcaagacttttgtgagaatgaaacaagacaggcccctctgcgcagacacagcctcttggcagatggtgccttcgtgctaagcaaaaagtgcccggcgcgggctgggtttcaatccccaccacacccttggctgaggcctggcacacgaaccatgtaaccatgcacggcagtcctgcataattcccagtgctgggggaaatggtatgaaaggggtgagtcatacttgaaaaccacaaggcaccagagaagagaccttcatatgagaccccctacctgtcctgctttctccttctcccctggaccaggggcccagagctactgggggactgggcaaagggaggtacagcaagagcaaactcgctggatccagggagtcatagcagcagagtctcaggcccaggcacaaagcctgcatacatctctctcctggagccaagtgagaacagtcctaggagagaggcaggacagagactagagtcttgtttttaaaaaaactgaggccaaaagaagttcagtggtctattcaagatgatgcagctaataagtaagggtggacaatgagaggcaaagtcacagggtagcgaagaggcatcaggcagacctaggaagagtcccagctctgactctgagcattcattgaagttcttcaagtatcagtctgctcatctgtaaaatgcggctaatagctacggttattcctaggattaaagacagcagtgtatgtaaaacacttaatgacaattatagaaactgggactcaaagcccaatttcttgcccagggagagatgtggatgcattgcagaattcctcaatagatcaggaagtccaggatgttagaaagttgtcgaactaccaggcccacagagcaaagaaagaagattcagagagatgcaccttccacagctctggggatgcgtagctgtgcctccgaggcctgcttcgggaccaaggtgagcatggccgagggctcaaagttgagtccctctccatgaactgctcttggccaaaaggagctgccccatttaaagccacatcccctgcacagggaagcctcatccaatgattgtgtaagtccctgggccaggctctcttgcctcaatctggggtaactctgcaggccaccacagccctggagcttcccagggaatcacctgcaactgcccacctctgctcttctctccccacaggtgaggggcatgcccccaagagcactcctcatgcaaatgcccatgtgcacatcttcatcagagtctgcttcccaggtgtattgtttccatggctgctgtaacgaattaccacaaacttggtggcttaacgtaatgcacattcattctcttacagttctggaggccaggagtctggaatcagtttcactgggtttgagtcatggtgtcatcagggctggttccttctggagactctaggggaggatctgtttcctcaccttttctagcctctgggtgctgcctgcattcctgggctagtggccgctttctcatgttactccaaccttgcttccattgtcacatctcctacttcctcccctgaccttcacccaaataatccaggataatcttcccatctcaagatccctttttttttgtttgtttttttgaggtgggtctcactctgtcacccagtctggagtatagaggcaccaccatggctcactgcagccttgacctcccaagctcaagcaattctcccacctcagcctcctgagtagctgggaccacaggcatacaccacctcacccagctaattgtttttatttttttgtagagatggggactcactttgttgcccaggctggtctcgaactcctggcttcatgcaatcctcctgccttggcctcccaaagttctggaaattacagacacgagccaccgcgcctggccaagatccctaacttaattacatctgcaaagtcacttttgccattcacaggttctggaaattaggatggggatattttgggggactattatttagcctaccacaccgaagaacctaaccaaagaaagcagctgcctgcctgccgtggccctcctcattgccttccaagcatcctcttgttgacacctccccagcaagggcagtctcactccatcacaggacggtaggaggggtctggctatggaaggcctgtctctggagtcagtgagccctatcggcctgagggtgtgtgatacccagctataaggaaggcttaagcaagctggaagcctttgaaatccagaaatacctgtcccctcttttctctgcctctcagcctatgtcacatttcaagacttggctgctgcaagaagccttccccagagcagacagaacagctccctcttctccagcctccaccatgctcgatggtggcaccactggtgcccaccccacagcccactgcatgcatctgtcattgcatgcctgcctctcccctcgactgtgcagtaggtctttctcattttcccatccgctccatgcttagcatggggtctgctcccctggagagcagagaccttctctgcttccaatcaatcaaataaatgcttgtagaactgggtcatgccgagccaatccacaattcccaaggaggaagacagaagtgtgaggtgtcagctgagtgccctggtggctcagtctgaatcagtgcaggctgggatgccctggggaggcccccctctacatttccatcaatccgggtcgggtctggcagctggtggggtgacatgctgctgctcccgcaggtctgcctgcttgtctccctggctcagagcaactccataaccagacccaagctcacctgttcaccagtcccagcgaccgtgcaacagttttcccattgtccatacttttcagagtagtccatagtctctgtgtgtccttctctcttattctccctgtaactcgctcccctttatcccaccaaaactgccctcctgaaaatcacaaccacctctgtgctgcccagtccacaggacaccactcagtccttaccataacaggctgctgccgcctcctgtcctggcacccatgcctccggcttctgcatctcttcatgagagaactatctggccttggaccaaaactggcccacatggaatatcagggggattcacaccccaggagcagcccttgaaggaagggcggggagctggtggatacacaccccagatttcccacccctcaatgggacaagtctgagacctgttctgtacactcagagggtccacagggggctgaacctcagtgttccacagcagtagctgctgggtaactcttatctacctttttctcttccctgtctcacttccctactccctcacatgctgcctgggatcatcttccaaacaaacaactacacccaaatccttgtcagaaggcctgtttagtgggggcagggaaccaacctaaggcaacatattcaatcatggtactctcctcaatgccaataagaaaagaccaggccccttcactcagtattcaagacctcagtgatcctgccctcggtctgcctctttgacaccaactcttaccttttccagcctcaaatgtatattctgggctgggcacggtggctcttgcctgtaatcccagcactttgggaggccgaggggcttgaggtgaggagttcgagactggcctggccaacatggtgaaaccccttctctactaaaaataaaaaaagttagctgggtgtggtggtgtatgcctgtagtcctagctacacaagaggctgaagcaggagaatcacttgaacctgggaggtggaggttgcagtgagctgagatcacgccactgcactccagcctgggcaacagagcgagactccgtctcaaaaaaatatatatatatatactctggcaacacaaaatttctcatctgctttgtgacttagcccaggcatttcatctaggaagtcttccttctaagtctagaggtcagtgagtccttgggcttcctgccccatcctaaggtgagcacttctatgagtcagccacaaggaagaactaaccaggttggagtgggctgttggcccaaagtcgagctctataaggctacagtgggctgctctgtagccagccatgtgtgcactctccccagcccccgcaggcatgcaggaagccccttcttgcctagtggtgtgctgaagtcagcttgcactggctcaaaagaatgaaacttgtgcacctcttccaattctgcattcagtggcattatgcgggttgtctgaaatcggctatggcaagagtatttacaccacagaaattggcaattgctacaaatcaggggtttcattttcttcaaagagtgaccatggcctcccctcccgccatgtgccataatcctgagtatgtctatgggttcatagtacaggtcccaggtctgaggcagggcagaatcagcttgggggaaggggtgttgactggcagcatggtgccaagatagatgtggagccaggggtcagagtgcagctgggtgaagtggaaaccaaaggagggacgagaggagctcatgggactgggggacaaaggccagggatgtgtgtgtagaaaagagagagactccaaaagaaatggagagagacagcaaggaagagacacggagagaagagtaagagagacatggagacacagacaaaacaaaacacacagatggagggaggaagacagagtgagacagcaaatagagacagaggcagaaacagagagcgagagacagcttgagactgggaagaaatgacagagtggaggaagccaagggcaaaaatagaagaatttagcgacaaaaacacaaactggagagtgacaaacaaagaccgtagcagcagagggggcccaggagggtgcagcccaggcctagctggggcccacggtgcatgaggcagcttgcaagagaggctcagggcccacttaggacaaggcctcccacgccctctagccccagccatcatgtgaatacctccttaggtgtccatcaactacttgaagatgtgaatgtttgattgcttctccaatttaggcattaaatccctcagtaattcaataatgcattgtccaattactcacatgacacgcaactttaaattaggaaaaaatatttagacaattcaattgctaaatgatctgattgtttctgaaattccctcataatgctcccttgagttattctcccttcttaaatcaacctgagaaagggatgtgccgactcagcagtctgtttcttggctctacctggctgaattcagtacaacctttagattagagtccccggattcaggcactttaccttgtccagtggtgtgctgaagtcagcttgctggaaaaaaaagaaattttcacaccttttcttaattctgcattcagtgacatcatgttgatagcttgaaattggctgtggtgggagtatttacaccatggaaattggcaactgctacaaaccagggcattttttttctttaaagagccaccactgcctttattcacctcccattctcccaccaatctgtggcccccaggtgggataaaaccctgagcagatttgtgggtttacagcatttgctccagggcccagctgggagcctccctaaaggggcagagcagaatcagttggcttggaggtttgggagagtcaactgagcagcataggaccaagctgggaattccagggcccttccctggcctctgtcccagggatcattgtgcctccccatcaagacagcacagtctggaacaaagagctcctgcctgaacattgggagaactcaggtatcactcggtgtcggtcaaggaaacccaggctctcagcaagggactggctcctggtcaccagcagggtggatgggatgggcatgtctgctgggcttcagtttcatgtcccgtttttctaagctgctcacactcaagagtcccagaaagtttgttgtgctacttctaaatagagaaaagttttgtctccataaatttatactctccactgccttcccaggaagctgagttctggtcacaggtgaccctttgtgctgccatcttgaaggagctgggtaggcaaattagggacaggaggggctagggaagtgggagacgtatgtgggaggaggtcggggagaggctggagagaactatggaagaaggatttcatgtgtctccgtggggtatgagaccatcttctgaatcttcccacccaaattgtcagtatactcaaccttgctccctgatgtctttgagtgaatggaatctggagtggagagggtggtggcagtttggaaagaaggatgagggaccagccccactggttacatgtggagaggacaaggtacacggaggaggaaggcaggcctggcagagctcagatatctgtgggaggaggaggcaggttcttgcctctctcttcctctgggaagcagcttgtttgggaaatccaagcccaagtccatccagggcaagtgcctcgattttcccttgagaggaagaaaagggctttcctgacccaggaggaggagaagactgaggtcaagtcaatcaaagggacaaagctaacccctatgccatcaagaatgtatgtgcagtgctgagtactattttttggatctgagttgtgctgagtgttggtttacagagctccagaacccccaagtgtagaatgactcattcaccgatgtcatgtgtgtagagaagagatctgcaagcctggaagattcacctcttcaggctcttgttctctgtcccaccagcctagtaatatgggcaggtcttaactttataaagaggccccaccaaccacaattccatgcaaagcttgctgcagagacccaactctgagggtaaggaccccaggccagacagcagacaactgggcatctctctttctctctcatttcctcctcctccttctcctcctcttcctcttcttcctcttcctcctcctgctcctcctcctctttttttcccccagtctgagccctcactccccaccagctaactagcccagagcaagcagctaaatatagttccttattctttgactcgtagaaatcagccacaaactgtctgtcaacatgaatttctcagctcagttgttctagccatgagcagctgctgctcctgatacttcaccgggctgctctcaagttcatctttggtggggtctgcatggaaggaaaacacaaatttgagagggcagctttagaaagtgtgaaacgggcatagactttgaaattggagagacaggaaccaaatcttagcttgaccacttcctagctgtgtgatcctctgctggctcaattattgagctcttacttagattctgggagatgctctaagatctttccaataaattctcatttttgctcaggctaatgtgagttgggcttctgtcacttgcaagctgaataagaacttgcttctcaaccccttgggtcctctgctgatggcctcttccatccatcctcactcacatgttccattcccacattttgtaatctcttacccctaaaaagttccaaagctgttttctttctcttttacttttaagaaagatttttttcaagtgtaacacacttactgtatagtctcaatttgttggggtatagacgtgaaattgttttctaacttccctgagcctcactgtcttcatctgtacaatgggactactattgcctggctcacaggactgctagtacggtcaaccaggagcctagatggaaagcttctagcccaggcctgtaacagtgggagggctgggtagctgtccattcctctccctatgtggaaagttattctttacctatcaaacagtagaacagaggctagaattataatgcctgcccccagaaagtggctttattgagatgtacaaaatattctacattaatttttatttcattctcacatttattgagatgaacaaaatcagtgttatggattgttatagacacagtatctgtccctgtgccctgaccctgactgtggggctgtcaaatgtgcttcctggggaaccagatacaccagacacaccacacacacacataaacacacacaggaacacatgaagccaagcaaattcagagacaatttgatgagtgtaacacacacacaggagggtatatgcacatttgtgagtgcactgcaggcccatggctggatgaagcatgggaaatgggggaatccacagggcgcacgtagcccgccagtcctggctctcagcgctctccttctgggccaggcctgggccatgcttgtgttgagaggctttggcgccctctgctgactgcggtcctccctgcagccctctccaacctagccagagcaggtgcagcaggcccagggaagccaggcgtctaggaagggggaaaaccagaagggaagagactgaaaggaggtaaagaatggagggagaagagaaccagagcctatactgtccccaaagccaccaggatggaggacccagctatgcagccactcactgaccacagcagctgcttacagacaggagcatcacctcccaggtgctcatgatgactgtctagagaccctgtggtggcacagctggtggtgtgaagggcacaggccccagaaagttcctcaggctctggctgtgatgccttgtaagtccatgtggcagaaccatcaaccagaccagtgaacttttccacctcctctgggaatgcccagggccagaccttcaatcctgcaggctagggagcttgatgatggcaaacatggacttgggaaccagactgacctaggcagagtgcctgcactgcctctcactagctgtgtgaccttgggctcctaacctctccctgtctctgcatcctcgtctgcaaagtgaggggagtaagacagctgcagtcaggatgaaataaaaatccatgtaaaggccaggcgcagtggctcacacctgtaatcccagcactttgggaggccaaggcaggcagatcacttgaggtcagcagttcgagaccagcgtggacaacatggtgaaaccctgtctctactaaaaatacaaaacttagctgggtgtggtggcacgcacctgtagtcccagctactccagaggctgaggcaggagaattgcttgaacctgggaggtgaggttgcagtgagccaagatcataccactgcactccagcctgggcgacacagcgagactccatctcaaaaaaaaatccacatagagtgcagcccagggcctgaggcaaagtgcataataaatgctagctactagcattactgttgtggtggttgttgcccttgccacgggcttcacgagagatgaaggacagagtttcatcagggcctctgcagctggcatgactcctgggaagtggagggaaggtgggatcatcagaatctcatgtttgcgtaaggccatgatgtcaggctgttagattcctgttaggaacacctgtcccaattgtctgaccttctttcttctagggtggcatagccctgttcctctgcaggactcatcacagccagggaggcccctcttctggtgttttcagactcaaggacaccgagactcacttctttctcatgacataacctccaagttacaacactcagaagctgtcagtggtcatattttctgtcttagacaaaaccagtcttctgggaaaagaacaaatgaggctgatctgcagcaagaagcaaaaacaagaacctggtggggctgctgtggcttgcaaatccctggttccagatgtctctaaggcccacccacatccccgcccctctgctggctcaattattgggctgtttcttagattctgtgagatgctccaagatcctccaataaatcctcatttttgctcaggctagtgtgagttgggcttctgtcacttgcaagccagagaacaaggactagcttctcgaccccctgggtcctctactgaaagtctcttccatctatcctcactacccacatgttcccatcccacatttttgcaatcctctacccctaaaaagttccaaagctgttttcttcctcatttaaggactttttttcaagtgtagcacattttttgtagggcctcaatttgttaggatgtagacgtgaaattgttaataatctcccctccaacacacacacacagtcaactgtgctctattgaaatccctttcctactgggtggtagggatcttaatgacatcgtggctgcgtcccacaactccgccgtcactttcatctactagaactgtctcatttcgttaatcaagacttcctgtttgtctctcctgccattcccacttctgcccagatgagagtggtgactggccctcccccaccaacaaggccacaatggaggggagcatccagctccagatccgcctccctatcacttttctagtctctcagtgactgcggggccaggagagggacttggaagcaactctcacatgtcctctcctaggtggattgtcactgcttctctggctactccactccctcctctctgccctggtgactgtctcgtggacagcctgtgcattctctcaagccctagagagacgccctcatgggtgggacaccagcttgtccacttgagcccagccacctcacacagctctctctctccactccaccatctgtcttgtattgccctcttccccaactcaggcagctcagaggtatacaagggggttcacagactaagcagatgcccccctgggggatggtatgcttgtctctccttacaagaaattatcttatgttatcagggaggaaaggcacccaccccacccatcatctcccgtgaagaggggagcaagcagcctctaccacaaacactgccctccccacatggcaaccgaccattccatcccctgctcctcttccagtcactgtgggaggtggtggtggttgatgagagaagagccatcagccctgcgggagggagatggtactagctgctgaccacccactgacaaccctctgaatgcagaaggcagggtccccagtgccttttgtactcagctttgggtgttagctgcaattccagaacaggaggaagagtcccacacaatatcctgttatgctggtgcagaactctcctccctcccagatcccagctgaattgatcaaaagactaggaaagaagagaacgcctgttggcctggactgaaagccagagaaggtacattctcgtgccaggaaagctggggattgctgtaaagtgtgcaagatacagattaaaggaagacctcaagggctgattcacaactccaattcttgagaaagcaaaactatactatgagaagtagatgaggtcctggcagaatgtactgaccctaaattagggcagatggtgggacacggggcttgcagggcatctttggaaagccctttccatactatcaactgccttgggaaggagctgactgggaggtgggctggggtgggggtatgtggttgccatgtcaagtaggtaactgagctgggtggggtgggaggagttcctccctcaatcaggttctctctaataccgtgttcctcctttcctgttagtgggggcagaagtcttatcatagctatgttgaatacctacaggaacagccaggaaaccctggacgctgggcaaatagacctggcccttggtgcagaggaggcaaggttacctgctggacctggccccagccaactcccacacagttgtcccagctagatccctgagctggtaatggcccttggacgctctacctggagtggggaaagaacggaacacttgcacacaaacacacacacaaacctgcagccagctcaactactggctggtgcctctggtgacaagtggggagacatgtcacagacagtttgtgttcatagccaactggtgatgtgaaattgcattaaccagtcctaaaatatgacaggacaattggagcaacatccagacgaagggtgacctaaagagaatccatttccttctccttgtttgggggaaaatagtaagattttataaaacactcacttttagctcggtgcggtggtgcctgcctgtaaatccagctgcttgggaggctgaggccagaggatcacttggggtcaagagtccgaggccagcccaggcaatatggtgggacccagtctctaaataaataaattaaaaaaaaataaaattaaaaaaagtttaaaacactcatctttaaagtaggagtacagagaaaagcaaacacacacccccacacacaaacccacatgcacacacatatacttggaaatacacagagcctttgaaaagactctgcatgaggcaagaagagaacgtggccctaaaagggcagagaaaagtaattcctttgaaaagatttatcacataaacataaataacttgcagaccacatctgttctgtacgcaattcatttaattaaagtgcgcactctaagaaatgagagttgaaaaataagatggaaagaatgaaatgagaaggctgctgactgagaggcaggtggaaatcaaaaacaaaccagaggagagaaggaaagactgcaaagaaactaaaaatgcagtagaattttaatttccatcaagatggtaaagaacagaattggaactacagaaaatggaatctgtaaatgtgaaggacagataggagaagttctctgagactgcagaggaaaagcacaacaggataaaaaacagagagacaacatgataggtatccgggcttacagaagacactaaacaaatgaaataaaagcaagaatcacaggagaaagatgtccctgagctgatgagaagcctgggcttatacatttaaaagattcctccttaagtcaaattaataaaaataaatgaacacttagaaatgccatgtagaattttcaaattgcaagggtaaagaaagaattctatcagcacccatgcagagagaaatatggagaaatatctgcaacattcatttttgttgttgttgttgctgagaccgggtctcactttgtggcccaggctggagtgcagtggtgcgatcacagctcactgcagcctcaacctcctgggctcaagtgatcctcctgcctcagcctcccaagtagcttgggactacagccatgtatcactatgcccaggtaatttttttgatttttgtagatatgggggtctcaccatgttgcctaggctggtcttgaaatcctgggctcaggtgatcttcacaccttggtctcccgaagtactggggttacaggtgtgagccacgacacccagcccaacatttcttaaagtgtataattggaagagagagtccatggaattttgttaactatttgtactgaggaaaaaagtttctgtcataaaataagcttgggaaatgctgaattaaacaaaacaagataaaaccctatgctgaggctttctcagggcttttaacgtattcatgcatgttattaaactggcaatattagcaagcccagttttccaaacttatttgactatgaaatcctttgccatagactatgtggtaagactggtgttcaatagaacacactttgggaaccactcttttacagaattttgagagatcagttgtgaccttacattttaacaatttgcctggtgcaatcatgcatgaagacaacagaaaaagactttcccacatgccagaacttaggacacatgccatgtatggctctacttttcacggggaaaaaggtactcagagatgcactctttccaagccagcaagagtcaaagtaagtaaaataatagtaagtgaaaaagcaagtcctgggctgcaattctcaactttggcccatataaagtctctaaattaaaaaaaaaaaatccaggctgggcaacatggcaaaatcccatctctacaaaaaataaaaaataaaacattagccaggcatggtggcataagcctgtagtcccagctactcaggaggtgggcagattgattgagccagggaggtcaaggctgcagtgaccttgacctgcactccagcctgggcaacagagtaagaccctgtctcaaaaaaaaaaaaaaaaaatcaacacagagaaattgtataaaagctctggaagtgaatattaaaaacatgttaaacacatggttatgcacgtatcagtcaggaagcagaaatcacaccagagccacttccttccctgcccagccctgagccccacaaactgcattcatcacccaggctcccttgtcctccagctccttgctgagtctgacaatggagggtatgggcaggagtgtggaaggcaggaggtgagaagagctggtgtatctcatctgtgccctgcctcttttcgtgccctctctctggcggggactttgttcctccacaagctcagctcttgcctgcacctcttctccaaggttccagctctccctgggctctggtcacactggttcctcccattgtccctgaagccctaaggacagtaacaccataatgtctagtctctgggtacctcaccatccttaccatgccttttttgttcacttaaccttatccacatttccttttctttgagacagagtctcactctgtcacccaggctggagtgcagcggcacaatcttggctcactgcaacctctgcctcttgggttcaagtgattttcctgcctcagcctcccgagtagctgggactacaggcatgtgccaccacacctggctaatttttgtatttttagtagagacagggtttctccatgttggccaggatggtctcgaactcctgacctcaagttttccacccacctcggcctcccaaagtgctggaattacaggcgtgagccaccgcacccagtccccttatccacatttctataaaaagtcccttcattaaagtctctttagttaaaccatcttgggtgagtgtttttttgccaggaccttaactcaaacgcttctcaattctttttgtaaagccagaataaccctgatactaaaacctgacaagtggcacaaagaaagacagaatgaatgagtcatacacctgcctcatttatacaaatgtagagtcctaatgaaaatttaatcagataagtccaatgtatgtcaacaatgtattaaaagaatacaccatgagcaaacattcctggaatgcatggataattctatattagaatggcagtgaactgatttaccacagcaataggtcaaaggagaaaaagatcattttacatactgaatagatgtttggtaaattgcgacatccattcctgattttctttttaaaagctcaagtaaacgggaaatcaaagtacacttatctcacatgataaaaaataataaatctcaaaccaacagccaaaaccaaaagcgtaaaatacaagtagcattccaccaaatctgagaacaagacaaagagttctaatatcttgttatttaacattattctaaagatcctagctaatgaaattagatagaaaaaataaaaaagagggaaacaaattataattatttgcaaatatgattgtcttcccataaaaaactgagaaaatacaaaattatcaaaatagaagaatttagtaaagtggctagttataaaataactttttcttttcttttcttttttttgagacaaggtcttgctctgtcacccaggctggagtgcaatgggggtgatcttggctcactataatctctgcctcctgggctcaagcgatccttccacctcagcctcccaagtagctaggactactggtgctcacgccatcatgcccagctaatttttgtattcttagtagagacagggttttgccacattgcccaggctgttcttgaactcctgagctcaggcaatccacccacctcggccttccaaagtgctgggattacaggtgtgagccactgcacccagcctaaaataaattttcatttcctaataaactgttagaaaacatgatgcaaaaaaggggggctatattagttatctctgctatgtaacaaattaccccaaaaccgagtgacttaaaacaacacatttattatttcaagtttctgtgggtcaggaatccaggtgtggtttagccaagtcttctggctcaaagtctcttacaagggtaaaagtaaggggtcagccaaggctctggtgtcatctgaaggctcaactggggaaggatttgcttctaagttccctcacatggctgctggcagcatgtggttcctcaccagttgttggactgtgggcctcagctcctggcttgctgttggccagccaccaccctcggttctctgccacatgggttttccataaggtggctcacaacacagcagctggtttcatgagcacaggaaagcaagagggttagagagacaaaattacagcaaaacagaaattcgcctcttataacctaatctcagaagtaacaacccatcattttttgccatattctatttatgagaagcaagtcactagatccagcccacacacaaaggaaagggattctccaagggggtgactatcagaaggtaaggatcattgggagccatttcagaagctgcctgccacagatgtcattgctttattttatgaaaataagcaccaaacacactacattcatctataaaataaagcttccctaaagacctataataaaaaagaccttaataatagaaagatatgccacgttcccggacagaagcactcaatggtgcaaagaagttgattatcactaaattaatctacaaaactaatccaattgcaatgtccagtgggatttgtctgctagtttatctcggcagaaaaaaaaagtttagaatttatcttaaagaatatatgaattgccacaaagaacacctcaaaagaaaaaaatgggccaggcgtggtgagtcacgcctgtaatcccagcactttgggaggtcgaggcaggtgaatcacttgaagccaggagttcaagaccagcctggtcaacatggtgaaaccctgtctctactaaaaatacaagaattagctgggtgtggtggcatgcatctgtagtcccagctactcgggaggttgaggtgggagaatcacttgaaccagggaggcagaggttgcaatgagccgagatagtgctactatactccagcctgggtgacagagtgaaaccctgtctcaaaaaaataataaaaataataaaacaaaacaatgggacttgtattctcagtcattaacccttattaaaaagttacaatcattaaaatagggcaacaaataccaatgtaagaacgatgtgataggccaacggaacagaacggtaaacccagtcaaacacacaaaaatatttagtgtatgataaaatggcctttcagatcattggaaaatgattaatttatttataattcatttggggatagttggttaatttgctttaaagttatgttcttacctctcaccacacatgaagacaaaatgaagagtttaatataaaaagtgaaatcataaaatctcagaagaacatttaattgaaaatttatatgttcctggtgaaggcagcggttatgcaacaataaagtccaagaccataaagaaaagattaataatctgacagcttaaaaatgaagcatcaagaaagtattttaaaaattgatggaaatgacaaattagttgcataatatgtgacaaagagtgatatatgaaaaggtgctaaatatacatcttataaaccaatactaaaaagatgaacattacaatagaaaatagtcaaagaatatgaacagaaaatttaccattcattcactcaacaaatatttatcgagcacctcttctgtgccagacaagtttacacatgggacacagcagtgaacaagacaaaggacaaaggtccctgccccaaggagcttacattctattggagaggggcaaacaataaacaagtaaattatgaagtattttagacggtgataagtactactggcaaaaaagaaaaagaagggttaagtaaggcgatcaggagtgaggcatggggagctcaggggctggggaggtctcatcaggaaggagacatttgagcaaagctttgaacagattcaggtagttgaccacacagagcaggggaaattgccatggtgcggcggaggggcaggagaaggccaagttggctagaacagaaagagcaagggaccaagtggtgaggaccctggaggccttgaacaggactttggcttttaacctgagaaccattgcagagctttaaggagaagagtgaaattttgacttatgtctcaaaaaggatcattctggctaccatcttgagagcagacttttggggtacaaaggtaggagcaaatagaccatttaggaggtcagcaaacacatggcaacatgttcactctcacgggtaaccaaaaaaatgcaactaaaaaaatgtattcacctgtttttaacctatccaatttttaatgttcttttagaaaacagtactcagtatcagtaagggtgaattaccttcgggcaggtaaatgggaaccacctttctgggaccagctgggtattctgtgccaaagcctcaaaaacactcaaaccctttcaccagaaatccaacttctaataaattaatctaaaggtctaataatcgccagtacttattgagtgcttgtatgcaccaggctctgaactaaacgcgctccatattacccccatttaaattcttaccattattcctgtcttacagaaagaaaaaaggcatggtgagtcacacagttcacaaatgagggctagaaccaaacccaggcactgtgacctgctacacaggagaggcagatatgaagatttcttcaagggtgcttattacagcatcatttataatagcaaataaagtacccaaaaaaatcaacaaaggaggtgattcattcagttatgatttgtccacataagtcagtcattaaaaatctggttaaagaaaactcgtttccgatccagccaggtgctgagacaggcagaactttccagagcttctccttggaagctgccagctgctgtgatgtcctatttcttgatccaggtggtaatccagaggtgtgctcacgttgggatcattcatcaagtggtacacctaggatttgtggacttttgtgtgtgtgtatgctatactcatgtttttaaaagttatttttggccgggcacggtggctcacgcctgtaagcccagcactttgggaggccgaggtgggcagatcatgaggtcaggagatcaagaccatcctggctaacatggtgaaatcctgtctcacctaaaaaaatacaaaaaaattagccgtgcgtgatggcaggtgcctgtagtcccagctacttgggaggctgaggcaggagaatggcatgaacctgggaggcggagcttgcagtgagccgagatcgcaccactgcactccagcctgggagacagagcgagactccgtctcaaaaaaaaaaaaaagttattttaaaaaatttaagttgccaggtgtttctcctcctacagggacacaagaaggctgtggagcaggattcttgggccagggatgaggccctagttatgtagacccaaggctggtagccaccacttgctccacgtggaaatggctctcaagattctgtggtctgagaaagcctggtccttcccatactgcaggaaggaaatgctatgcaggaagcggctggcctcctgggcagatagaaatgaaggtactccccgaccccacaccctaccttcccattccaaccagtgggttgacatttccacctctaagtgaaactggcaatctgactgcaggcccaggatccaggtccagtcctgagggagacaaggtcctaacaggggagggactcaccgctccggaacagagagggtatcttgcggagtgggggacaaagtcttgacctcctcttcatccaggcaggcaggagctcctgtgatcaatatgaatattgaaacggcagttaccttgaaacaaggaaatgttcatcaactgttattacacaaacaaagcagcttgtaaaatgacataggcactatgatcctaattgtttttttaaatgagtgggggggtggagcctaaaacaatggtttttctctaggttacagaatgaattactttttcttttttactctgtattctaaatttcctataattgacctatttcttttgtaatctgagattaaaaattgtattacaaaaaaacttaagggagagattgctgatatctcatctttcatcaccctgtggccctttcctttccagaacccagctgggcaaaactagtctccactggccccaagggcctgctccttctgttacaggaaagggttcccgatccaggccccaagagaggcttcttagatctcacacaagaaagaatatggggcaagtccacagagtaaagtgaaagcaagtttattaagaaagtgaaggaataaatgaatggcgactccataagcagaacagccccaatggctgctggttagctgtcatctatgattatcttttgattgtatattaaagaagggatggattattcatgagttttctgggcaagaggtagggagttcccagaactgagagttccccttccttttagctcacatagggtaacttccggatgttgccacagcatttgtaaactgtcatgcactggtgggagtgtcttttagcatgctaatgtgatatgatagtgtacaatggggagtgaggacaaccagaggtcatgatcatcaccatcttggtttgggctggcttttttttttttgagacaagagtttcactcttgttgcccaggctggagtacaatgacgtgatctcggctcactgcaacctctgcctcctgggttcaagtgattctcctgcctcagcctcccgagtagctgggattacaggtgcgcaccaccacgcctggctaattttttgtatttctagtagagacagggttttaccatggccaggctggtcttgaactcctgagctctggtgatctgcccgtctcggcctcccacagtgctgggattataggtatgagccaccatgcccagccatctggctttttttttttttaattgcattctgttttatcagtggagtgcttgtgacctgtatcttgggcctcctgtctcatcctgtgactaccaaggcctagcctcctgggaatgcagcccagtaagtctcaggctcattttacccagtccccattcaagatggagcccctctggttggaatacctctgtcacttccatcaccacatccagtctcaccccacaccacctccccttctccagctccactaccaacccccaccagggggaaatgagtaaactgcatgagctctgagaaagcagaaaaaaagccacctcatgaaggtgaaccaaggactgagtcgctgacagacagagatggatgggtaaatgggcagacagacagacagacatggagactgaaatagaaatgcctcccaaaggtcacagagagtcagtgccacgtcttcacctccacccaggactatcacttatacacccccaccagcctgggcacccactggaaacttggcaggtctggctgctctctgtgatgactgcagtcagcacagggcctggtattccacagatacccagggaacatgctgagtgagtgagtgagtggatgaatgaaggaatcgttcattggtagaagcatcagcagatagagatgacaggagggagtgtgaaagagagttgaggaagaacagaaacagatggagacagatggaggctgcaagtcacagacttggccacagatagaaaatgaacgaataaggtggagggaggttactgcagaaaatttaaaagctatagaaagccggtcgtggtcatgtgcacctgtagtcccagaggctgaggcaggaggatggcttgagcccaggagttcaaggctgctgtgaatccactgcactccagcctggggaacatagcaagactatgcttttttaaaaaaaacaaaaacaaacaaagaaaaagctagagaaacccagagagatcccagtgaaagttaaatttacagacaaaaagaaaaggagagagagagcacaagccctcccttaacttgtcaggatgttagcagagagaaccaggggttcctgccttagtttccctcctagatttgcaggtctctgctggactgtgtcccaagggcctggcgccctgcttggttttgtcagttctctccctcgggcaggggacagtttcctcttacccccacagcatgccagctcagggccctcccacccagaaggccccagacaactatgcagaatccccccgccaaggcaggtccctgggagaagatctctctccccagctggtcctcattcctgcaatgacaatcggctcctgtctccactggctctgggctcagggcccccgggttggataggggttggggctggaagtggaggtagagacaggagcctgcttgccccagactctggggaggggtgaaagtcagagaggggagaagctctaaggggctgaggcggcttcccgcctccacagagcccaacctgaatgcccagagtactgtatcagcttggttatttccaaatcccctgggagccgtaggggaggggacccagagagctgggaggaaaaccgactgggaagtagccagagccacagaattctcctgggtcctagagaagggtgggttccttccacccccaaccccattagtccctcgaaaaggctctgacctcacctcccccacttccggagtggagttccagccctgaagaaacacttccaaacccatggctctggccccctcctcaggccccctcctcggctacctcggccctggggactgggtcccccaccccaccgttgcgccagatgtggctgcaggggaggggtaggcacggggcccagctggcagtggtcactcggtggtcctctccctgcagagtcagcactttctgtgccagctcgcccagcctcctcactcagcacttcctccagcccgctttccagaggcagcagctgcctgggttgggtcttggattcccagtgctgccccaaacccatctacagcgcagcctggaagatggagggtttgggtgctctggggccttccctcttggcatccccactatcacagaaaattccgacccaccatgggcctcctagtacgtccctctgcaaagcaagggaggaatcccacagctcctgacccctctctgctccccagacccgctgctggtcaggcctgctgcttcctggttcccccatggactttccagaactcagccttccatgacagggtcacaggaccctggctgctccgtgggagccccggcaacacagagctgagcacgtggcaggggcttaataaagtcatgcgcaatcaacaggctctttcatccttctatcaccacccctccgagggtcccttgacaccggttcctagtgccaggaactggcaacaagcttcaagcacatgcctgggtcttaaaaatgtgggtgtgaatcccagcctgcagggacaggcggagagagaagctgcccttcaccccagacagctctggctcagctcagccttcgagtccacgccctcatttgaccccagctctgcaccctccataacctgcccaggtctcttttaggaccccaccctgcaggtttcaacctaaggatgccaggacacctccagccaccaaggcaaggccttgcccagcatgaggagaggtgatggaaggcaggctcccctgggctcacagaactgctgggcctgtcagccactgcaggagacctaaacccaagtagaatgaggtcagaaggagggagtagagaggaagggagaggacagctctggtggaggggccacctctggcccccctgcacaaggttcaccctgagcaaggaaagatgctgaagacagataaaaacaggaaagacagaggaagtgggagtgggggtcaaccccaagagataaatccctcccttctctcacaagtcaagaggaaagaaggaaaatagtggccacatgtctggctctgtgctggggacttttcataatcctctcattccatcctctcaaatatgccacaagaaaggtatgattacccccaggtcacagacgggactctgaagctctgagagcttaaaaagcttccccggggagtggctgggccaggccaggtccctagctcaagtcatggtgtggacccccaggtctccatctcagcagggatggctggcaggagcgcagtcctggccaggggagtctgtgcagaggcccaggctatgttcagagcagagtttattcaaatagagcctaacaggaaacttggctcctctgactcactctgattcgaccttattaagaaaaaaagagagaggagcaggagccagcatcgggtaaggtttcacgccaagagctggctctgaggcccgctgagtggaatggcatgtgccctgatccccccacatccaaagccttgaggcagcccctgccctgctgtccgagtcaaggcgaggggtcctgccttcacgttagggcaactgagttcccttcctcacagccatcctctgtcctccctccactcctcttcccttccctccctgcctaggggtaccctgaggcctgtttccatttctccccctcctctgctgcagcagctgcccatctggctggcgggagggccctacaggaccccagggattccaagcagctgaggccaacactgcagggggcaagcaggagggagggaaggcttaaccctccaggtcccggccctcagtaagccctgcctcagcatcttgcttggtgtcagtcacaccagtggctctttggaggaatcttgtctggagtctgagatggaaaccccatgctggggagctgaggtgtcagcgttgacaagttgctggccaggaggtattggaagccccctacctctgggctggattctgggcatttaaagggtagagacatgctggagtccaagcctcagtcctgaagaacagtgcaatgggtgaacaaatgctgcctggcaaggatggggttgggaggtctatagttcccaaagaatgtccactctagttgcctcctctctaggtgggctccaggcatttccaaaataaagaatatacaggagccaaattaaggacaggtccttcataccttgtttataagcccaagagggcaatttctgcccttcggttcccaggaacacggttggagaaggcagcccaggggaggccagaagagcagtatttggagtgtgatttcttggatgccaaagcgttcaaacttctgggaccccctcctatccctgccattcccagaaggaacagagaatctcccaaagcactctcaggagccatctggcctaatcttccattggtaagccgtggcacctggatcagatagagtaagggactaagccacacagcaacaggaccaggccaggtctccggaacccccttctgttgttcaatgcttactggcttctctgcctcacagtgacccctgtcccatatcaaagacagcccccagtttcattttatccatgtgtacactcaagttattcccaggctatgcagagccaagagatgtaggacagaaaccatacgtgatgtctgggaagttgatctctcccaggatctcacaagtgcttttcagctcagggatacaccccactcttcagactgggaaagtaagcccctgaggtgtgccacgagggaaaaggtgcagctccagtgcctctcttcgcaggcccaagagctgcggtgcacctgggacctggaattagagagtggtccctgttcagcatctccccgaggaggcccaccaacaaagagggtgtgtcttttttttttttttcttcctattgagggtgtgggataatggtggaaggaacatgcaaagagggtgtgtcttaattagcactggctttagggaacaaggaaaagggagaacccgggagtacgggaaggaggctggggcagacaggagtcagaggcccattccagcccaaacgagaagccagtgagcaaggtggagaccagggatgctgtgaccaaagcagagaggaatgggcggggtggtgctgacaccccagccccgttctgcctgccagagccccacttaccaggcccgagtccccagaggtcccctcctactccctgctcgattcccttcctcagaggcaggtctgtggcttggctgggaactccagggactgagggagcactgcagctgtgggaccggcgcatagctaaaagccggcgggccatagggccccgcggaggaggccccagcaggcggaccaggaggccgaagcctcccgacgctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtgagtacggccccggcgcccctccggccgcgcgtacccctggccactggaaactgctccgggccccccgggcccctccttagaacttcctggaggcctccccggagctgctaagcacggagcagcgccccctcccgacttcccccgacccagccaacagcacccccctggcatctcacctcccagcttaacccgcacccaggcatcatcagtgccaggggttggccaggcaggtgtgggctctgatcctggctttggtggagggactagccgagctttgggaggaggctcgccttctgcacttggcttgggtcatctgaggacaaaaggaaggagcccctcatccaccttctccctcatttcaatgagggcatctccttccccccttagagatgttctatgccagctcacagggtgaggcaaggagcatcagaaacctgagtcttcagggccagaaaggccttaagggatgcccctggaggtgtggcaggctgcccattactgggcatgtgtgaggttggcttgagtgcgcaggaggttagaggggagcgtgtgctccaggcaggagtccggacttcctcaggggagtctgcaaggctggggcaagagagaccagtcaggcactggcctgggtgcagaatttcaggggctaccaaaaaacacagtagttgagatgagtaatattgagatgtatttttttaagtcaaaattaatgcaaaaaaaaaaaaaaaaaaaaaaaacctgtgataaaggaaatatccagattttaaatagagtcagtaatagtggtatgccgagccatattggagcctgaggctaactgaaaaatcagcaacacggatcctgtctttatttgatatttggatattttgttcattacagatagttttgcattaatttttattttaaaaactattgtgttaaatattacttatctccgttactgagtttttttggcaccccctaaaattttgcaccccgaggaaaaaaaaaaaaaaacacctcactggcctcattcccctcaccctagtcctggccctggcggagagccccagctgtggacaggactccctctggcttttcagggggtgaacatacgtcctcctcttgggaaggcccaagccctctgcacatgaggacacagtggaaaggcagcttccacacatgctgttagcagacagggctactgtgacaagggctgactggtgggtgtggccagtgctggacggccatcagccattctctgctgtcctagaatccccctccctgctaccctctccatacaggcagcttttgggccaaggttttctactcagtccccaatacttatgcagtccaactctgccttgcctctttcaagctgtcgtcagtttcctctacccataattctctgctccccattgaggttgctgtgcctggcccaccaagtaagggctgactgagccctccagtgcctcagagtataggtgctagtgccccagcctcctcctcagcctctgtcagcagagggatgatgctttgtctccagccaagctgacctcagtgaggggctgctgctcatggggtgcctgtctccctgggtactgctggaggccaagactaggggagaggagcgtctccactgggaacactcactctatcacatccaaggtgtcgcttttgagttgtgtgctgaatcccactttaagaacctgcaggagctcaggaaaaatcagatggcaggtccttctgtggtgtgatgaaggatgcatccacctgctctggtccttaccaggtacttgcagcatccctgcagaagggcgcattatagccatgcatcagctgctctagggccccttggagaataggatgttttacctagagggtgctaaacttttgcagtggcttttcttagaatgcaagacctcagcatgaggctcagcctgatgggccccacctctgggcagagaaaactgagctctcaaatgccacaatattggcagaggcatgcctgggacttggcatctgggcaccaagtcagtgggtcttctagggcctgtctttgggctgttagttcttaaggaagccagttgattgagaggggaatgggacagggcaaggccatgtctgaagtgggggtgcttggtgcttagcagacctctggccactaccctgagccccacagttcattttgggtcaaaaacatttctcccctgaaggtagcatcctaggtgccaagctgagtgtactcacatgcatcaagtccaggcccttccctggggcagtctaccaggaggggcatctcagtgctgtgattaggcaagcattggtggggccaggggctttgtgagcccagaggagggccctccctgtcaggggctagggctcagggagacttccacaggaagcaatgtctaagcattgctgcaagggatggtcatcagcaccatccaggtgccccttcccctaatcattgagggtgtggggtgggagtgtgttttttgctggggaggggattgcaggctagtttagggctcacaaagaggccagagagggagcagtagtctctcccatcattggttcctccctccccaccctgctaggccagaccgtggaaaatcccagcccagggaaggccaagccttgtgcttgagatcagacccccaggcctggtgtgggagcccaaggcggattctccgagactgacttcattcctcctggccacacacccaggggtctgaggctgggcgctggcagcctgtgagtgtgtgtgggcgtggacgtgtcctcacaacaccaagcacatgtgagcaccacccacctccctccatgggtgggtggtttccaagcgcctgtcctgagcccagtttcttcctcgggtacctgtgccctcttccttcctaccctgggcactgagactgcccaaggcttcctgcagtaccattctctccaactctgaaacatgaaactgaaaagaaactagaggaaacagaggcccagagagggtcacatactttgcctggctctcatagcaaatccttgaagagaggcctggagggtggccagccacttcccaggcccagctgggtctcctgcactgtgtcggctccctcgatgtgaccactcctgctattaccaaccaggccctcctctcctgggatcctcgcctcagctcctgcctccctggagtttcagcttgtctgagctgggggtcttagtgccacctaagaagccccacagccccagaagaccaaagctcccctcccaaggccttaccctcgcaccccccgcctgactcaccggctctggcaatcctgtgaaaggaacatggaacaggcagccctgggcatcctcccagggcatcttggatggctgtgctagccttgcctgacgtgtgtcctctatccctgacttcacatggccaatcagaggccaggagagaaccgcagctgcctcctccctggtcccttgctcccagtctctccctcttcagtctgtcctgcatgtggggcagataaacccctgcagtctgaccaggttactcctctgctcaagaagattctgtagctcctcagggcctttaggacaaaatctagtgtctcagcccagcactccagagttagaggcacctccttcctgtcctttcttcctccttttctcaagcctccacagcccccatgggaccatgctgctcgtgggcctagatgttacacctccctagacacatgcaagggtgtttctagggtacctccttctctgtccagcctcctgcacccaagaggccagacctgtctggaccctcagtccctgagagcagccctggctgcctgctaccacctctcctgcctgagcccctagctcacctgggcctgctccaccccacctccacaggctgcctgcccacctctgccctccaggtcactcgccttcccctgcagagtttggagtagatgcagggaaggaccaaagcaggcttcacccaacaagcttccagagttagagcccagaggcagggataataataccaacttggccatttgctgaagaccacttcctgggcttactgacttcaatgtgcagtttcattcatcctcacaacctcctaatgaggtgcagattatggtcctcctggtgtagatgagaaaacaggcctagggaggtggcacagaagggtacagccgagcttgaattcaaactgaacctgtgctctctgcatcacagtgagatgacccaggaggatatcatgttcagcctgcgggcagggtggggcagggcatgagcatggacccctctgccagctttgcctctgtggtcctcacctcccacatctgcatccagaggaagaattatgcttgcatttgctgagtgcgttatacatcatctcctttaattcccaggtcctagccaggtactgttatttgtcccgtgttacagatgtggtgacgagctcacttgctgacttttagtagtggaaccaggatttgagtctgtgtgactctctatcctgagttcttaacaaccatgcatttaaaaaaaaaatttatatattattgcttatcttgtacacctcatttattcactcattcatttggtcattcattcattcaacagatatttgagtgctagattctgggcactggttgtgacagggtgagatgggacagtgagtgtgaaagactttggaagcagagtctctccccagtgtggggttagggtgtagcctggtcatggtcattgcagattccagaacgtttgtgtaacaaacactcatatggtgcatactaagtgccggacactgttcttggagttttgcagttagaatcacttaatccctgtgacaaccctgggattgttatccccattttgcagatgaggaaactgtggccctgagaagttaagcgacttgccctggaggcagaatcacagatcagcatccctccttccttccccgaagttgtctcagattgttccttcagaaagaaaaagagtcttcaggcttagaaagctgtgtcggatcagacaagctgtggaaacggagggttctgggccctcctcctgcctccctgtttctcctttgagagtcatcagtgtctgaacaaacaagtggagtcctaagcagcctcattccaggcagacttcctgtctcctctcttatcagccacttgcaaggcaccttctctctcccctgctctcaaactggaccatccctgcaagaagagacagctcctgttttcaataataagaataagaatatctgatatttattgaacatacactatgctaagcattttatttttctcatttaattcccacaacagccttgtgagataaatagtattatcagctctattttatagatgaggaaactgaggctcggagaaattaaccaactcacccaaggtctcagggttaatgagtggccaagcttagacctaggctgactgtccaatccagtgggccctggcctcactctgttccgtctcttagggacgggtgttttatattctgtgtcacctgtctctgtgttcactgttcccctgaggtgtaaacacctgaaaaaaaccaaatttgggtttttgcctcaagtttgcgggccccacagagttgctggggatggtggcagagcagggttgggagccattagtaccattatgggcaccaggttactgctagacttggcctgggagctctggctttttgtcctctctccttcctcctaacctcaggggtcctcactgcagcatcctctgctctcagaaggtgtacccctctccagtagctccctagtagctcctgagtccattctacctcctttctaagctgggaacacatggaagacttcccaggacagtggctgacatgggcaggagaggaaaggggcagggagggagctggggtccgcccaggcggcccacacctccttccaattgctgtgcccagcattcctgcagaagagcagtcagggttgggatgctggaaagagaggtttagacttgcccctcccctggccctgacctagccgcctcatttccacaggcagctggaccaagggccttctttttgtcgggactcatgatcacagggtgagggttgggtctgggtccctctccctcttgctgatgggcacccagaaaccaggcattgcagtaccacttggaaatggggagaggggtgtcagaatgccaaagcaggaagagacacaggatgggaaagcgaggccccagaggcctttgccatccaaacctcaagagacaacccatccttccccctgcttgtgggccagctggaaccacaggttttccaaacccaacgcaaatctttctgcaaaagaaaggactctgggaatcgattccagaccctgcttgacaatgaagtctgtgctcacacaggcagtgccaccagacgttttatggagtatgggcattggctcacgcacttgccaaggacatacaggtgctaggccctgagctgggcgtggagaatttcaggggcatcccagaaccctccctggcctcactgacgtctcagcctggcagtgagaaaacagacacctggggtggagagtggcccaagtccatgtctgtctttgccagctctcagcacccactgtgcacctgggagacgtgcaccagaagctgagtacaggcaaaagataataccactcacccctgccctcatgggctcttgcctggctgcagaaggcagatatcatctcgtgaggaaatagggcagatatcatctcatgaggaaatagtcatttaacaaatatttattgagcgacttactgtatgctgggcaccgttctagagctgggtattcattcgtgaaaagaaagagacaaaattcttgcccttgtggatcttctattttcatgtataaacataataaatatgtaaaaaaaatagaaggtactaagtgctgtggaaaaatagagataggtaaggaagatcgggagtgtaggagagggacaggttgcaaaggtggtcaggcctcatgaaggtgacacttgagcaaagacttgaggcatatgagtgagccatgcagctgtctgcaggaagagcattccagataggaagacagccagtgcaaggccctgaggcaggagttccctggggttttcaggtgtgctccagtgtggttagaacagagtagagtggaaatggaggtataacaggggacaggtcagagaggtaatggggtccgggccatggggagcttgtcggccattgtaaggggtttgccttttattttctgtgcatcccttttactcagcgtttgagctgagtagaagcatgggtccctgactgctaaacagggcccctgactgctgtgccaggagtggacagtggagagtcagccaggggaaccgacaggaggctgttccagagagtaggaagagtggtagcaatggaggaagccagctttagggtatgttcttgagatagagctgaggggatttcctgctgggttggatatggggtatgaaagaaagagaggtgtcagggatcacacagtggtttatggctggtgtggctggaaggatgcaattgccttgagctgagatgggaaggctgtgggcagcgtaagttttgtaagaaatatgaaaatttcaggtcactgtgcagggcctgagagggcaaggagggaacccctggagtaactgaagcatcaagggaagcttctagaggtggggtagggggcaccaggcagggcctgcaagggcggggagggctcaggggcaggggttgggttcacgctgggaggaaatgtgcattaggtgtgcagagaggcagcagaggcttggcctctgagcagggagctgacctccgcattggttagcattgtctgcctccccctcagcccagcctgcctcctgggcagctggcgcaatcaagcacacacttacaaatcccttctgtgagtcaagcccttctgctgctgtctctccccattggtggggtggacaggtgagtgctgtaaaagggtgcagggtggtggtggaggggtgttcaggactgacagggtgggctttggagctaaagactgtgtgcctctgcataggtagagctggtgtgtgtgtgtgtgtgtgtgtgtgtgtgtgtgtgtgtgtacgcgcatgcacatgcatagctgggaattccaggacaagggcaccatggagtcagggggtaaaaaaggttggggtatgctgccagagacctgcctactgatccttaggattaagagttctggaaggctaggtaaggtcaaaccacagacggctttagctgccactctgagacttctaggcttgattctgtgggcaatggggagccattgaagaccctgggcctggcttgatggctgtcctagctctcaggcttgagctgggttacatcttcattatggggcaaagtggaatctgcagccaccttgcctgcctgctcaccaagcaggtgtggcactgccaggccagtgctgacaagttaatttcctgattatgagataatcatttcctagggaatcgggcagccagctcccgccgtggaggcctctctggctcatctttattcaaggccctgctctgcagagctttctgcttctctgccacctaggggctcctctggagtctggctgcgctagccaaaacatcccgctcagcacatatttcacaagcaactgaccagttcctcctggactttgtttatcctccagccctgggctcaagagattagggctcttttgcattccactttccatcatttgcccctcatgaggaggaggcttggagaggaaagattccagagacaaggtttactgaacccacaaaaaagaggaagccaagagggaaacaggtgaggtgtggacgagcaatgggaaggcagccacagggctctcagcgccaggcagcctccctccaggaaccgctgggcaggagggaacagatttctaatgaagcaggaaggatttaggtcagaaggtgggagaatttcctgactgctaaagtatcgtctgtaggggttgtgagagggctcgggctcttgcccaaggctggggaatgaactgaacagctcctaaaaagtattttaatctccaagtgtttatcgatctatccaacctgtgttcaggggccagctagttcagtctccctcatcatccagatggggaaagtgagcctcagaaaggggactggggagactggacaagacagtgaactcacctctggagcttcccccctgagaaggccccagctgcatcccaccagggaaggggcagatggtctttgtcctccggttcccgagggcgggcacgggagccgtcagcaactccagacccagcattgagcaggaggacagggtgggcttgtcccgagcacacaggccccaagagtcagtgtgacaggttcctcctactgtgctcctgcacactcccacagaggaagctccaggggcagagccaggatatagaacattggttctgtcttctcggctccgtgtcttcactgtcctggaggtttgaagggcatgctatagctaaaaggcttaccccacatcagtggctggctgtctccctgtggaatgaatggccctgggaccgtattccctcgcacgcagctcctccccagccgagcatcctggctttggccatctcaagggtcttcgctgccccgtgactcagcatccctgccatcctggcccaggctctgtgcagcctgcatctgaggaagaatgcccacagaggccggcacagggcctcaggccccgagtcaggtggaggacaattagaagtggaagaatggaggccatgaagcctgaagtggggctgggtcaacccaaggccacacagaaggcctatgacacagtagggcaagaccccaggctcctgtctccctcctgggagcaagaaattgatggtggccagggttttcctgggtagtctgagcaagcccatccacccagtctttgggtggtgagacccgccccagcctacccccaccagtggtgctgggggcttgggagaagactgagcagggctgtaggtgacccagggagctggctgcgtaccttcatcaggcccaggaggggcacgtacggccgttcactgtagcgtgtttgtggagcggggagttagaggtgacctggaggtctaaaacaggaggctggccgggtgcggtcactcacccctgtaatcccagcactttgagaggccaaggcgggtggaacacttgaggtcaggagttcgagaccaggctggccaacatggtgaaaccccatctctactaaaaatacaaaatttagccagagcacacacctgtaatcccagctgctcaggaggctgaggcaggagaattgcttgaacccgggaggtggaggttgcagtgagctaagatggcgccattgcagtccagcctgggcaacagagctagactccgtatctatctatctatctatctatctatctatctatctatctaggtagatagatagaacaggaggccagctagaagggacatagaggatgcacatcgtggaatcctatgtagcagtgacaggcagtgaactagatagaccttaaaagtttacatggactgggctcggtggctcaccccataacctcagcactttgggaggctaaggtgggcagatcacctgaggtcaggagttcgagaccagcctggccaacatggtgaaaccctgtctctactgaaaatacaaaaattagccaggcatggtggcatgcgcctgtggtcctagctacttgggaagctgagatggaaggatcacttgaacccgggaagcggatgttgcagtgagccaagatcgcaccactgccctccagcctgggctgatggtttcccctgtatttggagtaagcaaaaagacctcatttgactgggtgcggtggttcacgcctgcaatcccaggactttgggaggctgaggcaggaggatcacttgagcccaggagatcaaggctgcagttagccatgttcacgccactgcattcctgcctggacaacagagcaagaccctgtctcaaagaaaaaagaaaaggtggaggtggcgtggggagctggatatgtaccttcaccaggtccaggatcttcctttaaaatgcatactttttgaggtgagggctgatcacacagtctgataataactggacttcacccaacattggccactctgcttggagggcctgttgtaccctacaagccaaaaattgcagaccagcctccttactcctacactgatcgtgtccactagcccccaactcaatcaacccttctttatccccttccaacatcacataatcccccagccccaagccctgcagaggggccaagagcccaagcctgcaggcctggctgctgacgaaatgtcccctgggagagctgcccagagaaggagccattgttccttcctggaaaaacataccagctatgggagggggtctgctattccctgggacctcggcaaggatcctgagggtgaggcgggggggcctggcctgaactcctgaggctgctcctttccagcagcttccccgagctgctgcctcttgtgtcacccccatggccatgagggtgtgacagaggtggagctcagagagggagtcacaggaggccctggtgattgttagagatgtagaacaaagaaacttacaaaataatggtaagagtgattccatttaagttctagaaaaggcataactaatctacagtgattagaagcagagcagtggctgcctggggtggcggaggcggggagaggacttacagggaaggggccagagggtgacagaaacaatccacagcttgattgtggtggaagccacacggctttatacatttgttagaacttatcaaactgtacacctaaaatctgtgcatttcactgtgtatagagtacagctcaaaaagtttatttttataaaaagagtgacaggaggagtcctgggagggcaaggagacctaggatctcctcctggggtaccccagctccctgtgtgaccctgtgcagatttatgggcctgagcctcagtttcctccggtgcttccaaagacattatgtgccttggtgtcttgggggcaggacatggaaaacactttgggttgcctagaacagtcattaaagaggctctcctgacagagcctgaggggctttggaccagtcagtcaccctcaaaacaaaagttgctccactgagggcgagtaggactcagggcctgcccatagaatgccatctggagcggaggagacacacacaggttagtatggtgaaatctaagtgtagatcaatacagatggggtggtgagagaggagaattttgtgcagtctgagatatcattgcaatcaggggagacttcccgcaacaagaggcccctgcctgagcctgagattcctcaacagtaagaggaagaagatgatcatctgtagcgagggtcaaggctcagattgtgaccagcagccccaagctgtttgtccttagtctctcttccaattctccacatgcagtactctacaaatgcccctcctccataactctggcacttataaccctactccactcagttttaatcagacttgatgatatcacagcaattcctgtttttttttttttcctttagctgaagagctttagtccatcatcaggggacaaacagaaatgagactgagattcagaattgctgataggcatcagacctccgtctgtgaccaggatcagggctcggtgtgtgaccagcatcgggactcagactgggatcaggaacagggcttggtgtgtgatcagggtcaaggctcagggtgtgcccagggccagggttcagtatgtgaccaaggtcagcgcttaatgtgaccagggtcagaggtcagtctgtgaccaaggtcagggtgcagactgtgatcaggcacagggctcagtgtgtgtacatagtcagggctgggagaggccaggaacagcattggccctcactggccccacctggcctcttcctcccgctcctccaacttccctgggttgcatagccagctcatgaaatagcctagataggaagggtcaggccacaaaagctttgtggagccatctgtgcagtatttcttgaaactgggcctggggtgggggcagcaagctgtctgatgtcaaatgctgggtctcctgagtcttaaggcccagctaccccaccctatacgcagctgagggaaaggcactgggtgatggggaaggggcccatccctctcatcctcacccctcccccagaggcttccagggtccagagagtgagaaccagctcccagctggcttgagggcctatgggtcccttgggaaatgactgcaaacattcctaggggctcaagtaacagggcctaggctggccaagaagtcccccaccagccaggagccacctcatcctcacccacccttgtactccaagcttcctcatcattccaagtaggtgagatcaccctggctgcctggaccaggctcccccatgaggcccaggccccagggagagcaaagctagggtctgggaactcagggtggtgtggggtgggggatatgctggcagacacttctgccgatggcttagaagccagccttcccctccttggcctcatcttccagacctaaaagctgatgagagggtcttggcagcaggaaaggggtgggaaatccctccatgggactcaagtcctcccaccttgcctgctctcacccttcctgaatccctcaagagcagaggacttcaaagaaactaagaggagcttacagcctcatcttatcacttacctgacagaatccctgaggccagagaggagacggaattagaggccccagaaccactcccctttaagtcagtggctgggctgggatagagcccagggccctggagtcccccctgcccacacccactgctgcccgcacccaccccagcccacaccccatcacgaacagaggagatattccctcttcattccaatgcagaatggagtctggacacctaagtttggtttctgcttattcctagtaactcctgctcagactcctgcatgcccagggaggaaggtggaggggcaggaacaggacggacaggccccgggctctggcacatcctggggaacaagggaccacaaggacgggggcagtctccagacttcccctgggcgcttgaccccaggccttgcaggggagagagccagggcctccctcaggttggtggccggaggttgcagacagaggagggtgtggtcaggtctagggtgatgatggcaggaagtggtggcaggtgatggggggcgggggtatggggaggagtggctgcaccaggcagaaaggaatcctgagaaggtcaggctgggtgcccaggctgagaatcctgccctgtcagcagcctgctctggggaagtgttttccttctagcccatcccttcctgcccaccctgactcctgccagcctgcatccacctggctctgcccatgaaccttcagggacacactccaggccagaagcccagggctctcttggtggtttacaaagaatgctgactgcagggatgagaggaacggagggtgtctgggggctgctgtccagaggcctggggagtaaggactcgagggagtgcctctgtcaggaaattacatggttcactcattcctgcctccaggtctttgttcatgctgttttccctgccgtggacaccctttcccgctctctgattctctaaatcctgccccatctcccagatcttgttcatgtccaagcttttccaggaagtcttagcagctcccacaccgcagagctcgagatgtaagctcttgctgcctgacttccctgaccccacacctgggcccaggacctaacacccaaggagaatggcaaagggttttggggtatgagaggatgtttggggtgtgaggaggtctctgggcattagcagtggccaacctgatgctctcaatgtcatgctcttcctccctccccccttctctcccactgcccactccaggtctccctgacttggtcccagaccccaactatgtgcaagcatccacttatgtgcagagagcccacctgtactccctgcgctgtgctgcggaggagaagtgtctggccaggtaaggagctgaggcagaagtgtagagtgttgggatagtccccgggagtcacccagaacccagcctagctgtggctgccagctaggctgtctgcaagctgatgaccctggccaagtgccccagcctcccaggaccctgaccgtttcatcagtgagccttgcctgccccgagggagtcaggaggggaggggagcaagcgggggcccagcatttctgtatactgtacctcactatacaaggaactccacttttactgtggcacttcatctttatatgagccctgaaggcatgggttaccccctcaggaaactgaggagcaatgaaaggaactcaaaccttttggatctgagctgtttaatgagaaggttccttttgggagcccaggcttccagtggtcatacagggacccaaggaagtcctattgggtggatgtacctgcaggatagagcccaggagtatggagccatgtccacagaggacagttgtggctttggctggtccaggctgcctctgcctagtcacagcaggggcagtgagcccgggggacaaagaagtttcagttatatgttgcactggaaagaggggaaggagaccagtttccatgaacctagaaggtgagcacagctggctcgccattattcatgggtgatcctgcctctcgcagtgtttgcttctaatttataagcagttcatattctgctggaacataggtgctttgcggatacctccctgggccaaaataattagttaagattatgttatctgcttcttttgttaatatccctttatgttgaaagcacctatttttcttaattacctgctttttggacatttgaactctctgtttagtttgactttttactatctaggaaactctttagaatctcaacattttctcatttctagaacttctagttcactgccactctaagtagctgatcataaacccttatctgtctgtaacaagataaagagcttgaactagaatgtaactcaactcactccttcattgagaaagtcttgctttaaaaaaagaaaaagtatccgctgaactaagcagagtgattaggaatgttgtcgatgtacattctggtgcaagttcccaatcccatcccagactggcatcagtgtgggaactgcccctggtccagggaccgcaggctgagtaccactcagccagcctgtctgggcagttcttgtcttgtttcagttgtcttggggaagagagcataatggtcctgctggaattcctccagcaatgaggaacttacagcctccatgacagcccttccagtcttaagagaattagtcaaagtcaaactattaacatcactgcctcttcatgaaggatcctgagtgcccggacctgcgctcccagctggggagaggaggcagcctgtcctctgtcctggagggtctcctggtacagctggagagaacagccctcacctgtaccccagtgacagaaccaagacacgagtgggaaaagagccagaaggactggttcacaggccagggctgctggaggtcagaggagggagggatcagcaagggctgaggcctcagaggaggtgggcgtgggagttcagacctggagaatcctgcaaaactggagccctggggcaggagggccctctgagatcatttcaagtatgggccgcaggctggtgccagttcacatgctgcaggcagaacccagagaagaaaagggaccaattccaagtctcaccaccagtttgtggccaagctgggcctagaacctagacccttatggtttcccacggtgtgctgagccgaacagaagggcaggatttaactgaacagagggaaggaggatgttttgtttcaacccagacatagacagattccaagcctcccccagacaaggctgagggcctttcatcctggcagacagtctgagccgcctgttgtccagacattctctcaaagagagcgctaatccctacgactggccaccgctcccctctggccttaggatcggaccttaatgagtgccagggaagagcccctgaggccaacagagttagctgtcagccgtcagctaaagaggggaggggccttcagccaccccttcctgttcctaccacacatgtgtgtgcatgtgtgtgtatgtgtgcatgtgtgtgtgtctcccctcactgcagcccctcgttcctctttccacccttttccttttgtcacaaggcctacctcagttggaaatctggagtcagcaggtgacttgcgagcaggcaattcataccagacccatgttccctgaatggaaaagggcaggttgccagcctgaagccatgcaatcagggagaggtggtctggacccagtgcaagatgtagatggtatcgggctgtgctgcagtcagtgctgttagagctcacaggcaatccggatcctctatgtagagcaatcagggcagacttcctggaggaggggacttttgagttgaccctaggatactgggtgagttttggaattctgggtcaagcaaacagcatgggcaaaagtatgggtcagggaaaaagttcagcctgtttggaaaataggctttgaagcaggaacccagggtgtgtgggggagtggaagggcagatgggactagaaaagtgaagaggctttgaccagaggacttcacgtctgtttttcaggcccacacccaagacatggcatactttggtcaacaattagggctctgtcttgttgtcagagacttatcagaatctcctggataggacttttttttttcttttttttagaaagggggtctcactctgttgcccagactggagtgcagcagcacaattatagctcattgcagcctcaaattcctgggctcaagggatcagtctccaagtagctgggactacaggcataagccaccttacctggctaattttttaattttttaaaaatttctttaattaaattaattttttaaattttaatttctcactatgttgcccaggctggtctcaaactatgggcctcaagtgatcctcctgcctcgacctccaaaaagctctgtaattacaggcatgagccaaagtgcctggcccccgcaatagggctgtttttcagtggcccttcagagattgctatgtgctcctgcacctaggggctgaccccagctgagtcacctgcaggtatcagggacactgccatgcttggtaccgctttagaaagatgctgttggcagctggcggccacatggtggaggccagaaaggaggggacagccaggatttcacggggtcagaagacagaggaagaggcctgagcctccgccacagttcgaggagacagaggagaagatcttcagggacaaggagtggggctgcagaaccagtggccaagggctgggggtggggctgagggggcccatgctgggttctggtgtcactgtgccccaaccccccctcatctcccccgccgtccctgcagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagtgagtggggaggggctgggcccgtcctcttccacttctcctctgggccagggaccttggtgcctgagctcccctcccaccatgagcactctgggagacacagatactggattagagggcccggggaggtgttacctgccaactcttttcactggggcaagtgtttctcagagaagccttagccaaagctaggctggaagatggatatagaaggattggtctcaatcagggatggaaatgtctagaatacagggcattgcccagtgaggccattacaggtgggagcccaaaaaggaagtgaggggtctagagcatgtgctgtcctggagtgacccagctaggtggggagcacagaggggccaccccgcagtactcaggagacaggagaacctagaccagccaggaggctgtgccacagcagggtcacctgagcccatctcaggatggggacaggatgagaggcccagggaagactaggccctcttctttctccttctctcctctgcccctaggcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccaggttgggctggagagatggggtttggggcatgggaggataaggagttggggaggcaaagagcgaggcccgctgaggcccggcaagtgccaaggcttctggccactcagctctgctcacagtgaaggtcttctcaccagtcctcaggctgccacactgccctgcagggactgttccctccctgccccagcccctttcccatgttattccaggtgatctgctcgtggagagaaggaaacatcgcaacagtctggagagcaacacgtcctattggcctgttcacccacccatatccctctttccatcagccaccctaaatatccacaaactgtccatctgtcctgtctctttttatccattctgccatccatctcgtccctcccacctggctattagatatctgtctttcctctggtccatctagccagtggctttaggaaggtgtggacccaccctgagcagttgccctgggccagggtcaggggagaaacccaggggaaggtgggccagaaactcctgaaggtgggcgtggggtggctctgggaaacaagcagcatcacagccgctcctcttgtccctttcccagggcctgagcccaggctgctatgacacctacaatgcggacatcgactgccagtggatcgacataaccgacgtgcagcctgggaactacatcctcaaggtgggcctctgggtctggggctttccctccaacctgatgttcatgtccaatgtccccccgttcctgaaagaagcttcagcctctgggcctgttcccttctccccagctgccgagcagaggcagcatctgaggcatcacttgaggtttaggcttcccagccgaagatttaggtctcaggctgacatagcctctctttccataaagaacccagggaacctttgccccagctgtggtaatgccagaggcagtggtgatactgtctccctaagtgacagaggaccagggagagcaagaaagacttggagagccatgtggtctatcttcctgtcttcggacagggcagactttgtatcatttgggagacagatgagaggccctcagctccttatagggacccctgcaaagccaagggctcctgtgactaagacccttttagcctgaacccctcctgctctaatggacactcactccatcacctcttcccttggttgagggaaaagtagaaaagcatattaacaacacacatccagacttggtacatccgtgtaggccaggttgtcatgggcccacctggggaagccatgtctcagcctcctccacacaggtataaaatgagtagggatcattccaccagttcatctggacccactcagaagcagaaaagcagctcagtaaaggcagagcagtgaagccaggtttgcaggcggaggccttccctgcagaaagtcagcaggtggagagatgcatccggcagcggttctctgcagttccctcctgagtgctcttcagcaggctccaagcttgctcctccagggcctggggttgtccagtatattttttcttttcctcattcatccactcaatcaacatgtaggaagtcccctctgagttctaggcactagacacacaaaccacataagcaatgcagttcacagtccctgccctttgggagtgtaccaggatttgaaagttgcatccctgcatctgttcttagatgttctgcaaataaagctggccctaccctagttaatccaacatttaaaagtgttgtatcccaacagctccttttcagacaaaaagcacagatcatacttgggccatcatctcagtgaatgttgggcacgtggggctccagagcaggggatcagacaggccctcgatcagtcacctagacagggatgcatagggaatgactttgagccttggatttggggagaccaggtgttgaatcctggctcagctcctcattactgcattccctcgggcaggatccaacctctctgaccccaaatgccccatgcggggcccacctggcataggctctagctctagggaaacatccaatcttctgataagggggattagatgatgttttcttggattaccagctgcctcttctttcccctctgtgtctctctagcagtgtgtctctgttctccctctctctgtcacctctctgtctgtctgtctgcctctttaccaccttctctggtgagcagttgaggtgcagcccccctgactagactccctttctccctgtttctcttcttcctcaggtgcacgtgaacccaaagtatattgttttggagtctgacttcaccaacaacgtggtgagatgcaacattcactacacaggtcgctacgtttctgcaacaaactgcaaaattgtccagtaagagtttgcccaccacccttcctggctccgtccctttcctgcctggggagcaggcaaggccacctgagatacctaagatacctgcactttaggtcaccttgatggccgaacgcagctgcagcagggcccatcaaaaagagccttgtccgtgccaaccccaagctgagtgtttacggtggggctcaggccgtagggtgttgatctggggctgcatcctgtggctccctgagatgtcccaagtgaaaaccagcagaaggcagagtcatttgatgcaaggccatgagctctgcagtcccagttccacagcttcctcgctatgtgacattgggttacttccctgagctactttcctcaactataaaataggtatttccacataggctggcaatgaggatctacaggcctgatgtctgcatgttcacagtggcacacagtgaacagcagctgtgatcattagtgtccttttcaagtggactggattaaacagtcacagattagaagtgattctggttcaaaggagccatcttcagtccctaggcccccattgtagaagaagtgcctaaaatctgggcttgggattttggcacatgctgctgggtagggtcctcagtctttctcctgattccccatgtgaagtagtttgcagagggaccccttgcttacaagctcacaaggaaaccccaccacactccagatcgaagcaacccttttccattaaaaaaaaaaaaaaaaattagtcctagagctttcagctttagttcatcaactgggagaaaggtggtagagatcttaaggcccagagaggtatctttccctaaaagtgtgtacttattaatggatggcaggtatgagagattaagcctatgactatggtcagggtgtggtgtatggccagggtcaggattcagtctgtgacaagggttagggctcagtgtgtgacaagggttaggactcaatgtgtgaccaggatcaaggctcagtgtgtgaccaggatcagggttcagtgtatacctagggtcagggcccagtgtgtgaccagggtcagggctcagtctgtgaccagagtcagggcccagtgtgtagccaggctcagggctcagtgtgtgaccaggatcagggctcagtgtgtgaccaggatcagggcttagtgtgtggccagggtcagggctcagtctgtgaccagagccaggctcatttagagacagccctctcacacttggttgctaccatcaacctaactgttcacagcatgctgccaccacatcatgaatattaaaaatgggaacagcagcctccagttcagtgcagagattaggttcctcatgagtagaatgagatcagaattccccagggcacacagcatgtttgaaaggacgaactcctgtcccatcactggcagtttggctctttagcaggcctgggtttccagcacattcctgctcctcagggcctgtcttagccattcaagacccagggtcacctaagtggtagaagccattctagggaaggaggaggaaggaagaagggggtatccaggaaacaaaggaggctgctgggggctcggggaggcagggaatccctcctgctgctgggaaagggggatgggaacagaaacagcatcccacgtgccaggcgcctggagcagccaggagggctgtcggcagggcagatggagaagcagcctgcgcggccctcccagctccccgggggcctgtgggcagcagggggagccaaagcccttccttccaagagctctttacataagtgcttggaaaggccgggccttattagagtgtctcagtctctgtgaccctgaccgcaggcaggcagctgggccagcgtgcacaggaagctggacagagcgttcccagaaaggccacgggactgacgcctgtgggtttccatcgtgtttctggaggaaaaaggaggcttaaaaaaaaaaaagtactgagttagaaaaaacaagaaagtatttccagacagtagcagctctgctaatggcctagaaaacaatctgggactagggcatggggaggggaatgtgctgagactgtgccctgggtgggtgggagtccatcaaacccctccttttggagctgggctgagggggtcggaactttctcttgagggaaatgtaggcccatgcctgccctgccacgagggatctgggctgtgggagggacgccctggctgaggaggccacgggggcctactttgcagcccctcattgacccactgtctttccttcctcagatcctgatctccgggagggacagatggccaatctctccccttccaaagcaggccctgctccccgggcagcctcccgccgaggggcccagcccccaacccacaggcacggaggggcatccctccctgccggcctcagggagcgaacgtggatgaaaaccacagggattccggacgccagaccccattttatacttcacttttctctacagtgttgttttgttgttgttggtttttattttttatactttggccataccacagagctagattgcccaggtctgggctgaataaaacaaggtttttctactctgtggctctgcatgcggcctgctggctggctggccagccacagctagtttgggcctgggggatgtccttaggcatcatccttcccctcgccaaatgtggaaagggcagccaccacccggtcaggaccacagtgaccatgagggcgctgagcccatcgtggaagcctgtggggttgagcccttggccaagcctgtcgcatgggaatgggaccacatccgactaggggagggccctgcagcggggtgggcggcaccagcctgctctccctgctcagcccctgctcctatctgggctcgtgtgcccactgctgccccttctcagccttcagcctcacactcccaccggtccccctcctggccctctcactctcacaccgttcactctccaccagccacccactcccttacaattgcaggctcccgaactcaagtctcctgaaggccaggtgctgtgctagggcacacgcaggagcatcgtagcttctgccctcagggagcgcataaccacagggaacggggagcacgcgttgcccagtgaggcagcacctaggggttctggggagccttcacatgggagagagcctccttccaggcagggaggggagaagaggattcttggcagagagacagcattgagcagagatcatgaggtggggctgcaggccgacagggtgtgagtgggagatggagggaggccccgcagccctgcagcccccgtcccctgccctggctgtggcatcccagaggtcctggacactggaatggaccaggaagaagtgagagggtggtgcctctcctcctcgaggccctgaacaacgagccctcgggatgcctccagacccacctgcttccctgtgggggcaacaccagtgagaaagggaaagagactttgtccaagtaccagggctctgggttccagggccaatcctgctcactgctgtgtgactgtgggcaagtcagacttcatctccgggcctcagtttcctcatgagtaagatgggaatgccctcctgcctggctcccacactgacatggagagttgatgagctactgctgcaggggaggtgccgggggagctacagggtgtcagcacccacccctccagatcttggtgagccccagcccatttgcagaggtcctccaagaaggtgtcccctgcttttggctctgatgcgatccttgcctcagggtccctggtagcaaggaggttttctggtgcagtagagagggagggcttcttggagccatgctatgcatccaggagggttctggcccagtcccctggagcccttgggccactcaccagcccaggcagcagggtggagtgggtgtggctgcagccctccctcggcccttcctctgcaggtctggctgggatttaactctgctgacagggtaggtgccgcagctctgccactctccctctggagctggaccaggacgggtgagaggagtacaggcacatgcctgtcatccagggctgccattctgctgcatcccctgccggtgtgtgcttcccaagatgctgtccttattgcagccccaccccctctccttcctagatactcccaggagtgagcttgggagggggtcagacaaggtcaaccaattccagactgtcaggaggcccgtatgaggtagagacaaaagcccccatttctcaggtcagaaaactgaagcctgtctgagaccacaggcaagttcaaggcagacacagtgctggagctcacgtctctaagccctaggccagggccaaatgccgggtgtgtgcagttttctggggagatctgtaccctcagcagatgagctatggccctgaacacagaattggatggaaggagagagtaagggtggcttttccaaaaagcccacacatcacaaagtgtggggaggtggggagcacacaaggagactcccagacacagtgctcccgcgtgcccatgaacctttggcctgaagttcagattctaggggggctggtggatgtccccaagcctgccatcagagtgaggacacctgggccagtcctcacatgctgggaggactctgagattagatctctggggaggggcttcagatacccctttgccccccaaaaagcagaggaggctttcacccaaaggagaagagagatagagagagaagagagaagacagccgtgacgcgcagggaccagggcagccctcaccgcttcctggctgacctgtcagggccctatcagtgcagcttcacggcactgcccagcagtgacggcccctcgggaaaggagatgcagctgctcccacctcagggggcagggtttcctcaggtattttgactccatgtagaatggcagagtctccctgagaatggggagagaaaaactgtcaagacggcaggggcccagcaggcgctgagctgaggagggcggctgggagaggagtgctctcccagctcggcctcagcctcttgaggtctgtctggctgtcactgcatggaggaacagcctgcttgttccttgttcttgctgtcacctggctcgggcccctccctagatagagctcacctgttgggctcaccccaccaagccaggcccagggaggggtgtgtgaggcccactggaggccaggtcacgtgacgcagggactcaggcccactggtcccttcacccttccgtttgccccttcaaggccagctgaaaccccgatttctcgaagccttccttaaccatcccctctccccttcaactggggtgcactgtgtggcctcattcaggactctcccacccccaccctgccacggacacacaggggcatgggaggaggcacccgagccttgcatgctggacaaaggttacataggtgccatctcagccaggtgcagtggctcacgcctgtaattccagcgctgtgggaggtcgaggcgggcagatcacttggggtcaggagttcgagaccaactggccaacacggcaaaaccccatctctgctaaaaatacaaaaattagccaggcatggtggcacgcgcctgtaatcccagctattcgggaggctgaggcaggagaatcgcttgaacccaggaggcgaaggttgcagtgagccaagattgtgccactgcactccagcctgggcgatagagtaagactctacctcaaaaaaaaaaaaaaaagaaaagcaaaacaacaacaacaaaaaaaccataggtgccatcttcactcctgacccagcacctccttctgggctgcacagaccaagagggtctctgctggtacactgggcactggtgtgcaggaatccacctgggctgtaagggcctcaagtcacctgcccagcatccctccctgtcctcttcttgctcagccccagggctggggagctcactgcttctcgagacatttgctgttagaaacaccttgaggtgaaacagacccccaccccctgccccgcagccttcccttgggctggtcctcggggtctactaagtaaatgactctggtggatgtgactggacagcaggaaggacagagacagcagaggcgacacctggcagggggcacagctgtggccctgactctgtccttcagtgggcctcagtctccctatctgtcctgagggggctgagtgtcttgctagtccttacctggcagagaagaaggggcaggggaagagaagagagggaggggaggaaatgggaggtagaaggaggctgggtagggagtgataggcaaagtccagcctgggggaaggtgggcaagcagcagggggactgcctcagaaggggagcagggagccagcagaggcactgctagggctgcagcctggtgagggctggggcgttatctggcttggaggatgccacagagagaggcctgaagtgggggtactggacctcaaaccagggctggcctgaaacccttggaagggcctgctaatagagacagaggtgccctgggcccttggcagggcggggtgggctctgaaagccagcccagacctgacccctctgcggcctaccatcttggccacagccttgaccttctccctccccctgcacctcagatgcccacaccccctgtgcattacactgtgcgctcccacccagggcagcagccccctgcagggagggcccaggctaaaatcccacccattctgtttcctctccttccactagaatcccacctgttttgagaagttggcagggcctgtgttagggaagcacctgataaccaacgtgagaatggtggcgctggtcccatgtcctgtctcacttttagatgaagagcttcttcatcctcaaaaaaaatgactcagaagagagccctttaatagactgctcggctaggggtggagggctcgtaaggatatttacagatccttgaaaacagagcttccagcatttaaccctgaagagagctggagcctgggccccaactccttaccccacctgagcctcctctctgcactggaggcctctgagcctgactccgcgcaccccacgctggcccacaagccaaggctccttctgatgccccctgaggctgctggcattggccagggctccatcagcacctccttgggtgggggggattaccgctttccctacttactccagccttggttagggggcccatttcccagctcctgccaggctctccacccatttgtggtcaaggcaagagagaccacacccccttgaatgtccaggcactgagtccctgccggctactcatacggatgggccctccccagccattcctcaccacggctgcgtccggatccacaccacaaccacagcattgttggaaagcaactgcacacctccctgcaacttcccctcgcatcccccagactgagtcatgcaggcggtgcccgtgggcagacctggccagggttggcaccagctggccagagagaatgagaggcactgaccacacccaggaacctcgctaaagcccatgcataagggtcaggagagcagccagatgctgggacccaagggtgcctgtgacacacaccaccctgaaagttgcagctgagcttttctgagaaggatggcaaagtcctggaaaagctttaacgacaaaactcaacatatggaaggcagaggaagcaggtaaggattctggtctccttttatgtgaaatagctttaaaaaaaactttttcaaaatcacgtttaatatgcgttgagccccctggctaccaggtgggaaagtcaaagtcctgaatcatttactcccaccctagacaccttgaacttcagaacttcagagaggagtcctgtggtctttagtcctcctggtcaccgctccctggctgattcactctcctccaggggcggtgtctccacttcctgcaaagcttgggcacatgggcagccatgtccctcgaggttcgccacctccccagggcactgccaggaggcactgtcctcgttactagcagagccagagccaccaccacaaccatagccaccacctccccagcccagggaactctcccagcctctttcctcggcctgtcttcactcccttctaactactcactcttttcctcttcctctctggggcaaccttccatcatccctgccatgtgccttggttcaaggaatcagctttggattctggcccttaagatgaggagtcacaagtacctcctaggaatgagaaagaggaaaagacctagcaggggaatgccaataatattagtgacactcactaatttcttcaacacttagccatgggccaggccctgctctaaatgctctacaaaggttaagcccatttaatcctcacaagaactctatgagggagacactgtcattcccattttgtagatggacaaactgaggcacagagaagtcatgtgacttgccctagttccgtcagctagtgaatgggagagccagaattccaacacaggcacatttctggagacagggcataggttcctccagatcctcaaaggcatgtgggaccaggaaagaagccataggtctgtgctctgaaacatggcaagaacactgttcaaaccatcccatcatctccttcctccacgagtcctctagaatcatgtgtggctcctggaaaccgcagcttgaaaaggattggtgagaagcctaattcctcctagaagtagtgtggtagtgtaattcagacttagattgttctttatgggtgagagagagggcaaattacaatagataaactggctgggtgccgtggctcatgcctgtaatctcagcactttgggagcctgaggtgggtggatcgtttgagcccaggagtctgagatcagcctgggaaacatggtgaaaccctgtctctacaaaatacacaaaaattagcggggcttggtggtgcacgcctatagtctcagctatctgggaggctgaggtgggaggattgcttgagctcaggaagtggaggttgcagtgagttgagattgtgctgccgtactccagcctgggcaacagagtgaagccctgtctcaaaaataaataaataaatcatcggctagtcaacaaaatattaatagaaaaatatgggattagaagggataagaacacagccatggagatgacttttgaaattgaagaaactagtgcatgcttataaattggagtgtcccaacattaaataataattttctagtatttctaaattgccaaaattgactcgagtgaaaagcacaaaaagaccaattaccacagaagaaaatttaaaaattatcatctctaagaaagacaccagccctagggagttttagcatgagttatttcaaactggaagaacagtgaatttctgtgttatgtaaactcttccagagcatatggggaaaatgctgaattgattttatgcttctgaattgattttattaagctaatcctaacaccaaactctgataaagattgctatcctgcgccacccaccctcacgctgataaccacagaccaattttactcctggctgtgaatacagaagtcctggataaaatgccaccagtggaatcctgtaccattgtaataccagatgcagcccgtgtttggcatgctttcccctccaccagatgtgtgctagggcaaaactggaacctgatatctgggtccaggcaatttggacacaacattcacttctgtggtcctaagcgccccctctcaggaagcaaagagtaaaatgaagcaggtgtccaaagcttgcaaatatgcagaaaggctacagcttggattactgctgttgactggcaacatagttaaccacaatatcctgttagagtgatcattcatcatttcttttttttgtttgttttgagactgagtctctttctgtcgccaggctagagtgcagtggcgctgtctcgactcagtgcaacctccatctcccgggttcaagcaattctcctgcctcagccttctgagtagctgggactacaggtgcctgctgccatgcccagctaatttttttatttttagtagagatggggcttcaccatgttggccaggctggtctcaaactcctgacctcaaatgatccactcgcctcggcctcccaaggtgctgggattacaggtgtgaaccatcatgcccggctgttatttcttttccttgctgagaagttcttaagtattttttgtgctttttttcctttttatggtaggtggctaccttctctaccttttccctgcagggtttgataacatgattgaataagcaagtcctaataaatgccctctttgctgtatcaacatgcatacccccgaaaacttgggaaacagtgcctgtcgtgccctgggaaaccgaatcctgggcccaagggacatgatccagctggtagtgcccctgtgccaggtgagaaaaagagaccttgccctctgctggagttgcagcagcctgggagcttctcagccagggaacagatcatcgctgcagctggaggacaccctatttcagatatgtgacatcagaggccatctcatttctgattcacagccattgccccttccacttcttcacaaaaattcaagtatattaagaaatacatatttttttgagacgaggtctcactctgtcgcccaggctggagtgcagatcatggctcactgcagcctcgacctccttgggctcaggcaatcctcccacctcagcctcccaagtggctggaactagaggcacgtgtcaccatgcctggctaattttatttatttattttttgtatttttttgcggagacagggtttcgccatgttgcccagtctggtctcaaacttctgagctcaagtaatcctcctgcctctgcctcccaaaatgctgggattacaggcatgagccacagtgtctggcaaagaaataatctgcatacagcaaaatttaccctttttaggtgaacagtttgatgagttttgacaaatatatgcagtgatataaatacccccacagtgaagatgtaatacctccatcactcaggacttccctcttgcctctttgtgctccgttttctacctcccacctccagcccccggcaaccactaagctgttttctgtttctgtagttttgtcttttccagaatctcaaatatgtggaaccacatagtatgtggccttctatatctggcttgcttcacttaacataatgcttttttaatttaaattttatttttatttatttatttttgagactgagtctcactttgtggcccaggctggaatgcagtggcgtgatcttggctcactgcaacctccgcctgccaggttcaagcaattctcctgtctcagcctcccaagtagctgggattacaggcacacaccaccatgcctggctaattttttatatttttagtagaggcggggtttcgccatgctggccagtctggtctccaaatcctgaccttgtgatctgcctgccttggcctctcaaagtgctaggattacaggcaggagccaccgtgccaggcctatttttcatttttgagacagtctcaccctgttgcccaggctgaagtgcagtggtgcaatcttagctcactgcaacctctgtctcccgggttcaaacgattctcctacctcagcctcctgagtagctgagattacaggtgcccaccaccacgcctggctaatttctgtatttttagcagagacaggttttctccacgtttgccaggctggtctctcaagtgatccgcccacctcggcctccaaagtactgggattagaggcatgggcctctgcacccggcctaatcttatttttaattgtaaactgacaaataacagttgtatctatggagtatgaagtgatgttatgatgtattaatatgatgttgaataatcaaactgagctaattaacatatccatcacctcaaatactgttcttattttttgtagtaagaacatttggaatttattctgttgataattttgaaatgtacattatttaagatatttgaccaggggtggtggcacatgcctgtaatccaaacactttgggaggccaaggcaggcggatcacttgagctcaggagttcaagaccagcctgggcaacatggtgaaacactgtctctacaaaaaacacaacaattagctagggatggtggtgggcacttgtagtcccagctgctcagaaggcagggatgggaggatcacctgagcccaggagtttgaggctgtagtgaattatggtctagccactgcactccaacttgggtgacagagggagatcttgtctgaaaacaaaaaacaaaaacaaagtggctacatgctcaccagacacattatatcctctttttttttttttttttttttttttttttttttttttttttttgagacggagtctcactctgttgccaggcttgagtacagtggtgcaatctcggctcagtgcaacttctgccccctgggttcaagcgattctcctgcctcagcttcccaagtagctaggactacagacacgtgccaccacacctggctagtttttgtatttttagtagagacagggtttcaccatgttggccaggatggtctcaatctcttgacctcgtgatccgcctgcctcaatctcccaaaatgctgggattacaggcatgagccactgtgcctggcctgtatcctctttttaaaagccattctagtaggtatcctgtggcagtcatctttccatattcctggggactgattccaggactcctgaaaataggaaaccccgggcatgctcaagtccctgatataaaatagtgcagcgtttgcatataacccaggcacataacccgctctactttaatttatctctagattacttatgatccctaatataatttaaatgctatgtaaatcgttgttatgctgtattgtttttatttgtattgtttttattgttgtattgttatttttttcaatattttttatctgtgtgttcactgtgcagttggttgaatccgtggatgtggaacccgtagataccgagggctgactgtatttcattctggtttaaattttcatttccctagtgactaacaatgttgagcatgtgttcatgtggttgtttgccaggatatctcttctttgatgaaatttctgttcagatcctttgcccatttttaattggcttgtttgtctcattattgagttggaagaattctttatctattctggatacaagttattcatcagtgatatgttttgcaaatattttttcccaatctgtcgtttgtcttctcattttttactagtaccttctaaagagcggaagtttttaattttgataagagccaatttatcggttttttttccttttatgggctgtgttttttgtcctatctaaatcttaacttaaacaatgtcacaaagattttctgtaagcactgcaataaatggtatcccatgagtttttaggactaagttctaatttttgattttgcccaaatttctatctaagggatctagggagtcatgccctacaaatcctaaattctcatcagatgggttttatttatatattgtgacttacttttcaatctgactctggtataacattacgagacaaggaaaaaatatttaaccccaaaatatatttccctgccatagcttgaaattgccctgcaagtctcttgtgggaaaaatccacattctatagagaatccccttgcccctttgttttccttccttcctttccagatccaggagataatcaactaagagccaggcactcttttaggtctaataagaaacattttacaacctgctctctctctcctctctgtctgaagtctgctatctgagagattcctctgcacaataaaacttggtttccacaatcctttattttaacctgaacatttcctttctattgatcccagatcttcagacaaactcaaccaattgtcaaccagaaaatgtttaaatttacctatagcctggaagtccccactttgagttgtccctcctttctgaaccaaaccaatgtatttcttaaatgtatttgactgatgtctcatgcttcctaaaatatataaaactaagctgcaccccgaccatcttgggcacatgttcacatgttctcaggagcttcggagggctgtgtcacgggccatggtcactcatatttggcttagaataaatctcctaaaatattttacagagttcgactcttttcatcgacagtgttgatatgttgtatttttatttccattagaatatttctaattatcctcatggtttcttctttgaaccataagttatctaaaagtgtgttgtttgatttccaaacatttggggactttccagatatctttctgttactgatttatagtttaatttcattatggtgagaaaacatactttgtatgatttcaattatttttaatttgttaagatttgctttatggcccagaatatggtctatcttgctaaagttccatgggcactcaaaaagaatgtgtattctgctgttgttgtgcgaaatgtcctataaatgtcaatcagattgttggttattagtgttattcaagttacccatacccagcctgattttctgtgtactcgctctaccaaatattgagagaagagtggatgtgtctatttctcctttcagctctaacggtctcgattgcatgtaccctgactgtgttctccagtgcacatgcatggacagttatgatgtcctcttgatgaatcaacccctttatatacagtccttctttattcctggaaatattctctgtttctgcttcatctgacattaatatagacacttgagctttctttggattagtgtttgcatggcatgccttttttccattcctttggttttaggctatctaggtctttattattattttttatttcttttgagacagagtctcgctctgttgcccaggctgaagtgcaatggcgtgatctcagctcactgcaacctccacctcccgagttcaagcgattctcgtgcctcggcctcccaagtggttgggattacaggcatgtgccaccacatccgactaatttttgtatttttagtagagatggggtttcaccatgttggccaggctggtctcgaactcctgacctcaggagatcagcccgcctaggcctcccaaagtgctgggattacaggtgtgagccaccgccccagccctaggtttttatatttaaagtgtgtttctcacagacagcctgagggtcccggaaattttctggaagttgcggctccaccctcagctctcagcaacccctgctcgcctgcactacctaggggatgcgtggtcttgccctcctcctggtggtaaatgtctctgtgtgctcttgcccgccccctggtggtaaatgccgttgctgctactcttggttgggctagtagtggaggcagtttgtggacgtgtgttaaagggtttccggacggtgggatgttgctccattctcctggcccagcctccgcagagcctgtgtactagggtctcagaaggtggagtcttcgaagtgctcctgtccctcctgtcgtgccttctatctcctgtgggtttaacacaggagagtgcgtcctgcgcctcccacaggggcaagtggtgtttactttgatcctgccccagaagcagtggatcttcgtttctgcctctcccgcagcagccctggggccagagagtgcagcctcccacgtggttttgcccagagagaatcgtcctggggaagcaggtgggggtcgctgcacagcagtcaatcaccgcttgagtgcttgtgccaccagcaagggggaggggtctctcccggctccccctctgcctccagtctttttcctgcagtgaaggcctgtgcaaaaagctcagaaggcagggcagactccctcctgcccaccacatgctctgcccaagacagttggtcttgcctttccttggaggggcttgtcactctttggaattcagttctcttggttgcctgccacctcagctatctgactggtttaagaaattatggttttgcaaattatctggtgttttgttattgttagagtcggggggcggggtggttcattcctgtactcccagcactttcgggggtgaggtgggtggaccctttgagccctggagttcaagaccagccagcctgagcaacatggggaaaccctgtctctacaaaaaaaaaaaaaaaaaaaaaaaaaaaattagccagacatggcgacaggagcctgtagtcccagctactcaggaggctgaggtgggatgatcactggagcccccccagaaaagaatgggaatgatgttcccttgtggtttttctatatcctaagaggaaataaaacactcttctctttcacttttaacatatgcaaatgagtgactctaaatgccttctagggcaatgtctcatggcttacagtgcctcgtggtttttctcatttctttcatgattgcagctgtatttgctaccacttgtgcagctgacatttaccaagcccttactgtgttccagcatgctttcatttagaaccatccctgactcctcttttctctcaaacccacgttcaatttgtcagataatcctgttggccccatgttcaaaatataaccagttcctttcaaaaataaaaatggacttatcataaaacccggcaattgcactgtcatgcatttttcccagagaaatgaaaacttattttcatggtggaacttgtacacaaatgttcatagaagctttatttataatagccctaaaccagaaaatactcacaaactatggtatattcataccacaggatactattctgctgtagaaggaatgaactattggtacaagcaacaacttggatgaacttttgctgagtgaaaaagccagcctcaaaaggatacatcactgcatgattctatttacacggcaaataatataattagagagggaatagactagtggttgtcaggagttaggaatgtgtattagtccgttctcctctttctataaagaaatacctgagactgggtaatttataaagacaaaaggtttaattggctcatggttctgcagtctgtacaggaagcgtggtggcttcagcttctggggaggcctcagggaacttacaaccatggggagggcaaaggaggaggcaggcaccacttacatggccagagcaggaggaaaagagatgggaggtgctacacacttttgaacaactagatctcatggtgctaatccattcatgagaactccacccggtttggtggggacccagatcagtaccatatcagaagggaggggagggtgtggctgtaaaggggttacacgagaggctttgtggtgatggtacagttgagcacctcggtcattctggtggctactccaggctacacatagggcaaatttacatagagctactttgtggttggctgggtgcgacggctcacatctgtaattccagcactttgggaggctgaggtggggggatgacgaggtcaggaggtcgagaccaacctggccaacacggtgaaaccccgtctctactaaaaatacaaaaattagccgggtgtggcagtgtgtgcctgtaatcccagctactcaggaggctgaggcagaagaattgctttaacccgggaggaggaggttgcagtgagccaagattgtgccactgcacttcagcctgaaaacagagtgagactctgtctcaaaaaaaaaaaaaaaaaaaagcttttttgtggtctttgtgctgataccaaataagtggtatcatttccaacaccaatcgattttctgcttctgtgataccaattgggtgttcaataattcaattctattctgatactaacctggagttagtgtcagactccacaggctgaagggctcagtcccataagactacccccatttctcccaggcgcagtggctcacacctgtaatcccagcactttgggaggctgaggcgggcggatcacctgaggtcaggagttcgagaccagcctggccaacatggtgaaaccctgtctctactaaaaatacaaaaattagccaggcctggtggcgggcacctgtaatcccagctactcgggaggctgaggcagaagaattgcttgaacccaggaggtggaggttgcagtgagctgaggtcacgccattgcactccagcctgggcaacaagagtgaaactccatctcaaaaaaaaaaaaaatggctgggtgtggtggctcatgcctgtaatcccagaactttgggaagccgaggcaggcggatcacctgaggtcaggagttcgagtccagcctggccaacatggtgaaacctcatctctactaaaagtacaaaaattagccaggagtggtggcgagtgcctgtaatcccagctacttggggggctgagacaggataattgcttgaacccagaggcggaggttgtgtgagccgagatcgtgccactgcactccagcctgggtgacagagtgagactcgatgtctccaaaaaaacaaaacaaaacaaaacaaaactacccccatttcacatgccagtcacaagtactgggtccccaggttacccacacttctgtccagccaactacaaatttggaggttcccgtgacctccattcctcaggtttgataatttgctagaatggctcacagaactcaaaaaaacacattacttcaccattactggtctattgtaaaagatacaactcaggaacagccaagtgaagagatgcataggactgggtattgtagggtgggtgtgcagagcctccctgcctgctctgggcgtcacccctccagcatctccatgtgttccaacccagaagctctccaaactccattgttttggaactttatgaaggttccattacagaggcatgattgatgaaatcattggtcattggtgactgaactccatccctagccactgtccactccctggaggtcagagagtgaggctgaaagttccaactctctcatcatcaatcatggcttagtctttctgatcagcagcctgtatccagaaactatttagggtcctcattaacataagctcaggtatggttgaaaggggtttgttatgaataacaaaacatcactgtaactcaggaaattttaggagggttttaaaagatctgtgccaagaaccagggacaaaggccaactctatttttctcactatatacatgatttcccatttcctacaggcacacacaaacacacacacaaatgggtgcgtgcataactggttagatctgaataaactcaatggattgtgccgatgttccatttcttcgttttgatactgtactctggttatgtgagttgttcgcatgagaggtagggaacatgggacttctctctacattcctttgtgaccttctgtgaccctacaattatttcaaaattaacaacttagaatacaaataaccagagtccacctcccgccctgctaccagcctggtccacaccactctcttttcttgcctggattattgcaacagccgctttttttttttttttttttttttttttttttttttttttgagatggagtcttggaacagtttcttaatgggtctgcttttacatacaatctattctcaataaagcagcttcgtaagacagatcctaccatttgtagaaataaacaaaaaccattcagagcttgctgtagcaaggttgtcagccagcatcacttgcatttttgtagggactcaaaatcaggctgagccttattgtcggtgggccgggggtaggggtgcgggaaaggaggtgggggaaggcttggggtgtgccctgattggaggctattggcctggagaagctgggtgggataatttggaggggattctgagattggctggggaggggtgggtgcatatttggctttctcttgctggccctaagttggaagctgggacaaaaattagggaagctgccagtttttaatcaagtcctggcctttcggggctgattgttagagaagttattgttttgcttcctggatggctactggagatagtgatctggcttccttcatgtctgacttatagcagactggcatcctgggctgtggattccagatgagggggttggtttcctgggcagcttgctgcaggttaggctcagagttctagtttccacagggtctggccatggtgcacgtgtatgttcagtccctcatgttcctctgcttagaaccctgcaggggctcccactgaacacagcccttcctgtggcctaccaggccctacatgagctggccccatttcccctctggcctggtcttctgccactctcctccctctctccatcccagccacaatggcctccttgctgttctagaacatgccaggccctctcccaaggcattcatggccttctaacatactgtatgcctttcttatttttctctctctctctgtttctcactctctctctctctatatatatatatgtatatacgtacgtatatacctatatgtatatacatatacacacacacacacacacacatatatatatgtgtgtgagacagagactcactctgttgcccaggcttggagtgcagtggtgtggtcctagctcactgcagcctcaaactcccgggctcaagctatcctcccacctcagcctcccaaagagctgggattacaagcaggagtcaatgcacccggcctcctttctgatttttaatgcttattgcttatgtctagctctcacaactagaatgtaaattccacaaggacagggttcttggtgggtttgttccctactatatccttggcacctagaacattgccttgcccagcacatagtgagtgcccaataaaaaatgtttgagtgaatcaatgagtttgtgcgtacatgtgtgcagatacatttactaacatctactacttctaattaggtgctcagtgtttactagacactatgctaagtgctttcatctagtatctaatttttattcttcatagctttcctatgggtaggtgacatcaggccacttatctttcaggtaaagtggtctcagaggacatgctgaaagcccatgagcttctcagggacctaaataaatgtttaaaacctgagaaaagtcttggctccaaaatgtaaaaactacagaatcatccaaattaataaatgtttaatcaaatgtctacaaagtgtcatcgattgttaatttatgtcattaattctctattggcctctttaattattaaatgcagtgttcataagaatttcattacttttgaaaagaatttgtagactagatgttaactcttggagcacagtcatgtatctgttaaccacaggaataccatcagaaaaatgtgtcattaggtgatttcaatgttgtacaaacatcagagagtgtccttacacactctgtgatgtgtagcctgctacacacttaggctataagagatagactattgctcctaggctacaaacctgtacagcacgtgactgtaccgaatactgtaggcaattataatacaataataagtatttgtgtatctaaacatagctaaacatagaaaaggcacagtaaaaatatcatataaaatatttaaaatgtacacctgtttagggtacttaccatgaatggagcttgcaggactggaagttgctctgggtgagtccgtgagtgagtggtgaatgaatgtggaggcctaggacaatactgtacactactgtagactttaaagacactgtcacctaggctactacactaagtttattaaaaatattattctttggcagggcgcggtggctcacgcctgtaatccctgcactttgggaggccgaggtgggtgaatcacctgaggtcaggggctcgagacctgcctggtcaacatggtgaaaccccatctctactaaaaatacaaaaaattagccaggcatggtggtgggcacctgtaatcccagctaccagggagactgaggcaagagaatcacttgaacctgagaggcggaggttgtagtgagccgagattgtgccattgcactccagtctaggcaacaagagcaaaactctgtctcaaaaaaaaagtttttcttcagtaataaattagccttagctttctacaactttatgaactttaaaattttttttaaactttttgactttttataataacacttagcttaaaacacaaacacattatgcagctatacaaaaatattttctttttttgtatccttattctataaactttttatttttcaattattttatttttacttttaaaacctttttgttaaaaactaagacacaaatacacacattagcctaaacctacatagggtcaggaccatcaatatcactgtcttgcacctctacaccttgtcccactggaagttcttcataggcaacaacacgcatggagctgtcacctgctattgcaacaatgctttttttctttttttttttttgagacagagtcttactctgtcgcccaggctggagtgcagtggcacgatctcagctcactgcagcctccacctccaaggttcaagggatcctcaagcctcagcctcccaagtagccgggagtacaggcacgcgctaccatgcccagcgacggggtttcgccgtattggccaagctggtctcgaactcctgacctcaggtgatccacctgcctcggcctcccaaagtgctgggattacaggcgtgagccaccacgcccagcggacaatgctttcttctgcaatctctcctaaaggacctgcctgaggcacttcttgaagaagtgtccgtcttttcagaagtatgtccatggtggtttgccaagtttgtttctttcttccgtcatagatttgcatgagtaatgctttgtgtcagctaaaatgttacatcggctatgacgtcactaggtgataggaatttgtcagctccattataatcctatgggaccgccatcggatacgcagcccatcactgacctgagacgtcgttatttagggtgtgactgtactttaagaatgcaaatgaatacccagggagggctgagaacgcgtaggtaattacaccataaatgaattactcttagccaagtaatttccaaggcaaacatacaaaaatcacctcgtgttacctgacagtgctatgttatatttaacgtaagaaatctgtgtattttaatatttaataaggtgtgggaaggaacttccaaaggtaatagcatctggtcctagcaaggtcttaaaacgccgtttgatttcagaatgcctcattttgtagatttaatccagaatctgcagtttctggcgacgcagtagtccgtctcccccagtttctcctggccaaagcctcccaccttcctctctacccccacaaccctgtcaagcgcacctggaccaggtacaacaggggtgtgtgtgtgagtgtgagtgtgtgtgtgaatgcatttgggaaaggctaggcagggtgaatattccctagaccccgctcttcaccgtcactctactacagcagctcactgccctgccccgcccctccccggccctggaaagcagcctctggaaagaggaaaccagctatctcccgtgttgccacaagatggcaccacaagctcgggactggctttctttgcgttcccgtcagaaaaaaacgagagctctgacctaggagccgaggctcccagggagacctctggacgccactccccgggctgcttctcctcctcggggtgactcgggccctctggagtgacctgcatagctttgtggttcgggctcccatggggcccagaagccagcatggagacttagggcttctcttgggccacttttctcctcatacccagcatgcagaccaaggttggggatgaattctgaacgtggggcagagtccctgtccccagagcaactctgagagcaccttgcccttcttcccagggcacaggcaccagccttcctccccagctcagtccctgcttctttctaagacaggttcttgctctgtcgcccaggctggagtgcagtggtgcaattatggctcactgcagcctcgacctcctcctggtgagaggtgacagcgcgcctgcagccctcgctctcggcgcctcctcggccttggtgcccactctggccgcgcttgaggagcccttcagcccactgctgcactgtgggagcccctttctgggctggccaaggctggagccggctcccttagcttgcggggaggtgtggagggagagccgcgggcgggaaccggggctgcgcgcggcacttgctggccagcgcgagttccgggtgggcgtgggctccgcgggccccgcactcggtgcggccggccggccggcccgcaagccccgggcagtgagggtcttagcacctgggccagcagctgctgtgctcgatttctcgccaggccttagctgccttcccgcggggcagggctcaagacctgcagcccgccatgcctgagcctccccccagctccgtgggctcctgtgcggcccaagcctccgcgatgagcgccgccccctgctccatggagcccaatcccatcgaccacccaagaactgaggagtgcaggcacacggcgcgggactggcaggcagttccacctgcagcccccgtgtgggatccactgggtgaagccagctgggctcctgagtctgttggggacttggagaacctttatgtctagctaagggattgtaaatacaccaatcggcagtctgtatctagctcaaggtttgtaaacacaccaatcagcaccctgtgtctagctcagggtttgtgaatgcaccaattgacactctgtatctacctactctgctggggacttggagaacttttgtgtctacactctgtatctaactaatctagtggggacatggagaactttcgtgcctagctcagggattgtaaacgcaccaatcagcaccctgtcaaaatggaccaatcagctctctgtaaaatgggccaatcggctctctgtaaaatggaccaatcagcaggatgtgggtggggccagataagagaataaaagcaggcttgcccaagctggcagtgacaactcgctgaggcccagtttacgttggcgaagctttgttctttcactctttgcgataaatcttgttgttgttcaccgtttgggtccgcgctgcctttatgagccgtaacactcaaccgcgaaagtctgtagcttcactcctgaagctagcgagaccacgaacccaccgggaagaagaaaaaactccagacgcaccgccttcagagctgtaacactcactgggaaggtctgtggtttcagtcctgagcccgtgagaccacagaccgaccagtgggaagaaattccgcacacatctgaacatcaaaagtaacagactctggataggccgcgtttaaaaactataacacttaccacgagcatccgtggcttcattcttgaagttagtgagaccgagaacccattaattcccgaaacacactgggcgcaaatcttcccttctcagttttccaagtagctgggactacaggcgccaaccaccatgcctggctaattttttttgtatttttagtagagatggggtttcactgtgttaaccaagatggtctcaatctgacctcgtgattcacccgcctcggattcccaaagtgctgggcttacaggtgtgagcccgcacacctggccaccagttatttttcaattgttctgtttccctgttcttgccttactaagaaagtaattttgaaatgaccgatccgttctttgttttttgtttctggtttcttcagcttattctgtctgtaaaacctgcgtcctctgctccgctccatgaagacgctcattctgttttatagaagttagtaagtgtgatatatctattctttgtttttgtctatagttcctggctgacagcccatataatcattgtaatttcctaggagactagagtgtgataagagtatctttccttaaaatatttggcctttcatcctttgttcttgaaacagctctggagcagctccagagtaagcataaaggtgaaagatgggccgggcggagtggctcacgtttgtaatcccggcactttgggaggccaaggtggcagataacgaggtcaggagttcgagaccagcctgaccaacatggtgaaaccctgtctctactaaaaatacaaaaattaggtgggcatggtggtgcatacctgtaatcccagctgctcaggaggctgaggaggagaattgcatgaactcgggaggcagaggttgcagtgagctgagatcgccactgcactccagcctgggcaacagagcgaaactccatctcaaaaaaaaaaaaaaaaaagtgaaagtcgggcttgttgtttggagccacaactgagcttaacgtttataaccacaggatggatggctgcttgccaggggatccaaccgtctgctcagagccccaccctccacattcggggaggagagaggaaccgaaggttgatcaccaatggccagtgatgtaattgatcatgcctacataatgaaatcgccataaaaacccgtaacgactgagttcaggggtttcccaggaaggtggtcttgtatggaagattttgtattcggggatggaagcttttgtatttgaggcccttccagagtgtgccccgtttatgtcttcatctggcttttcatttgtatcctttaaaatatgctttatgataaactgctaaacgtaagcaaatgcttccctgcattctgtgaggtgctctagcaaattaatcaaacccaagaagagggtcatgagaatcctgatttatagccagttggccagaagtacaggtaatacaacctggggcttgtaattggcactggaagtgggggacggtcttgtgggactgggatctgacgctatctccaggtagatagtgttggaattgaattaagaacacccagctggtggccactgcagaactggctccttgcttgatatgggggggtgggggaaccccacacatgtggtatcagaagtgtgtttctggagtatagtaggagaaattgagtttgttttctgctcatacacagagaaacaaaatcactaaagagcaacaaattgtattctgttcagataatatagtggaagaaatattccacttatagtagtaccaaaaaggataaagtacttaagaataaatgttcagacgatataaaggacatttcaaaacttctaaaggacacaaaagacatcaaaacacaccatgttcaaggataggaagactcaatatcataaagattgtcattttcttttttttttttttgagatggagtctcgctctgttgctgggctgggtggagtgcagtgactcaatctcggctcactgcaacctccaactcccggatgcaagcgattctcctgcctcagcctctcaagtagctgggactacaggtgcatgccaccacgcccagctaattttcgtatttttagtaaagacggagttttacccatgttggccagaatggtctcaatctcttaacctcgtgatccacctgcctcagcctcccaaagtgctgggattacaggcctgggccaccatgcttggccaaagattacaattttctatgagttacttgacacatttaatataatcccaataaagatacaatattctttttaaaaaactacaccaggtcattctaaagttcattgaaaaaacaaacactagtcagataaagacactgacagtattctttttaaaaaactacaccaggtaattctaaagttcattgaaaaaacaaacactagtcagccatggtaagtggcttgcatctgtagtcccagctacttgggaggccaaggtaggaggatcacttgaacccaggaatttgaggctgcagtaagctatgatcacacctgtgaatagccactacactccagcctgggcaacatagcaagactctgtctcttaaaacaaaaaaaggcagaaggtctttcttaagaagcattaaaaagaattcctcctatagatatttaacattttatggcaccccaataattaaagtggtcctagagaatggataaacattagcccaatggaacagagcagaaagccccactatagacctcaacacaaaaaattcatggtgttgaaaaaagggggatcaatattttatactttatacttatttaaattccaaatgagtttacaattttacaagtaaaaaataaaagagaatacattaaattctgttatgatctcagaatggaggttttttttacttatgactcaaaatccagaagtcataaaatatttatcaattcaaatacatttttaaaatttcatgagaaaacattataagcaaagacaaaatgcaaaccaacaaattgggtgaaaaatttacagctcatatcaaaaatggctaatcttcctaatatttaaagagctcccaaatgtcaaaaacagaaatagaaacaaccagcactagaaaaatgaacaaagtagataaaataacagtttgtagaaaaggagacacatggctcttaaacatattagaagatgctcaacctcactcaaaataacacaaaagcaaatgaaaaggtttctaggtaattcaatggggaaaagatacctttaaacaaaaagtgctggaacgattggatatcaccatgaaaaaaaagaacgtcaacttttacttcacaccatatacaaaaattaattcgaaaatggatcacaggtcaggcaaggtgtctcatgcctataattccagcactttgagaggccaaggcaggtatataacttgagctcaggtgtttgagaccagcctgggcaatgtggcaaaaccctgtttctacaaaaaatataaaaattagccaggtttggtaatgtatacctataatgccaactacttgggaggctgagtggggaggattgcttgagcccaggaggttgaggctgcagtgagccaggattgtgcctctgcactcagcctaggcaacgtatggagagtctctctctctcttttttctttctttcttcttcttttaagagatcaggtcttgctgtgttgtccaggctggcctcgaacttctgggctcaactgatcctcccttagcctcccaagtacctgggaatataggcatgtgtcactgcatccagctatactaagaacttttaaagctcaacaatattaatagcccatttcttaaataagcaaaatattgaacagatagttcacaaaagaagacacgtgcccaataagcaaattaaaagtggctcaacattgtcagtcacacctgttagagtggctaaagtttaaaagactgactataccgcatgttgacaggaccactttggaaatgtttgacagtttttcaatccagcaattctaggtatttacccagatgaaaatatatgtccaaacaaagacttgtacacagatgtctggaggagctttatttaataaccaaacctgaaaactactcaaatgttcatcaatggatgaatgaatacattgtgcctctatctagacaatggaatgtgttggcaatacaacaaactacagatacacagaataacatgtattactctcaaaaccattacagtgagggggaaaaagctagacacagaagagtactgtgcactcatttcattcatatgaaatgctagaaaagtgaaatgtgatcagcggttatggaaaggtcagtggctgctcaaagctggaggtggcaagcactgacgggaagtgacgtggagaactttgtgagtggatgggaatgttttgtatttgattgtagggggtggtggttactcaggtgttcacatttgtcaaagcacctcagatgacactttttattttatctttatttatttaattttgagatggagtctcactctgttgcccaggctaaagtgcagtggcatgatctcaactcactgcaacttccacctcctgggttcaagcaattctcctgtctcagcctcccgagtagctgggactacagccgtgtaccaccatgcctggctaaattttgtatttttagtagagatggggtttcaccatatcggtcaggctggtctcaaactcctgacctcaggtgatccacctgcctcggcctcccaaagtgctgggattagaggcgcaagccagccaaataatacattttaaaagggtgtttgttgtatgtaaattacacctttaaaaaatatgtaaatgctaggggaagagaaaccaaaccaaaccaaaccctgttctttgctggagctagaaatccaagacttacaaagcaataaacaattggacaataaacaggctgggctagatggctcatgcctgtaatcctagcagttagcgggccagggccaggtgggaggatcacttgaggccaggagttagagaccagcttgagaaggccctgtctctacaaaaaaaaaaaaaaaaaaaaagccaggcatggtgatcctttaagcctgggaggttgaggctgcagtgagccacaatcactgcactgcactccagcctgggagacagagtgagaccctgtctcaaaacaaacaaacaaaaaacaaaaaaataacttgaacaataaacaaaaaaattacactgagatacaaattttcactttccagaatgtcaaaagacccaaaagtttaataacacagtgtattgacatgactatgagaaaaaaacaccactgacaatgggagtgtaaattggtataatccccagagaaggtattctggcaatatttactaaattataaatgctttgatttagcaattccacttctaggattttatcttatagataaactctaccacaaatagcacatgttaaaggttattcattgcaaaagtatttaaaatagcaaaacacaagaaataatcaaaatgtctatcggtccacgacaggttgaataatttatgatacatccatactgtggaatcctatgtaagtacaagaaagcacagggaaaggctgtctgtggtaacatggaaagatcctcagtgggtaatgttaagtgaaaaaggcaacattgtgtttctatgttgccatttgtataaaaacaggaacaacaaaaacccagaagatacatatttggattttcttgcatatatttttttttaaaaaacaaaaccttcaggaagaattaccaagaaactaatcgcaggggatgggggaaggcatgggaaatatgtgtggagggagaattttcataatatgctttcctatctttttaaatgtttagccaaccaaaatttaaatattggctgggtacagtggctcacacctgtaatcccagcactttgggaggctgtggtgggaggatcctgcgagcccaggagttcaagaccagcctgagcaacatggggagacatccttatctctacaaaagagattttaaaaattagccggttgtggtggcacaacctgtggtcccagctactcaggaagctgaggcaagaggatcgtttgagccccagagttcaaggctacagtgagctatgatcatgccactgcactccagcctgggtgatagagcaagacggtctaaaaaattttttttaaatgcttaaaaataaggccaggtgcggtggctcacacctataatcccagcactttgggaggcctaggcaggcagatcacttgaggtcaggagttcgagaccagcctggtcaacatggtgaaatcccatctctactaaaaatacaaaaattaaccaggtgtggtggtatgcgcctataatcctggctactcaggtgtctgaggcaggagaatcacttgaatccgggaggtagaggttgcagtgagctgagattgtactgtactctaacatgggcaacagagtaagactcttgtttcaaaaaaaaataaaatacttttcaataacatcaaaataacacattatatattaatatattaactaggatacttaaactattatcattattcaccaggttatcttgaagaaaaatataataagaagtgtctagtccggtataaggacatatttggcacacagtaatggttactatttctataccctgcccctcaaatgcccgcacacaacctgtctggtacttcaggttctagttccccgaagcccagttgcctgactgcctcttccagctgtgcccttgcagggacttctcctctgctgaatgattttccccatctcttcttattgtccacctacttggtagctgggatgtggaggacatcacctcctcaggaaagccttctctgattgacacacaccctcctcctccctcttcacaccgaccctttaggtggcccttgtccttcctcccctgtggactgcagggtctgctcagtcctctgtagtcctggagtgctggccaaggatcgagctcccctccacagggtggggattcatggcaggggcaggccttactctccacctacacagacatccagaaaagtttcggtttcccctaaacgttatgttgatcttcccatgctcacaaagaagagtttgggtttcccctaagttgtgatctcatttttcctgtcttccctaccctccagccctaccccagccaaggggccgtgccagctttcatggtgaagatgcctggggtttcctgggcagcccttcatatactgtgtaatagcaatggaaggaatccacaggtgaatgctgatgcaggaagctcccagtccagcagggagggcagccatatatgcaaggagcagaaacacacaatgtggaatgggtgcagagagccaggcaagggcacagaggacaagtctcactgggcctcaaagggtggccacagtgtggctgcggggattggagggcaggctttggaacagacagcctcagctagaaagccctgggagggcccatgagaggcctccaagtaggcaaaggggcaacagcaggtgcagcagcctgggactctaggaaggggccctggaaacctgaacctcaatggccatggcagtgacagaggggtctgtgctgggctttagggaggtgcctcaggcaatgtggaggacctccaggaggcgggacaaggcagtgtctggcaaaggcagggacagacagcaaacaagacagagccaggcacccaggaagggcagagaccccttgggggagagggaagttgcggtgccacaggacaggctgggggctgttcttaaggggaggctttgatttttgtggttttgtttttcccagaagtctctccaaggagtaagattcctttcttaggactcaagaagtcagaggcccccttctctggggcccctggggtttgggcgagagtactggagcagaaagcagggctgggctgggcctggggccagacctcaatgactgtttccttcccgtcagcgagcggagaagcagtgacagagtgtaccaggaggggaagctgacggtggccccaactcctctcttgaatgggatatgaccaccccacctgcccctcagtgtttgcaggacactctggcacactcatgccttcctttcctggtgaacctgtatcccactacaaagaggaacagaactccccacccagccccacccttgcttccaggggctttgagacactcaggagaaggagcttcaaatattgtgagggtctgtctgtgtcagccaccaggatgtcaatccctgcctgggctggcagcatggaccttgtggaccctcctagcccaccccatgcccccaggagccccgcttggcttcttctcttttatacattgtaaacaccacatttatttgtctgaggcttgcaaacctctggtaagaagcacagaacgcagggctctccttcatgctgccctgggccccagctcgccaggcatgcaggacagagctggcagatgagtcagaaatctttgggagcagcgccagggaagcagcaggccctgctccttcccatgcccaatcccgccagcacgggcctggactgcagccaggaaggtgggccagccaggatccccaggtaacttcgccacagggacctcttcttggagctgccttcccttccctccccatccctctccaatccccgcagagcttagagcctgggccacatgcttggtccctcacacaaggaccaaaccagctgctgtcaggctgtttctgtgggtcctgtctctccagtcaggaagccagcagggcagggcaggcctggctctcctcctggaatcacaccgtgcacccagctcagcgctgggcactcagctggggaccgggatggacaaagccttgtccagagaaccactgtaggggagacgtgcatggcagccggactcagcctcctgcagcctccattcatgggctcttggctgggcctgaaatttgttagggcctcaactctctgtggtgcagatgaacacctcctcctccaagaggcccctcaggcttggtgccaggcttgggactgggctctggaaagtcagccaaggctgctacttcaaggccctgaggacagcctccagcttcatggccatagccaggtcgcccttcaccttcagccgtccactcatgtaggcccccaggggccgcagctctctgcatagcagggcccgcaggtctgcctcggccatctccaccaccacatcagggatgccatcaggcaccccgtgtcccactcttcctcgtcctgtggggcaaaagaaaaccgagtgtcagtaggggaatggaggaacgtgaaggagatctatgggggtgggaggggctggtatttcccattgggaggagagtactggttaagagtttgggttctaataccctgggtttgagtcttattggctgtgtgaactcttggatcctcagtttccaaatctgtgatgataattcctttagagatgacaattcctaaagcataggctcatggtgagaagtgggtgagataatgtacaaaaagtacttggcacagagcctgacaggcagcaggcctgtaacacgggcaggcctcttggtattggaagcctggctgcattgtcctgcggatggcggggagaccagggcatagttaatgcctggaaatggtgtctgagcccctgcctgccatgggttcaccccaaattattggcaggagcagggggcagtctacgagagcaccactggggtaggtaacaagaaacctagcaagctggatgggaaggagaggcaaggagggcagcggcacctgtagtgaggtccaggaagtaggcgctttgggtgccgctgggcaggacgacattgaactggtagcaggccccgacttggctgaccagggcctcagacaggaagggctgtagagcagtcagtagcccctccgccagaggctgcttcggactggacctggcaccaacttgaggggcaggtggctcaacttcactcaccatctccacggtgtctgctgggggtggccaacagggttggggaaggaggcagagaggaggtcatcgtgttgccaaggtcaggaccactcactgtggcctctgcaccttttgtggcagtttcctcttagatccccttcaggcctctgttcaacttcctcctctaccagaaaggtgcccctgagttttcagcctaaactgcaaactcagtttctaaactactccagcctcagatataaaattctttccagctgcccttctggtgatgtcgcctcctcccatggaggctgccaatggcctctacacactcagacacctggcctcctctcactgccttggctgtggtcagtgtgggctgaacatctgtgcagggtgtgtactgcacagagctgctgggatagtgagcaaagtctgtgctggcaccaagctggtaaacacccccgctctcctccccagggctcctcacctggccccggggacggggcacctcctgccattgagttcatgcttcctcccaggaagtgcagggccagctgctggagggtgctgtccaggttgggcccagctgggctgtcctggggcggctggagcacggcctccactgccagctccacgcggtctacctccagcccccaggccctggtcacatcgttgatctccagctggaggacagtgtgaggagaaatgtaattaattcaacaaacctttcctgagcaccttctttgggcagactgtgtggccgtgcatggacatggaggcaccacaccgcccttgagacactcctagcctgggaacacaggcagagggcaatgacctttcagctgtggtaagtgccaagacagaagcaaggcctgtggtgagcccccagcagaggagggtggtgccagcaggagggagtcctcaggtggaggaggacccttccagcaacaggaacagcatgtgcaaaaccccagacaagaaaacctggcatgttcgtggagctgcgaggaaccagagttccatttagctggaccctcacatgtcggctgaggactggagacagctgaggggtcagaggtggggtgtttctgcttactttgatttattctgaggcaacaaagagccccagggaggagtttgagcagggaggtgatacagcagacttgctttaaggcaagatcctcctggctgctgtggatgctggattatagggggctgaggggagggatggagaccaaggaagacattgtttcaaaatacagccaaggaatgatgcagctctggcgagggtggaggggagctgtgaagccaagatccactgagggaggcatgcctctatcaactgtactgagccacaacagggcactagagaagtgcaagcaccaggctcggggctgcctcgatgtgtgcaatgatatgagagggggcgggagtggggaggagtcaggctcctgaatggatgagtgtggcattcactagagaggacacacgggggtgggaagggagggatggcaacttttttttttttttttactactgtaagcttgaggtgtctgtggggcagtcaattgtccagtaggcagctggagaaatggcccagggtacagaagcatcagggctagggcaggacattgtgaataatcagcatccacaggcagcagacagcccagatggatgagctctcccagggaggtcacagatgagaagaggccagtgatgaaaccctggaaactcaagggcaggagaataagtggcagtaaccagggatgacagggaaggaggaagtacagggggttctgggggctgggggctgggtcgaccatgtcaaatgctgccaccaggtgatgtaagggaagggctgagaggtgcccactgggctggcatgtgggaggtcactgtgatgttggccagcgctgtcttgggagcccaaggaggccaggatgaaggatgtaggggcaggggctgggagcatggatgaaagtcttgcagaagaaaaggggagaaagggagtgggagctagagggcactgtggcaaagggagggcacatttctacacagaaaggagaggtgacagagagagagtgcatggagtggagggaaggcatcctgggatagcagggggcccacagcactgcgcagtacagggatgagcctcagagaggggaggcagaagggcaaggaggcaggaaagcagcacagaggcaggtgggtttgaaggggtgaaactggaggaagcagagtgctcatcctagagtttttctcctgagtgttaggaggcaaggcctgctgcagagagcaatgagcagtggtggggctggaggagggcagtgaagggctgaggcagctggcctggagcactggcaggtaaggagtggtaactggctaaggaaggtccagcaagtgagaggtggggactctgatttctctagaagaaaatcaggcaaaaaggggcatgtgaataagtgtacgcctgaaccagggcctgagggcggtgtgctggacctcctgaggttctgtctcaaccacaggcacagctctcactctaccaggtgctcactcagtctgggaaatgggacttaaaggactctcacatcctggtgtggaactgacctccccaaactgcctgtctcacatcaaaacaatgtgcaacaagactgagatcagttttctcttcctaaaggtgaattaacacggggcatggttttatgaataaaagttgttatccacttgctatctgagttgtgttagatcaagcactggattgaggggcgatggtgggatggaggcaggtggtctagctatggctcagctctgcccttgaccatagctctcagaggcaagtcaaattatttcttagccttagcttcctccctccaaaataaaacagtagtaccgacttgcagcaaaaaatgtcaagctcagaaatgctgggccagacaaaaggactttgtaaaccataaactgctaagcacgtaagagctactgttaggatctcaaatagtatttcctcaggaatttcccctcgctgcttccagtgggacctccaggactggcatttatcccattcccccgactgtcctctaaccttgattccccagggcaaagcagagccaagaggaatggggagaaatgtcacctacattcccctgtcaggacacaagaggaagcacaagttgagtgtggctgcaggggacacaactctgcatgtgtatttatttctaccccatcttgtagcagaagagatttagggcaaactccaatatacacatggagaagaggcaggaaaaagatccaaatgtcctcatgttcctttgttctgttccaaacaaggaaacaaaaatcacaagcatgcacacgctgcatggtgagcctggaattccccagcaggtgactgggctgggagggtccctgctccatcacccatctgcctgccccatgagtcaggcccggaatgagagctgtagaagccagtgtcatcatggcagagcagtgaggggtaaaaactaaggggcagaccccaagaatgtctgccggggccacttcctcttctcagggacaagtttgcccaggatcgttatggtctacgcccacctgccattcctcaactcatggccccacccaggcactggctcttcaaaggtggttacactattgggacatatggtaaactgaggcccagagtggtctgactcttttctcaaagtgacctggcaggtggagccaggccggtgccacccctcaagctccgtcttgtgaggggctgcctaccagaagctggtcgctgatcttgagcttctccatctggatctcccgcagcggcctcttgagcagggccttggtcatggcgttctgggctgtcatgcgtgtggctgtgttcaggtctttcacagtcatcaccgacagcaccgggtcccagatgcgaaactggacatcggctcccacggacagcacagccccgtccttagaggccagctgttgggggaggccatgagagagagacactcaaggggctgggggtgcagggaggtcaggcccactggggccacccagcttgaaccacctgcttggcagctagctcctcaagggcaaatggtgtcaccaagtatgtagggttaggtgtatgaagcaaggatgtcctcctagcttccatcaattttctggtctcttcttcccccttcccccctcagatggtgactcacaggctgaggtcctggcaccacagtacattctggacaggcccccagttcctctgtcaaggcagctgagaagcccctcaccttgcagggagggacgttgaaggctcgtgtcctcagatccaccctctgaaaggagtcaatgaagggcaagagcagaaccatgccaggtccctggggggtgcggatccggcccaggcggaacacaatcatccgctcgtaggtgggcacaatctgtccacaatggcaagggaaagagttgaaagtggtcagcctaggctggccaatgctgtctgcctaggtcccttcctcacttctctcctcctcacctgggtcacagttaggtatccctagcactgtttccagatgagaaaaccaaggctcagggaagctaagtgactgctcaaaaattgcatagccctaagtgaaatagtgaagatttgaatgcagttctgaataactccaaaggccatgtgtcttaactactgcactgtattgacttgatccttagagaaacttttcatctctgtggtctgaagttagacatgactcataccaggaaactgtctgtccttggattagttaggagaaaaggctcggctgccctaacagcacccccggggaaagggctttgtcaactttaggtccctggacctcctagagaagtagtgatgtccaaattgagaaatgaaggcccagagaggcaaagaaacctgttcaaggtcacatggcatttgtttctgtggcagttttagaactaggatataaggccatttaaggacccccttgcagaccacaccaaacccagaggttttctagagagggactgttgcctagggctacacaaagggcaaggcctccttgggcttccaccttcccccagctttcacgtgcgatgctgaactatagctccatggttcatccttttcccactgtaccaccccttatggaaaatgaggcctgaattcctattatgcactaccagctgggctaagttgggtgttttcatttctaatttattctaacccaaagagaagataatttggcaaagacatctgcgtgtaccttaaagccagtgtccagatcccaggacttaggagtttgggacttgcttctaccccctactggctcccagtatgactttagacaagcccaagccttagtttcctcccctgaccaatgtgaatgaatggttcttgcctagcccattacacaaaggggtaataatatttagggaaaggggacagaggataggcaaatttattcatcaatgccaaagctctcagtgtggcccaaccaccctgggggctgacccagccagccttaccttcagggcaaaccagccagaaatggggaaggtgaccaacagcagcaagaaccccaggaaactgatgaggccatgacagaggcaggagggccagctctggggtacatctgcaggtgagagcagaggtggtcaactggacctgcacgacagctgccaagcggagtgaacttgggcaagtgtaccttacgcccaccttcccctcgagaggctccttccttctcagggctctcaatctggctccttgcctaatattcccgtatctttgggcagctgcaagttagggtctgttccctcctcccatacatcaacactcatttgtcccaagtccaacaaccctcacaaggccttattctctgctaggcaacagccattcaatctcagaatccagtccgcgtgatgatgctctcctcactggactgagtaggggtcaatcctctcgtttaatttatattgcctacccatacctggcatggagccaggagcacctgggcatctgtaaacatgcactgaatactgctggcaaaacacattcctcctataccatcagccccagaagtgtgctttccaggagtccttatgaagatgatgccttagcctacagggataaatcataaatagcttatcaacgggagccacagatgaggaattagattattattttctattccacacccaactttaatgccttaatgaccattaaaaaatgcctatttcacgagatggcgccactgcactccagcctgggggacagagcgagactccatctcaaaaaaacaacaaacaacaaaaaacaaaaacaaaaaaaaaccctgcctatttcaattcaagaaaattgttaggggtcggggtcaggggcagggctagaaagatgaggcttatccaagccaaatgtcctggcccctggagattcaggagcccaagttgggagcaaagccgagacagctccagaatctgggatgaggttatttgccgctttcctcccaaccctggacaggaagcagtcgggagccctgctccattcttccaggaagccctgccctctgggctaagccccagagcactgaggctccactttgtgcctggctctgatccaccaggcctctcaagagacttctggatagggagagctttcaggacaggaaggccagggagggatcaaatccaaggttaggcggttaggctgaacagcgtgggatctggcctgtaggccaaaggagccacagaagactttgagggcaagacagaagcagggcagatccaacaggcagctgaggacctgtcattttggcctgcacatccaggagatgcctagttcccgggcttctagaggtgccccctagggcgaaaattcttccatttccctgcagcaggtgcctttagggtgctggtggcctcctctgcctagacctcggtttcttctatgcgaaatagaaacctgaaacgtcttcccaggcctaaagggctgataagagccgaggacaaatgtggtgaggtgaggttttggaagataggagcaacgctggctggctctggggccaaagccccatgaccctagggagggcggatcggcgctagcaccaggcgccgggtccagccccctctccacatcgtatccctttctcagtcccccctcgtagggtgcgacggcaccgggccggccgactcctcggaggcagagattcgggcctgggggttgccggccggtcccccccggctccgccgtgccaggcggccactcaccggcccctgtccccacgccgccccgctccggggacaagcagcccttctgcgagcccagaaagccgaagctcgactgctggaagcggtcaaaatcacccaggggcagcgcccggtacccagacctgccgagcatggcttttgacaggagacacgccccgcgcctccgcgcggcgccctccctggccagtgggccctacgcggccccgccctcctggctgctgcttccggcttcacccgcgcggccacccgcggcggcgcgggcgcaggaagaggaggccggccggggcccgcttccgccgtcgcatggctccccctgcgctgggaggaccgaactgcagcccagggctactgggtgtgatcggcgttcctcggaccccgctggggtcatcgcctcctcccctcttctcctactcagccctagaaaagctggaggggaagctgggcacggtggctcactcctataatccatcaatttgggagactcaggcaggaggatcgcttgaggccaggaattcaggaccatcctgagcaacatagtgagagcccatctctacaaaaaatttttaaaaattagcctggcgtgggatgcctgcctgtggtcccagccacttgggaggctgaggcgggaggatctcttgagtccaggagtttgaggctgcagtgagctatgatcgtgccactgcactgcagtcggagcgagagagcaagatctcatcagggtttacaggaagccaatcttctccaggatcaaggacatgctatatcagccttctcagcactccttctctcacactggaggcaggacatgccatatctggactttgggtttctctgggacatagtctgcaaattattcctctttgtgaacccacagcccagcaagcagggactggcatagggcaggtctcaatacttatttgttaagtaatggcctggccaggtcaccgtgatcaaggtggagtaggaaggcctgaactttggcacaaaaagaaagaagtttcacatgcagacttcggggagcatgggagtgtaaggaagaaggggatagcacagagctacatgagggcaggggccccagagcaccacagaggtgaggccctcagtcctgcaggtccagaaagagcatgccccttgatccaggtacctggaattaacttgcctctccagggcttgagaaaacctgaatgcaactcgtgaatttcctttgagaagtgttaacttccaacaggactttggggtagtctgggagcaggctatcttccaaagcaagcaaagaaatgaataaagcttccccagctctgcctcctcagccaatcgcctctggcctccgaagccccatcctgccatagcccacttccaggtcccttgtgcagatggctgcccaccatatttggctttcatggactgattctctaaaggcctgggagtactgaccaggctggagggaagggcaggctcctgaggccttacagtccctaggaagttgcgtatctgcccaacccctgctctccaccctgcagactgtaaggtttacaagagccaggccctatcatcatcctttctagtctgtttctaagttggaacagagtacggaatgggtacacaggagccagcacagtggttgcgatggtttaagtttgaagccggggcgctgacccagtgaggtcacctggaactgtgcccctttccccttaccagctgggagtctgacatgcttttccattggcgaagacctagctggctctcccctcaccctcttcatacccgctctccagctctccccctccctcctgcccccaccacctcagatccaccagcctttccagctgtcactcaaggcatcatcctgctccctcacctccagtcactggcttcccaggatctctgaatcaagtccctcctctgcatcccacagccactgtcctagaccagggcacctgctcctaggttgtcagagtgactgtcccatcatgcacagctgatcgtgttgttccctggttccaaatccttcagcaacttcccatcactcacagaactggttcaatctcctcagctaggatcttgtcctagcacactccttgggtatcatttctcatgaattccctcttaaatctgaaaatggccaaaattagttcccaaacaggcttttgcaagagctatcttttctgtttcaagtgtcccccgtaccccaccacctacaaccctaaatccctggtgaatttccactgcttttgcaggtcccagctgtgggctctcctttccagaatgtctccgtttgcaggcttgctcttccattacatctacggctcttagaaagcaggggctgcgtgtggctcatctttgtacgcccagctcccggcaggacgtggcacgaagcagtgccagtgtgaacggatgaatggatcaaagccgggagcagggctgcccccctgcagctctgccctacctctcccgctttaccgtaagtcagcggtaggtctgcagctctccgcctctacctcctccccgctctgggcgtgtctttaaaacccacagtcggcctctctgccccctagaaccgcccccagcttctgtctcacttcctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagaggtactattgggttaggggatgatggggttaagctttgttggtttgctgtggtggggagaggcgggaagagagggtctaacggaggatttggtcaagtaccctagagagtgacacaaagcgggaagtccagacaccagggtcctgaccgtctcgggtggggcagggaagggagggtaggatagagtagaaaagaggacacggaggagttggggcggcctcgctgggctgcggtttctccactgagcagttgggcaaggtgagaagggtcagtggcctccgggcctgggcccttccgcccaccctcgagccctgcctcaactttgcctcagatgcaggacttcagattagggaggatggaggtagtacccctgttgcgctggcctggagccaggggcatgtcccaggcacggcaaaactaaaaccaacttcccagatccgaggtgagaaactggctcagactgaagaggtatctttgccaaggcctcccagctcatgtggtttctgcttaaggaagcctccccaacgaacccttctcttgccacacctttcctgcccacctcccacctcccccgacaaaggaactacttgggtttcttgctctgctgcctttcaggcccttttactccccttcatgaaagtacagaggacaccgtattacagtaacttttataaacattattacaactaagaataacattacttaacaatactaggtaacatttatgagcacttcaaatgtgccaggtactgtattaagcactttggtttttttttgttgttgtttgtttgttttgctttgttttttgtttgtttgtttatctgtttgtttttgagacggagtctcacactgtcgcccaggctggagtgcaatggtgcgatctcggctcactgcaacctcctccttccgggttcacgccattctcctgcctcagcctcccgagtagctgggattacaggccacgccaccatacctggctattttttatatttttagtagagatggggtttcactatgttggccagattggtctctaactcctgacctcgtgatccacccacctcggcctcccaaagtgctgggattacaggcatgagccaccatgcccggcctgtttttgtattttacaaaatgtggtaaaatatacctaatggataagttcctatgttaaccatttataagtgtaccattcagtggcattaagtagattcacaatattgtgtaaccatcaccaccatctatttccagaactttttcattactccagaaactctgtactctttaaaccataggggagggaaagatggcttgcctccacccttctagtttccttggctgggctatgaattaaatagcctatgaattaaatagtcataaaatagattaccagcggaaaacccatatttaattacatatgtatactcaggagtcccacaatatatgagactcaaagaaaggtcagatgattgaagcctgtataacatcctgagctacggaaaagagcttggagcttctgggtgatggtgataacacaagttatgggagggtgaggagaggagctgtttggtgaatagaggttgtcttgctatgtagattaaaagttcttagataataaaagttgtctggagcagccctcttttaatatagatcattttactaatgtagattttcttttaagatataaatgcctttcttttttacaaaaggagagcttttcagagctattcctgtatcagcagtttctcagaataaccagcttaaaatatgccaaagaagtatatttcaagagcctcctgcagtcatactttgaagtggtgtgtcctgagccccagtaatgcaatagctcctcattttctccttcccctagcccttggtaacttctaatctaccttctgtccctatgaacttacttattctagatatttcatgtaagtggaattgttaccagtagaggatcttgactgcaaattgttcaggttcttggcattttgaacaaagaattggacaaaatgtacagcaaagcaaggaaagagtgaagcaatgaaagcagagatttattgaaaatgaaagtacaccccacagggtgggagcggctagagcagggctcaaggaccccagttacagaatcttctgggttccaaataccccctagaggtttcccattggccacttggtgttcaccccattggttgcagaaagcaaccaaccagacgtactttcaattttccatctgccctgcaggaaatggggtgatttgcaaagagagtagcctctcttccttttgttactgaggcatggagagttgcggttttcctttcgatttagttctaggaagtcagagggaatcggccttaggttccctgcctccagaccctattctcctgcctcagaatcatacagtgtttgaccttttgtgactggcttatttcacttagcataatgtcattgaggtctatctatgttgtagcatgtatcagaatttcatttctttctaacgctgagtaatattccattatatgtgtagaccacattttgtttatctattcatctgttgatggatacttggattgtttctacattttgtctattgtgaatagtgttgctgtggacattgttgtacaagtatctgtttgggccttgtttttacatcttttggttatatatctaagagtggaatttctgggtcatattgttgttccatgcttacctctttaatgaacccccaaactgtgcattaagcactttatatgaggttggtacttagtgtatctaccttccaaactgagttccttgaaggcagaatgtatcctacacctcttatatctcagagcctattactgtgggtgatgagaagtagatgctcaataaatggtgcagtgagagctggagggcctgaataaatgggggtattggggtgctgataagccagggttttgcatcatccaatgactggctggaatggaatatgaggtcctactccagggtccagctgtaagggtggttggccggtaggtgggggcttttgggacttctccaggcctcacctgcctctctggtcccccagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccaggtgagtaggccggcacagggtggggtggtgcatccaagtaccaggtagagggcgagaggagcaaagatccaaagagtcacacagctgaggacaaggagcttctggggccttgcaactctaaatgtggtctgcagatatgcagtgtccgtgttgatgaccacaatttatgctgccagtccccacgcaggtggatagtaagtttccagtttcctcctgtaataaataatgctgcagaatcatctttgcatctttatccagtaacttctttaggataaatttttagaagtgccactgctgggtgtagggggacgggaattctacatttgatacatgttaccaaactgccctttagaatttagtggaattttccgagagcactgacacggaatctcagtaaggctggattctaggatcagagacaagtagttagtttctgtctgaaaagttgaaaccattaacaccaggcagcgctatctgagaatgtctgtatggggaaaaaaaatcacatccagttgtaattatttttattaaacagattttaactcagttttttaataggtaatacattcgtacagttcacgaacaaaatttgtaaagaggagagagagagtgcaatcttctgtccatgcccaactgcctaattcccaccacttctccctcttcccatccacaggtagccattgttactagttttgaatgtttcttctgagagtttctttacgaatatatatgcaggtaggagcaatcttatcaggtcctattttccctcttttagccaaaaaggtagcataactatgtgaacttttcaccattagcaatagattgttcatagaaggcgcttcttggttcttagagatccacttgcaaaatgaaagcatttttcgctggtttttgacaactcagaactatatatggctaaaccacatatttgctgaactacatatctgctaaactgactgtgatttgtttcctgctttaggataaacttcccacactatcagaataagctttcccctccgactcctcaacagctggtatcaccacgtttcttagcttattgtaaaggttgagtggctttccacttgtttattggccattgtgtttctgcatttgcgagtggcctgtttaggtcctttgcctgttgttgttgttgtttccgttgaggaattaagggactaattaaagaattcaggaacaaattcctcgaaagaaaaaaatgtatgcatttcttttgctcttacaatttatgcagttttaaaacttacatatttattggattttgattgaaattgcaataaattaggagaaattggctttatctctggttctatcttttggatttaaaaaattttttttaattttttttttttttttttgagatggagtctcgctgtgtcacccaggctggagtgcagtggcgcgatctcggctcactgcaacctccacctcccgggttcacgccattttcctgcctcagcctcccaagtagctgcgattacaggtgcacatcatcatgcctggctaattttttggcatttttagtagagacagggtttcactataatggtcaggctggtctcctgacctcaggtgatccacctgcctcggcctcccaaagttctgggattacaggcatgagccaccatgcccagccttatactaatttcttaatgaatttgtaagctttcatgttttgaacgtgataatgcagccatcccacgggatccatgggagtctgtttcaaattcatagatgctcaagtctctgatataaaatggcatagtatttgtatataacctctacacatcctcctgtatactttattttttattttatttttattttttgagacggggtcttgctctgtcgcccaggctggagtgcagtgctgcactcgtggctcactgcagcctcaatctcttgggttcaaacaatcctcccacctcagccaccagattatacaggactgcaggtgtgcaccaccacactcagctaatttttaaattttttgtagagacagggtttcacgacattgcccagactggtcttgagaactcttgggctcaggcagcaaccctccctaggcctctcaaagtgctgggattacaggtgtgagccactgtacccatcccctcctgtatactttaagtcatctctagattacttataatgcctaatacaatgtaaatgctatgtaaagagttgttttactatatttttgaatttgtatatttttttattgtggtacttttttaattgattttttttcgcctgaatatttttgatccaagatttgttgaatccacgggtgcgtaacctgcagatactgagggccaactgtacatataaattgtttagcgtagtgcctggcacatattaaatactcagtgaatgttaaaattctattataatttctctgctctagaacaatttgaagaatataagaaatttaggcttataaaagttttttgaaaaaccatcttggaactggtgccttttttatagtagatttttgggaacttttcccatttttgccatggcattaatctgttttggctcttgtgtcagatttttggaagattttccagttcatcctgagttatctttcattatttaaaaatctcctatatgcctgtaactataccccctttttttatttctgatgttgtatatttgtggtttagcagtcttttcaaagtactgtacttttagtctttccttagattgcttactgattttaatgttttccttctttctgtttgatcattttatttttgtcattttcttccttctaacttttgtcattattcattttctagcttcttgaacttataattcatttatttgcaatctttattgtttaataataataacttttttttttttgagaatctccctctgtcacccaggctggagtgcagtggtagatcttggctcactgcaacctgtgcctcctgggttcaagtgattctcctgcctcagcctccccagtagctgagactacaggtgcccaccaccatgcctggctaattttttttatttttagtagagacggggtttccccatgttgaccaggctggtctcgaactcctggcctcaagtgatccacccgcctcagtctcccaaagttctgggattacaggcgtgagctacaatgccctgcctaataataactcttttaaggcataagttctctgtatatggttttggctgtatgccataactttgataacttcattagtgttctcatagtcaatcatttctcaaatttcatttcagtcttttcttaaaaaggttctcttgcttaaggtcaagagttcgagatcagcctgggcaacatagcaagacctcatctttacaaaaaataaaaaaaattagccaggcatggtcggtggtacatgcttgtagtcccagttatttgggaggttgaggcaggagggttgcttgaacctaagaatttgagcctgcagtgagctgtgatggtgccacttcactccaaccagagcatcagaaccggaccctgactcgaaaaaaaaaaaaaagaaatttttttctcttgaaaagttttagagaatagtgttttctaaaattttcaagtggttttgatgtttggtttcttgttctgtcacccaggctggaatgtgatggtgcgatttcatacttgttaatttctgcactatggccagtttatacagtttgtatgagttctacatctaagactatattgagattttcttagcggcctaggatattccttggactcacatattcctagcaataatccttagagttgaaaagttgtatttgttgtacacacatatatatacatacacaaatatatgtatataatatatatgtgtatatatgcatatatctatatgtatatatccatatatatgtaagttctagtgcttgtgtgtgtgtgtgtatctccacgctattgaaactttctacctttctttcttttctttttttttttttttttttgatggagtcttgctctgtcatccaggttggagtgcagtggcatgatctcggctcactgcaacctcctcctcccgggttcaagtgtttctcctgcctcagcctcctgagtagctgggattacaggcgtgtgccaccatgcccggctaagttttttttttttttttgtatttttagtagagaaggggtttcattatgttggccaggatggtcttgatctcctgaccttgtgatccacccgcctcagcctcccaaagtgctgggattacaggcgtgagccaacatgtctggccgaaactttctacctttccttccattctgtttcaccagttctctaaatgataattacagagtggtaacttccccatcaaaacatatatataggccagatgtggtggcttccacctgtaatcccaacactttgggaggccaaggccggtggatattttgagcccaggagtttgaggccagcctgggcaatatggtgaaaccccgtctctacaaaaaaatacaaaattagctggacatggtggcacatgcctctcgtcccagctattcgggaggtggaggtattcctcagagaggatcacctgagcctgtccgttcaaggatgcagtgagccatgatcacgccactgcactccagcctgggtgacacaatgagactctgtcttaaaaaaagaaaaaaagtgggccaggcgcagtggctcacgcttgtaatcccagcactttgggaggctgaggcaggcggatcatgaggtcaggagttcaataccagcctcaccaacatggtgaaacctcgtctctattaaaaatacaaaaattagccgggcgtggtggcgggcgcctgtaatcccagctactcgggaggctgaggtaggagaattgcttgaaactggaaggcggaggttgcagtgagctgagattgtgccactgcactccagcctgggcaacaagagtgaaactccatctcagaaaaaaaaagtgtatacacacaccaacacacacatacatgcacactctagaacctatctcatctatcaccacaaagagtagaatataactattcttccagagaaaataaaacatttagcacacttttatagtttttcttcttccctcttccttctcactttcagatttagttgaaataatgtgaacttttagttccagattactaccaaattgttaatttttttttcttttgtaaacatcctttctgaacaggtattaagcttcatggtcatattacaacgcacttgttagccataccttatactttaattggtttcattgctcatgataagttttcctatagcttttcttctcctttcttgaattatttaaggtgattaattttccatttggcaggaatactccatcaagtaattaaaaaaattattccagagtttactttctgagaccttaagtgtctttacttgtatgtccttcttttgctgtcacatgtgagggaaagttgagctaggtgtaaaattctgaggtcataatcacagtgctttcacctcagaatatataaaccttgcttcataaatttctagtctctggtgttgtagatgagaagtccactaatggtctattttttctctgtgagtaatctgtttttgtttgttaaggatctttatttatttttatttattttactttttagagatggggtctcactctgtcacccaggttggaatgcagtggtgcaatcagagttcactgcagcctcaaactcctgggctcaagcaatcctcccaccttgacctcccaagtagccaggactacaggcacctgccaccgtgcctggctaataaatatagttggatggttttcatttgtttatttgtttgtttagagataagttcttgctctgttgcccaggctggtgtgcagtggtgtgatcatagctcactgtaacctcgaactcctagactcaagaggtctgctagccttagtctctgagtagctaggactataggtgcctgccaccatgcctggctaatttttaaaattttatgtagagatagggtctcactatattgcccaggctggtctaaactcctggcttcaagtgatcctcctgccttagccgcccaaagcactgggattacaggcttgagcccatgcccagcctgctaaagatctttatataattttttcttttttcaataatcttctatcgccattgttgatctgaaaaactcaagtctttcttcagctcttcatctcagggaaattgtattctgctttttaattttttttttttttttgagatagagtattgctcttggaatatagtggcatgatcttggctcattgcaacctttgcctcccaggctcaagcagttctcatgcctcagcctcccaagtagctggaactacaggaatgcgccactacacctggctaatttttgcattttctttttagtagacacaaggttttgccatattggccaggctggtcttgaattcctggcctcaagtgatctgcccgccttggcctcccaaagtgctgggattataggcgtgagccactgtgcctggccatactttttaatatactgatagcccttcatttgtttattttattttttatttttattttttgagacagggtctcactctcacccaggctggagtgcaatggcacgatctcggctcactgcaacctccacctcctgggttcaagtgattttcctgcctcagcctcccgagtagctgggactacaggtgcgcaccaccatgcccagctaatttttgtattattagtagagacggcgtttcaccatattggccaggctggtctcgaactcctgacctcgtgatccacccgcctcagcctcccaaagtgctgggattacaggtgtgagccactgcacccggcccatttgtttatttttaaaatttttactactgttgttatatggatattggaactccaagaacatattttacatcttttaaattttttccccattaattctgttgctttgcttttttccccgagattctcagagagctcctcgaattgtttttctaactcgccagctcatcttttcgccgctgactccattcttctatctgctacccctgtagagttgttgtgggtttttttccccccagcaatctttttttttttaattgccaaaagagcttaatgctctcaggatgctttttcttggcagcctgctcttgttttctcattgtagtgtgttcttaagtctccctgaaaaacacagttggcatttacagaggtgtatgtttcctacacgatccccttttcaatgggtacttgctcagtttggctgctgattctcttcataggtcctgcggtctgtgctatctgctcccatgtaaaagttgacatctagattgttcagtgtttgtagctagcgtgggctggcagcaattgtgtaaagcacaatttataccccacattcaatccctgcagtggaacagggccgctccccacgagccccagatggtgtcagcttgtaagtagtcccacctctgctgtgggggtcagaggtggatttctctccattagggatagaaaaaaaccttttgtctgtacccattttagatgtccagctaggtccctgtaaattagactaacaagatatagattaacacgagaaaagcaggctgggtgctgcggctcacacctgtaggcccagcgctttgggaggctgaggtgggtggatcacctgaggtcaggagttcgagaccagcctggccaacatggtgaaaccccatctctaccaaaaatataaaaattcgccaggcatggtgtcacacacctgtaatcccagctactcaggaggctgaggcaggagaattgcatgaaccctggaggtggaggctgcagtgagctgagatcacaccactgcactccagcctgggcgacagagcgagactccgtctcaaaaaaaaaaaaaaaaaaaagaaagaaaaacaggagctttttagcatgtgcatctagcatgggtatcacatctagcatgggaattgtgcatatacctgggagtatccagagatgagtaactcaaagcgttggttagaacttcagcttacatagcatcttaatgaaagagaaagaaatgtttagagaagtggcagggtaaaagaaaggggttttaggcttgcaaaggtggcaaactgttggaagttgtgtttctgttttgcattgctagaaggaatacctgaggctgggtaatttgtaaagaaaagaggtttatttggctcatgttctgcatgctgtacaatcatggcaccagaaacctgcttggcctcaggtgaggctgcaggtaggttttactcatggcggaaggtgaagggggaacaggcgtgtcgcatggcaagaggggagcaagagagagagaaggaggaagcaagagaaggagatgccaggcgcctttaaataaccagctctcccttgaactaccaaagagaggatttactctttaccacgggatggccccaagccattcataaggcatccaccctcatgacccaaacacctcccactagaccccaccttcaacattggaggtcacacttcaacatgagatttggtaaatatatgggaactctaatggagtaaggtttgtttgtgcgggcctacttggtgccagctttccatcttcgtggctgtaaaacttccctgagagaggagatttatggtagttcttgtttctcagaagtttctgttttttgtcataagagcaaagagcgtaagagtcaaaagagtttctgtttttagtcatgagagaagctcttagaaggctcctttctgcgtctgttggttttcatttgcctgcagctcaaaacaatcatatgccaaagtggcatattttggagtggcatatttttatcccttatgtcaggtacaatgggcagggaaggttcagccagcaagagggcaggattcctgttccttgagcacggtgcatggccttaacaaacctgaaaaatcatgtgctcccactcccatttcacattgtttcacaatttaccagtggttactggacaaactcaacttattttttctgcacaaaacttcaatgccataaataagagctcacaactttcctctggtcacaagtcagttagcagccacctcgctctttgaccctgggctgatttagagctcacactggggagcagccccagaggtggctttaaacctgggactcggggtgtctgccctggggtggctgccctggggtggctgccctggggccattggtatttgctccacatgcctgtggagtccattttttcatgttcatgtcacacctactgtgttgcatgttctttactagggggtggggtagaaatatgaatggacatagcccctccttgagatcacagcctggtaaacagatcagccattaacaattgaggcggcagggttccgtgcagaaggctgcatgactttgctgtctattgtgactgcgttttgatagttacctttgtcacactgtcttctgtattatgtttgccctcagcaacatgtcgtatctggcacagggctgacatcctgtttgtgctcagtcatttgtggaaggaagaagtcaggcaggcacaaaggtggctgagctcagaaaaggccacttaccctgctgggatcagctggggaaggtggcttccaagaggccatcacacttagtgtgatgtataaggaaatagaaaggccacagacaggagggactgcacgtgcaaggaaggggcactagtgagtttgcagcatctcaggaactgcaatagaaggttgatgtgagggcaggcactagaagggtgagttggggtcagatgtggcaggcttggaaggagtcaggactctatgctacaatttccagaacactcagtgttctcagctttctcctttgtcatgccttcataccacctaatcttctcaccagtgactatcctctggaagacaatgggaatgggaccctgtggagggctctgttgaaaacccattgatggggccgggcgtggtggctcacgcctgtaatcccagcactttgggaggctgaggtgggcagatcacgaggtcaggagattgagaccatcctggctaacatggtgaaaccccgtctctactaaaaatacaaaaaaattagccgggcgtggtggcgggtgcctgtagtcccagctacttaggaggctgaggcgggagaatggcgtgaacccaggaggcggagcttgcagtgagccaagattgcgccgatgcactccagcctgggtgacagagcgagactgtgtctcaaaaaaaaaaaaaaaaaggaaaacccattgatgggcattgaggagtggtgggatgatcagagcctctctctgcactctggtactttgacaagagtgggcaagtttgggaacagggatatcagtatttctttggctgcatacttatttatatttcaccccattccacggagaatttgaggggatttatcaccagatgtgggatacttatccaatagaaactgaagcaaagaatctggacaagggaaagggagcctcatgagtacactaggtcttaggtccaggtgggggtgaggcctgcaagaatgcagagatggaggggtgtggagacggctgtggtcccacactgccagcacttgcctgaccagacattctcaggagtgcttccacccaagcatggtgtgggtctagggctgcaggtggagctaagtcctgtctgcgtctgggtgtcagatcctaaaatttgctggatggagttggggaattaatccagctgaaagagcttgaattatcattgaatggaggaaacaaaaggcctattaatcaagtttaagaggtgtgattgaaggattggcacctatccctgcttggtgctctcttggtgccctctgtgaagttagcagtaaattgcattttattggggattgatattattgggattgcttcctggcctgcaaggagcattacatgggcagaagaaaggctgctgccaggagttgggcaacatgatgaaagatgtggacaataaatgacccatttcctagtttttctatgaacttatcttgaaggtagatttatagaataatatgtggataaaaggggttttcctcctggtctcctttgatgttttggagaaagaagcaaggactttatttatttatttgtttatttttgagacagtgtcttgatctgacacccaggctggagtgcagtggcacagtcatggcttgcggcagcctcaacctcccaggttcaagtgatcctcctaccttagccttcctagtttgtagagacgagttttcaccatgttgcccaggttggtctcgaactcctgggctccacccacctcggcttctcaaagtgctgtgattacaggcttgagccaccacgcccagccagaagcagggaatttaaagcagcgcaagccaagatcaggattagggctggtgctccggtctcacttctcctgaaggccaatcgcctctactttctgcagctatgggagtgggctttgctattcagggatggaggcctgggacattttagaacaatttgggttttttagttttgtttttttgagacagggacttgctctgtcacccaggctggagtgcagtgtgcgattatagcttactgaagccttgacctcccaggcccaagttatcctcccacctcagacccccaagtataatagctgggactacagacatgcaccaccatgcccagctaattttttttttttttttttttttttttttgtagagatgggctttcattatgttccctaggctggtctcaaactactgagctcaggcaatccacctgcctgggcctcccgaagtgctgggattacaggcgtgaaccactgtgcccagcctttagaacaatttttaacaagacttgaaattaacaagcttttggcatagtggtgcacgcctgtagtcccagctactagggagactgaggtgggaggatcacttgagcctcagaggttgaggctgcagtaagccataatcatgccattgcactccagcctgggcaacagagcgaggccttgtctctaaaaaaaaaaaaaaaaaaagaaattaacaagcttttctcattgattgctaactgataaaattaaaaactattaatagaaccaccgccagccagccagacagccattgagcaatcacttattgagcatttatttcatgactggtgttatgatagctattgccagatgaaaaagaatgcctgccttcgaagcttgaatttgtggagagtttcagcctatggataagttgcatgtgtgtgcagacttgtactctatggcaagaacccagaggtcccagaagatacgttcagatcaagtgctgtggcagttttcagaagggaaaacttgtatttatgtgggagggtcagggaaaccctgatattttagcatttgggctacaccttgaagggtttatttgtctctataagttgcatctaaaacaaactgtataaattagtgagtttttttagttagtagcttaagcaaaagctggattgatggctgatgtaagtgcataggggtcaagctggcctctgacctgaccaattagatattcagattgtgtcaccaggaggtactttctctgtatttcttgtgacctggctttcttccaagactggtccattcacagaagggtttactcctcatgggtgccagatgattgcaacagctccagaggttacaccctcagccccaaattcaaggggaaaagagtgtgaatctctcccagcattccaagctaaatctcagtgtgtctttgattgggtcaggttcctctccctgcaagggtggctcaggctaggggggttctcagattagcgtaagcctgagtcatatgctcccccaaagctcatggactgagaacaggaatgtgtggctacctaaaggcaaagtccagtttcatattggtacaagaagaaagaagaatgtgcctttaatacatcttagaaaaaatgtccaatagccaccgtaaatgaaagcaaagaagaaaaaaacactccaggtatatggaaggcagtggaacagaaactgaagtgcaggggacaggtttgaagccagcctcaagtgaaacaccctgaccccttggtgcctgggtaaactcttttcaatagaaagccatccttttccaaccaggttagggaatgggctgttcaggctgcatgcaacctttcctgttgacaaagtggagaactatcctgccatttgagatgtttttcctgtgctattctcctaactcccacaccctcctgtaagattatcaggaagagagaactgttccctttgtacaaacaaggcgagaggccagagagttaacaggagcttcccaaaagggagagcttgccagagccggggccagaacaggatgcagggtttcctgattgcagaatgggtgcccctttcctactcctgctggactctacattcaggcagcccacagctaatgactgcactgagttgcaaaaagaattctaaaagttgtttcttaagaatttagagtgtatcttaagtaagcatgcaatttaagcaatgttgaacttaattttcccttttacagaagataaagaaactaaagtgaaattagacttgctgaacttcaaagaaataattcttcatcttaaaatattttcctaaaaggtccctctaagattaagagaaaaaaaccccaagacattaagaggttggagccattttgttttttgaaacagagtctcgctctgttgcccaggctggagtgcagtggcgcaatcttggctcactgcaacctccgcctcccgggttcaagcaattctcctgcctcagcatcccgagtagctgggattacaagtgcctgccaccactcctggctaatttttgtgtttttagtagagacagggtttcaccatcttggccaggctggtcttgaactcctgacctcgtgatccacccaccttggcctcccaaagtgctgggattacaggcgtgagccaccgtgcctggccatttttttgtatttttagtagagatggggtttcgccatgttggccaggctggtctcgaactcctgatttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaaaaagcaattttttttttccaagaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaattattctggaacctagcatgctccttcaatctaaaaattatctttatttcaattgcttaaattacttctcctccatcttccttttcttccttctcattttcttctttttcttgctctattactaataatatcacaatttgtaatttattaactttaggtgtgttcagtttagtaatataacagtactactaccatttagggtgggggaacttatttacttaatgacttaatgaatgagtaacaaagattagaaccaccatatacattcacttgatacatatttttataaaagtgcttgagaatatcagaattatttatgtcacacaaggagttactgcctgttttctgtgtcaccagattctattaacatttaatgattacctttactctttgaattttgaattttgtaacaaattcctgctgtggcatattttgcaatttggttatgttctgccaaagctgtaacagtaggtgaggtgtttcaaatttggcatgactgaatagaagagctgcccgttctcaccatatgttactcaactcatatattgctatgttatttttaccttactcatcaaattatcttttctcttatacatggctttaattaattgattattttaggtatttccatctctggacatttcatgtactgaaaatagatcagatttaaataaaatagctttataatcagtatttatgtgataaactctgtcttatttcttgcaacatttaccggcatgtaaatccaaattgaatattggttaatgttcagcaatattcaatactatataattgtagtgtattgttatgaaagtcaatgaatttccccccatgatgtactttgttccaaaatttgaatctcctttaataacatataacacataagttgcttaaaaaatttctcactgctgacactatttggattgtacttatgacaggcatactggccatcacctcagcatatgaggataaccatattttagaaataccatgctggtggcactggggagagctgattggagctggagagaccagaggcagggaggcctcttaggacatcgtgctcaaggagataagcaataattgaggcaagaacagaggcagtagcagtgggaactgctgggacaggtttaggagccagcattctgccttaatcatctttacacccttgccgcatgcctagacctagttggtacttagtaattttgggggggtttttttgagatagagtctcgctctgcctcccaggcagtagcgcagtggcgtgatctcagctcactgcaacctctgcctcctgggttcaagtgattctcttaccctcagcctcccaagtagctgggattacaggtgcccgccaccacactcagctaatttttgtatttttattagagacgggaggccgaggcgggtggatcacaaggtcaggagttcgagacgagcctgaccaatatggtgaaaacctgtctctactaaaaatacaaaaattagctgggcgtggtggcgggtgcctatagtcccagctactcagtaggctgaggcaggagaatcacttgaacctggaaggcagaggttgcagtgagccgagatcatgccactgcactctagcctgggtggcagagcgagactctttctcaaaaaaaagaaaaaaaagaaatcattgaagccatagaggacagggaggcatccaggagtggccattgaatggtggtgccattccccaccataaagatggcaggagaaacagggaacccacgtggcagtgtacccactgcctgttgaatgagtgacatgatccaggggaacactgcccactatggatacaccagccatatgccttgggagcaggtacctgtgtagaaaagagtggagaagaaaaagcacaaactttctcctccccattcctgggtgtggcaccagcatcagacaggagttcaaacagtgcttcctttcaccgctttccttgctgcttttctattctggtatcttcttctccaagacctcaggctttcccctctccaacactaccttctcagccaataaatcactggaggggaggtccataggaataatgcattcactctcttcaaatatcccaggctctagaattacccatctcctctcctggtttcagaaatcttgttttttcaatggtgagatagcaggaaactgatctggtaaaatgcattcatactactgtataaatgattgatggatccttttaactgtagttacttgaatttccaaaagagctctcttttaccactctaccaaagtgaaagtgccaagttgctgcatggaaatgggacaggtagaggagagtttttggtcaccattcaggcaagccaggtggtaccagctctccttcactggtcctatttcataacatttttgcttcttgcattttagagctaccagtttcctagaacagcagaagtagcatgctcccctggcccaaccaacaggtgcggctatagtggcctatctgtactggggaggggacaccccaaatctgacattgacaggttcacccaacagcagggatgtcctgtgccatgtgtaataccccctcttctttcatagctccagaatgtccaatgactacatagcactgtgctgagtccttcacatacaccagcctgtctttgtgcttgtaacagtctataagggaagcattattactcccattctacaggtggggaaattaagactcagagagaaaaggtaatttgctcaaggccttgtagctagaaatttggaagagctaacacataccactcttggcatagcagtttagacatggacagctttaggatggggagactgagaacccaggaaacacgttgaggcttctattaaaatacactactcggccaggcgagatggctcatgcctgtaatcccagcaatttgggaggccgaggtgggcagatcacgaggtcaagagattgagaccatcctggccaacatggtgaaaccctgtgtctactaaaaatacaaaaattagctgagtgtggtggtgcacgcctatagtcccagctactcaggaggctgaggcaggagaatcacttgaacccaggaggcagaggttgcaatgagccgagattgccccactttactccagcctggtaacagagcgagactccatctcaaaataaataaataaataaaaataaataaataaaataaaatacactactcaggaggctgaggtgagaagatcacatgagcccaagaattcaagtccagcctgggcaacatagcaagaccctgtctctgaaaaaaaaattaacagtgtggctatttcactgaataatcataaagggataaatgaaacaatacatcccagagacgagaaagagctttgttgtaatacctagatgggatgttctttgagtgttccccattgcttcctatttaaagtccaaactcctttacttagaattgattatagaaagtttaggaaaatctaaataggtgaaaaggagggatgagagaaagaggaaactactatcactctagaccttttcctttcctttttgctatctctgtgatcatctaaaacaaaatgaacaacatttagtgttgtataacttgcttttcttataaatagtcatgaagatctttcaaaaaaatatacagttttgaattttttaggcagtggcatcttttttttttttttttttttttgagatggagtctcgctctgtcgcccaggctggagtgcagtggtgcgatcttggctcactgcaagctccgcctcccgggttcatgccattctcctgcctcagcctcctgagtagctgggactacaggcacatgccaccatgcccggccaattttttgtattttttagtagagatggggtttcaccatgttagccaggatggtctcgatctcctgacctcgtgatccacccacctcggcctcccaaagtgctgggattacaggcatgagccgccgcgcccggccgggcagtggcatctattgattgtatggtttcttttatttcttcagtaattatagtgtctttactatggtgagagtaaatagtccactgtgttttctccttcgagatgtaattttacacatttaactttgtgattcattggaagcatatatgggtatgaaacaagaagcaaggctctaacttcattcctgccccctaccctcctccctagccaatttctctgattccaattgttgaaaacccctttaatgtccatcagtttgggctgctggctgggcgcagtggctcacgcctgtgatcccagcactttgggaggcaggggctggcggatcacctgaggtcaggagatcgagaccagcctggccggcatggtgaaaccctgtctctactgaaaatacaaaagaattagccaggtgtggtggcgtacacctgtagttccggctgcttgggaggctgaggcaggagaatcgcttgaacccaggaggtggaggttgcaatgagttgagatcacgccactgcactccagcttgggtgacacagtgagactctctcaaaaagaaaaaagagaaaaagatgggttgctttctttgttatataaaatattacatttctatagatgccagggactacatcaggcctatctggtctgttctactgatccttctcttgactcttgaactagtaccatattctcttaataatggcatttctataatgtgttatcccttccttacactgattcctcaaacatttcttagcagctggtcatagtggcttaggcctgaaatcgcagcacttttggggccaaggtggaaggatgacttgagcccaggagtttgagaccagcctgggcaaaatgttgagactctgtctctataaaattaaaaatttttttcttagctattttatctgtttgttccttcatatgaaatttagaaacctagccaggcgtggtggctcacgcctgtaatcccagcacttctgggaggctgaggcgggtggatcacctgagatcaggagttcgagaccagcctggccaacatggtgaaaccccagctctactaaaaatacaaaaaaaattagccaggcatggtggctcacacctgtagtcccagctacttgggaggctgaggcacaagaatcacttgaaccagggaggcagagattgcagtgagccaagattgtgccactgcactccagcctgggcaacagagtgagactcagtctcaaaaaaaaaaaaaaagaaaagaaaaagaaagaaaagaaatttagaatactttggttaagtttcaaaaataatttaaattgccttaaacctgtttattaactcaaggagaattaataatcttataatatttagtcttatctcttagtaggtttttgtcattttctaggtattttgtaccttcttttttttaatttaaaaaaagttttttagagatggagttcttgctgagttgcccaggctggcctggaactcctgggtgtaggcaatcctctcaccacagcctccctagtagctgggactataggcacacaatcatggctttgtagaattttttaaatagctgctgtgaatgggaagatggatttttttcccatatttcttctcatttgctttgctaagatagaattatgctatttttctttcttaattattatgtaatctagccactttggtgagcaatttcttattaagttagtggtgtttttgcttattgttttgagtattccagaagcaaatagatgttatttcgcctttctgaagatacggttaagtctgggttcttgtcacggagcccttctgggcagtttcccacttcacctctgcctcctccaaagtgccaagcacgcagcaggtactcagtgagtgtcctctgaatgaaggtaaaggaaccgcttggctaaggtcattcctggccctgggtggcagccctttgattcaggatctgcacctcagtcttaccagagggctgggggcttttagacccaggtgtctgattcaggctagccacctcacagacacttgccgcccatttccatctagagggaaagcaggggccagtcaccctagggagaccccattcaggacaaaagaagcttagaaaaaggacccagcggaggctatggccatccagaacgtcttgctctctatccagccaggctgcctgaggcgtgcccttccaggcttggaaccctgtctccaaggaaggggatccaacatcagacacagcccctctccccaagtgtccaagatccaaagggggaaaataacaactgtttcttattctcttccctttattcctataccctatagaattgcccacatttattagtattctgttttttaatttcaaaaaaaggaatacattcatacattcacaaggctcaaacataatctaaaaaggtatgcagtgaatgtcttactctaccctcattccacccatcccatagccacttttattaatttgcatgtccttttaatatttatttattcaaatacaatcaactatgaagatattcttatttttccccattcttacacaaaaggtagcatctgatacacacatttctgcaccttgatttctaacttaaaatatatatcataataatacaaatagttagcatttattgaacactcattgtatgccagtcatttttcaaacttttatccatatattaactcatttaatccttccagtactcctattattaacctcatttctccatggagaattttccttatcagtatataaagagcttcctcaatggcttacagctacatagtattccgttgtatgggtggatcataatttatgtaactaattgccttgtgagggacacgtgggtggcttctaattctttgctattgtggactgtgctgcagtgaatatattgtatggatatcatcttgttatgtgtagagatagagctgcagagcagatccaaagaaagaggattgctgggttaaatgcatttgtaattctgatgggtattgccaaattgccttctgtagagttattagttcttttcataattgcttagtatttctaattaaacgtagcattgatgagcactatgtatcagtctggctggctagtaggctctctgttggtggttccagaacaagttgatctcagtgtagtcccagatgagaccctttcttctggcctcaggtgggctgacttattccttttttttttttttttttttgagatggagtcttgctctgttggccaggctggagtacagtggtgcaattttggcttactgtaacctccacctcctgggttcaagcagttctcccacctcagcctcccaagtagctgggattacaggcgcacaccaccaagacttattcttatcactgccggtgagagtaaattacagcaatatttctggggaactaacagtattttccctggtaatatttgaagaagcagccttgtaatggttaagaacatggactctaagctggactgcctgggtttttatattttctttcgctgctgtaacaaactaccacaaatttaggggcttaaaacaatgtaaatgtattctgttatggttctggaggtaagaagtctgaaacaggtctcactgaggtatataaaggtgtcagcaggctttgctcctttgggaggctctcagggagaacgttttcttgcctttcccagcttctagaggctgcccacattccttggtgcatggcccctttctgtcttcaaagccggcaacatcacaacattcccacctctgcattcatcacatcacatctcctctcattctcctgcctccctgccctttcctttgaaaggattcacgtgattacgttgaacccacccagataatctagaataatctctttatctcaaagtccttaattgaataacacctgcaaagacccttttgccatagtaaggtgacatattcacaggtctcaggaatttgcacgtggacatctttagaggccactattctgctactacagtttgcatctagactctaccacttactaatcgtgtgatcttgaacaaattattttgcctcttgcaccagttttctcatccttaaaatggggataataatggtatctattccactggattgtcaggaggattgaatgagtaaatatttgccaatgcttataatagtatctgagacacaataaatgctatggaagtatctgctagctaaaatatattaaccaggccaggcacggtggctcacacctgtaatcccagcactttgggaggctggggcgggtggatcacctgaggtcgggagttcaagaccagcctgaccaacatggagaaacctcgtctctactaaaaatacaaaattagccggggtggtggcgcatgcttgtaatcccagctactcgggaggctgaggcaggagaattgcttgaacccgggaggcagaggttgcggtaagctgagatggtgccattgcactccagcctgggcaacaagagcgaaactccatctcaaaaaaaaaataaccaaataaaaatattaaaatacaaacactttgatctagcaggcctatatttataatctatttcataggaacaaaagcttccatgattaggctatataacttggatattactaaagtgttgtccatattggcaccaaaagaaaaaaaaaaggaaaggaaaacgaaagaaagaaaatgcacaaacaggaaattacctgaatgccagcaaaacgacagtgattgaatcaattgtggcccatctgggatataccagagctattaaagagaatacatctgatctgtgcctatgcacctagaggaatgctctgagtgaaagttcgttgagaggaggaagttcaaagtaattatatgacttgatttatttctttcttttttttgagacggagttttgctcttgttgcccaggctggagtgcaatggcaccatctgggctcaccgcagcctccgcctcccgggttcaagcaattctcctgcctcagcctcctgagtagctgggattacaggcatgcggcaacacacccggctaattttgtatttttagtagagacggggtttctccatgttggtcaggcaggtcttgaactcccgacctcaggtgatcctcccgccccggcctcccaaagtgctgggattacaggcgtgagccaccgcgcccggccgatttctttctttctttttttttgaacaaacatcagcccccaaaattattgtagatatctaggtcaatcatttaacatgttctgtttcttcctctgggaaatatgtataacgacaattctcactcaaggggctcttgcaaaggttaagtggcatggctgacatgtgtcaagtctgtaccatcctgcaagcagcagcccagtctggcatttgtgtaaggcggtttcagtggagagatgtgtggaagggtgcaccccacgatgctcacctggtgcttcctcggtggggaagggaaattcagaagtggtggaaagagatgattgtcgtttcgtatatctttgtattgtttcccggatgttgaaattgttactgtagtaactttttatactcatgtgttattggtagtttggatactatcaccataaccacaaacactgaattaggaaaagcagaaacctagaaacatgccatgattcaaagtctggtatttttggaagaggaatttaataacgaacgttttaagaggaaaaagtcaggagagtcctaacccaggccaaccttgtgtgtccacagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaaggtaagcacgcacgccaccttcctgggcggcctgtgcctctgctgcaccctagggaaggcgagtcagaagagatcatctccatttgacagaaaagaaaactgggtgtttattcagtctttgggggttggtaaggtcttaggttccagggcacaggataagggggagatgaggccctgacaaagggctgcagccacccagaggggacacattttactaatttacaagactctgtggattgacctagcgatgactcatggggaacacgtgaaagttgaaaaactgcaaagctgagaatcagacccagtatcattttggcgccagagggaccaagcacttcaggaggttctcttaagccaccggtgtctcggaacagagaagtcaattgggacctggggttacggtagaagggggctaagaaaacctcctggggatggttggatgcttacccaaaaccatacagtggctcagtggaggagatcccttgtctgcaggatgacctgctgtctgccaacctttgcgcgccctgcctagtgttggacgcttgagaggtaaggagacacagactagtttctgatctcaaggagccagagccacttcacgtagctggagaatgagacagtgctcagctctgcaatccaaatccgggagatgtagcagctgtgtattagctggaacaggggggctttcaaaataaggggtagggggagtgtgccagagagtctccaggagtctttgactaaatctccaagctggaatgtgagctctgagcagctagtataggatgcccttactgggaaaggggagggaggctatggaatctgaaggcacctgggtagggtgccagtgacaaagagcttatttacttctcctggagctggacatgggtcatgaaggataatcttagagggcctggacctgtgccttctccacctaggtagtgaatgtcacccatattaaggaaatgaccccacagagtttacacagcttgccttgggtgttataactgggcaatagcagagagaagggttattttattctgaagcataagagatttagatttaataaaaaccaggctgcagataaggaagatcatggagctctcactatatgtagagagtcagtgagccggtagtgatggctttatgattgcgcacacttagccttgctgttggctcagagatggagagaggtacacttggggtttggagccaaaagcaagcactctaatgccacctccttttcccttctggctgggttcctgcccactgcattcgagagagctctccttccagctgcccctccagggagttgtccagtgctttgggatgccctggaaaataggtatcctggaaaagcaacagggacctcctctctatcactgtcccaggtcaggatgtcccttaccagcatgtccttgacctgcctgtgaccttctttgtgttctacagatgcagctgtatccaagaaagccagcccagaggctgccagcactcccagggaccctattgacgttgacctggtgagatgggtttgaggtctgaaggggtggtggtggggcccagcaggtcaggcaggttgtgagtcctgctgtccctgtgtgtgcagggagagcgtctgagtgagggacagcaagtggctggactggaaatttcagtgagaggaagtaaaggaagacattaaagaagggttggctggctagctggctctgactctaggctcctaaatgccaaagttgctcttgatgggccatgagccaggttcagtgggggttagatgtggggtagacagtcggccacagatcagggctgctgcagagggaattccagcattagatggcatattagtgccttccagccatgagaaactatggttgtcagatgtatggttagatatagggtcagcagtcctgagggatgtgcagatgtcctctcccctcctacaccctacccccaatgtgggagccttctcttggagtcagaataggtgggccttcccctgctctttccccacagatggttcttggaaaggaacggggaatggtgccaggagtcagatttcgatcccagttgcccgggttctgctggtgtgattccagggccaccatacatgtaacaaagcagactgtctcagggttcaaggtatccatgtcccatctaatgctggcattccttctgcagcacccctgacctgtggctgtccagctttcatgtacacatctccagggacaggaagcttgctcattctagaggcagctgctcccaactctggactgctctgacttagaaagtgcttttccgagtggaaatgcagtggtgtccctttgacttgccccctttggcattcacaagtatggctcctttccaccagaataagcatcctcggtttcttcctggacttggcatctggtctcttccctagcctagtcactcaggtttgcatgcgcctagcctatcaaggatctggcccaggactggccagtccttcatggacagcaggtcttctggtggtgggtaggggcctagcttttgccatggcatgacccataggagagagagagtgctgtaggttgaggcaatcaggagaggcttcctggaagagacaggacttaagagtctcagagttttagagccaggcaagagcatggagtctaaccccctttttttcacagaggacgaagctaagacccagaaaggatgtgacttacccaaggctacacacagcaaattaggggcaagattaaaagctgactctgttttttgtttgtttgtttgtttgttttttagatgaaggctcgctctgttgttcaggctggagtgtagtggcgtgatctcggctcactgcaccctccgcttccggggttcaagccattctcctgcctcagcctcccgagtagctgggactacaggcgcgcaccactacgcctggctaatttttgtattttttagtagagacggggtttcatcatattggccaggctggtcttgaactcctgacctcatgatctgcccgcctcggcctcccaaagtgctgggattacaggcgtgagccactgtgcccagcctaaaagctgactcttaactgccttgggtactgcattcctatatacacaacctcaagtaaaaagaggaattttttaatatatgtgtgcataatacaatcacatagtcagaaataaaaacatagaaagtgatcaatagtgtcttactcccactttagcccccagttcttatgcccatataactatcttttaaaaatttcttttgagacagtcttgctctgtcacccaggctggagtgcagtgacacaatctcggctcactgcaacttctgccccctgggttcaagcgattctcatgcctcagcctcctgagtagctgggattataggcacgcactaccacacccagctaattttttgcatttttaggagagatggggttttgctatgttagccaggatactctcaaactcctggcctcaagtgatctacccacctcagcctcccaaaagtgctgggattacaggcataagccaccgtgccccacctcttttttaaattcttatatatccttccagaatgtatgtaattacaagcaaatattattatagatatttgccttttgcattctgtgtttcacaaaggtaggataataccagatacacatggtatcataccagaattcttatcctatcaataggtagagagcttcccgatacctttttgcagctgcataatggaccattaaatggatatggcaggctttatttagccagttccttgttgctgcatatttaggttgttttgctattacaaacaatgctacaatgcatgatgtttgcaaataaataatataaaataataaggccaggtgtggtggctcacacctgcaaacccaggaccttgggacactgacgtgggcagattgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccagatgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcaatccttgcctggggatggcagtgctgctgagggaaggaagtggggaacactgtgagtgcaaggacaggtgaggcaggcacagacggctgtcccaagggaaagtgctccatcagctgtgccaggagagaagcagctcttgggtccgtgtttctgccttagaaggcaggagttgggcatctagctccagcactcatccctcttgaaactgctggtttgtttactttcattgcaactatatgcctggaagagatgaagagaaagctcaacaggcttcactaggattgtttgggtggggtggcagcagctcagatattttccctcctctgtttttcataggctttttgtaatcgtgttataatactttaatggaaaaaaataaatttattattttaaagctataaaaattataaatcagtcattatgatgtgtttttctctactgagccctctggtgtgttccctgttttattaacgtggatggagggtgtgtcagggaggttgggacagaggcagagaagaggccagcccggccttcggggagttcgtggcctgtctggaaagagggtcttttacataccagcagtttgcagagccagacacagaacgatagagcaggaccttttaaactcctttttcaaaaaaaaaaaaaaaatgtttaattttggtaaaatacacataatataaaatacatcatcttaaccatttcaaaatgttcagttcagtgtacactaagtgtacagttctttagcattgagtacattcacactgctgtgcagccattaccaccacccgttccagaaggattttcatcttcccaagctggaactctgttcctgttaaacagtcactccccatgctgcctccctcagccctggtgacccttgtctactttctgtctctatgattttcaatactctaggtacctcctataagtggaatcacacagtatttgtccttttgtgactggccactttcacttagtgcagtgttctcagggttcatccatgtagcatgtgtcagaatttcctttctttttaaagctgaataataatatcccattatgtgtatatgccacattttgttgatccattcgtctgttggacacttggcttgtttccattttttggctattgtgaatctgctactatgaacacgggtgtacagatatctccttgagaccttgctttcaattattttgcatgtttactcagaagtgggatcgctggatcatatggtaattctatttttaattttttttttgaggaatcaccatgctgttttccattttttattgcaccatttgacatttccaccagcaccgtgtaaaagtttcgacttctctacagcctcaccaacatttgttatattgtctctctctctttttttcttaaataatagtcattctaatgtgtgtgaggtgggttaaactcttttttgaccactatcctctattgaaaaaaaatatatattatatcttaacttatagtatatacatatgcacacacatactgtagctaaaggagttttataaaataggctgggtccagtggctcacgcctgtaatcctagcactttgggaggcggaggcaagtggatcacctgaggtcaggagttcaagaccagcctgaccaacatgatgaaacctcgtctcttctaaaaatacaaacattagccgggcgtgatggcaggcacctgtaatcccagctactcaggaggctgaggcaggagaatcacttgaacctgggaggcagaggttgcagtgagccaagattatgccactatactccagccggagcaacaagagcaagactctgcctcaaaaaaaaagaaagaaagaaaaaagttttacagaataaattatgattgttacatgggatgtactctgataatttctattctatactattatttttgacataaaaatgttggtcatgccccactaaattgctttcatggttggatccactaatgggtcacaagctgcagtttgaaaaccactggccttaagagtgactagactttcctagaggcctggcagagacagatcctgggagataatctgttctctctccttcccaagacaggctcacactctctaatccagagaggtcatcctccttctttttaaagatttggagaaaaagaaaggaaggaaggaagggaggagggaaggaggtcaatccatcatggccaatggtgtggagcccatgagaaggacccaccgcggggttctggtacctggcacacccaggagccagcactgtgctggggccatccctgccttaactcacatgcccagcagcctctgtcgggagcctccttgcccagccccagcttgcctgggtggttctcagaaggcccacacaggagggacagagcttgtccctgtgaggaaggtgtatccctgccactcactcattttcaataatcggtccagtggacgcttaaagttcacaaaagagagaaagatggtggggagggacataaaagactcatcaagtaaagaaaatgaagagcacgccggggcaggaagaggcctccatttcaagacactggatttggccaggtgtggtggctcatgcctgtaatcccagcactttgggaggccgaggcgggtggatcacctgaggtcaggagtttgagaccagcctggccaacatggtgaaaccccatctctactaaaaatacaaaaattagctgggcgtggggctgtgcgcctgtaatcctagctacttaggaggctaaggcaggagaatcgcttgaacccagaaagccgaggttgcagtgagccgagatagtgccactgcactccatctcctgggcaacagagcaagactctgtctcaaaacaaacaaacaaacaaacgaacaaaaaacactagattcaagtcaggccaggggtcccgaggtatgtgaccttgggaaatcacttcacctctctctgcctccgtttccttctctgaagattggcaataatcatagtacggtacctactttttttttaactataatttttatggcgataaaattcatataaaattcaccattttaactcttgaagtgtgcaatttagtggtatttattacattcataatattttttaaattttttaattttttttctttgcagctccagctcaaatgattaaatttttttctttttaattttcagagatgaggtcttgctatgttgcctaggtgggaggctcaggtgattctcccacctcagcctcctgtactttcataatcttgcacagccattgccacctatctagccccagaatatttttatgcccccaaaaggaaaccccttacccatgaagcagtcagtcccatttccccctcccccatctcctggcaaccaccaatctgctttctgtgtctatggatttatccattctgggcattgcatgtaaataggatcatacaatgtgtattttgtgtctggtttctttttttaaaaaaatttattattattattagtgtttgagacagagtctcactctgtgccccaggctggagtgcagtgacacaatctcggctcactgcaatgtctgcctcagggctcaagcgattctcatgcctcagcctcccaagtagctgggactacaggtgtgcaccaccacgtctggctggtgtctttcatttaatgtaatacattcaaggctcatccatgttgtacatctcagtcctcattgctttttatggctgaataatattccatcacgtggctataccacattttgtttattcagtcatcagttgatgcacatttagtttgttttaccttttggctattgtgagtagtgctgctctgaacattcacgtgcaagcttttgtttaaccgtctgttttcccttcttttgggtgcacacctggggtagaattgctaggtcatatggtaattctacatttaattttttaagaaactgcctctatttcattttgagataggtacatgaagcacttagcactgtgcctggcacagagtagtaataagaacaatatttatcatcatcaatgacattttctaagtgccaggtattttatattttacttgtattaacacatttcatccacattaccatatgaggtagatgttattattcccactttatagagggggactgaggcctgaggagttttaagcaattcatccaacttgtgtagtagctgacccaggtagagttaaggctgagagggcagaggcaaggtcccagggaggccagtttcagctcaatgggaggattttctcactgttaaaggagctgctttcgccagtagtgagcactttgtccctggaggtgtgtgtctaagtagggctaattactgagcatgtcctgagttgggcagtgtgattcctggggtatcttccagccctgttaggacacacaacaaccaaagtggtccctgggctccagtaactcagagtcagaaggaggtgatgccagtcgcggtggctcgtgcctgtaatcccagcactctgggagactgaaacaggagaattgctcaagcccaggagttcaagaccagcgtgggcaacatagtgagaccctgtctctacaaaaaaatttttttaaaaaaaggaggtgatgtgatggagagtttggaggacttcttgtccccagtgagctcggagctttgagtcagggagcctggacctgtgacttggtgaggccccagggattaggccaaccacaggtctggggtacctggccctggggctgctgcctagtcatttctgactcaattttcccaactttgcagcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggtaaggttctccccagccccagccttccctcctgaaggcctgagttccaccaggaaagtgagctggcactggggtgggaatccaggccttcatcagatcagctctttgtgggaaagtgtttgctcaacgccttctctgtgctctcccctgttcttggctgcatggtcagggagcttcccataagcatggcccactcccagcccagcaggggtgctgagacactcagggttgtcagaggccagcagagactggtggacagcagatagtaccagcttgggaaggcttcctgtctgaagagagacgtaatctgcgtggttgagagcagaggagaggggacagcaggagcaaaagggtggccacaagtccctggcagtcagggcaggctctgcccactcacccctgcaggcacctgacctggctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccacaagaagtttgttggctgatgcctagcatactcccagagagggcttgggcataccataacaggaaactggactccccatgaccttaactctgctctctcagtctacacccatcatttccccaagtgtttctgcaaaggccacctacctaagtatctcatttgtcagagttatcttctatgaacactgccaggcaggtagtcagttgggcaggagttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaattctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccgtttcccccagccgactggcctgcaaggattcccataggtgcacacccacacccctcccagcatgcatcctaggcagttcataatgcatctccccttccccgtttcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgtcggtccctcagccggtcctctcagactctgaccgcagcctcctgttccttgagctctcagtcctaccttcgcctccctccagccccgcgcactccccatttcatcccatctttcatcagaattgcagctccctgcccagcagaaaatcctggaaggactcaggagcttgtcgcctctgtgctgccacctggagaccgagatctgcaggagaaaggcctgggaaaactatgagtggttgcctgtgactgctaagggctccttggtgctccgcccagcatgtccttttgctctgcagggcagcccccgcctgcctttcttcactgggcccttgtcccagcctcaccctcagctgatggcggcaccttctgctccagggagaaaacaggagctctccaatggcatagggacagttgacatcttgctatttacagatccccatcgcaccccttccctgccctcgttagggtggaagggatgtccacctgcctccaggactcaccctgtgtcctggccccagcccttgaccccctgggagcctcactcctcctcctcatctctcttgcatcttctaatgtatccactgccttctgaactaaacaccctgaatgaggtctttctcatctcagaaaactccacccacttctctctccagctgtcggctccccttcctctgctctccttgtttacacttcagccccctccttgccccttcttcaccccacctcctgcgcttccccgccagtaccagggtggcctctgtgcctctaggtgcagtgtcgcgtttagtcgttattattcttgaccggcgctgggcccggtctttcctggaaagatcgcctgctcggatgcagctctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccataggtacctcaaactcagcaccttctcctcccgtctcactggctcgccccactctctgcccggttgcacaagccaagaccccatagccacccagggcaccccccttttgattattcctcacatccaaccagttattgagtcttgtctttctagggtgtaaattcctctgaaatctgggcacttctttccatcccataatcttggtaaaattaaagctaccactgaccctgggtagaggcagaagcctgggaaggaaaggtggagaacaggtttggagtgccaacagtgtccccagatgtcatggagaatcaagtagagggaccccagcaatattgggggtggggcggggagtatgtaatgctcagctatcagcaaggagtcattaggggctatacagtgaattaagggagggggtaaaagcacatttcaggtgatgatgaattaaatacctaggagctcacattagagagcaggcctagagacgtggggagagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagctttgcagtgaggaaagttgcagaatactggtctgctacattactactttccaagtgtatcagggcatttaggaacccctcccttgagcttcacctgtgtcctagggattcagtgagagactgtttgtgcaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttttcacccactcttgtgacagattactggctccggtgccttggtggcagcagcaacaggagggggccaaggtgagggggcagcctgtggcagaagtggcagtggtgacggcggaggaagggaggcctgtggggaatggctgatccaggggaggggccgtggcactggtgagtgtgcatctgagaaaatgaaacggaggtgctggccaagaggctggagctaggcagaagggcagcagaggccacaggctggccgagtttatggtccagttcactcataacatgtgcagtattcctggggtctttgaggctttgcaagagctggggttttgtgtctgcagaaagatagcaatgcatgtgtcttgccaaactgatcccagctgtagctgatgcttaagtgctcagaaagttcttcaggagcttgagggctcttgataagcatgaatgtcagatgttctgtatcttccagaggctggatgctgactatcagagtttggcttgtgtttggctgatgagcaaacctggaatgaatcagtgataaggacaattgttctcaagctggctgtacactggggagttttcccaactacagattcctaggtcctacgccctgagattctaatcgaatcagtcttgggtgcagcctgggcctcagttttttcttaaagctatgaatgcctaaccaaagtcaagaaccactgaatcgggggattcattgcatgtctgtggtagaggaatgctgctcatttgtttatagatgtggcagtcttgaatgcaggtgacattttcataccagggtgtaataccgcagaggaggggagaggctggatcttccctgatgtacctcctggacttttggagtgtgattacaatgccaatccagccacttcctctgagcatgcttgggacgactgttagacctgctgtgttgagttagaatgcacttgacctgctcaggccgtgaaatctatgaggaaggggagtgagatggatgtagctcatgagccagattgcaggtgtatccaagttgcatgtatatcctgaaaaaatcctggctctcacgaggctcagcctgaacacagttttgcattcaaagaaacaatgtccattaaccaagtataataaagaaataaatcccagtatttacttgcatcttttgaaagaacattaaagggaatccagctcataaccccagcagcacttcttcagtccttcttccccttttctttggcgcctggcatctctcactgcatagcaaagctttcccccttgattcccggtcctcacacgcaggctcaaggctctgtttcccatcttctttcttctgtcccccttccttttctcttccaagcaaatctaagtcttttccagtgactgtccctctctatgctcccccgacacccagttatcctaatttgcggaataaggccaaggtgtggggcctgggggcagaatgggagagtctcccctagtgagcagggaggggagtatgttctgcaccaggccactatgtctgatggccctgctggcaaacctgagtctttcagaaagtcttgtttaaatgcgtcagcactccccagctgtgatgctggagtttaaggcggagcaggggagaattctgggtttacagctggctggagttccagtgagaccagctccatgggtggccatactttatggaagtccccaagggcaagaggaattttggaggaagtgagtcagggctgaaaggtccagcctctcctccattaacaagcttggtggaaagggggtgtccttttattaaaggagacagtagaggtttcttagagaaggcagctcgagtaagtttaggacaaaggacatttccctggccccgggacaatggaaggctctaaaaacgaggttctagtggctgccataaatgaccctgctgtaacgatgggaggggtggcctaaagagacagtactgtggctctccagggagctctcctcttggaagagcagatctgaaggcgggaagactggttctaaggccgaggacattgccccgagctttgtggaggcactcaggaacacaaaggggcatttccagttgggtttggagcaggaagaagaacgaaaaagagaaagtcctgtgtgccatgtcagtgggtggcagcatggactcagcctcagctattggcaccaaggatctgaaccagggaggacccagaaggggagcccagcccctccaccagcttgtgggagagcgctgctgcccagtgaagcctggagagaggaaacaactggattctcccaaagcgggagaaggtggagtctccagccacccagctacaagctaggaagacgccttgtagaaggctccttacagggaggaaaccgagttggaaaggcgagacagcagtgtgggctcacccggagcaagacgtgtgaaatcagcttttgacagcgtggctgaatgaggatctggagatgcgaggcgctgggcagactctctgactagatccctggatatgaagaggcaaagccagctctagatggattcatagtgagtgtctgcttctgacaataactggcagaaagctgatgagcctggagcagggctgtgaaatgcaaatccagtgaaatccagccactcctacaaaaacccaccacatcttaggttacttgtgggtggaaacgctttttctctcagttgaagcttggttggaagcagatgtttcacttgggcattggaagggtctggggaaatgtgctgcctcctaggccagggacattagccagaggccagaattaactgaggctttagcaccaggtgacaccaacttcattgagaagccagcggcagtccataaagaggaaaaacccaaggcctgccctggactctgtcccagccatgctcccaattggccctgtgatcctgtccatgtctcttccttgctggtctctggctaacgtccacaggtggcattcatgggaggttccaagttggtcatcaaagactaaacatctgggcttggcagctgagcagatgataagcaattaactctgtattaccatcagaggctccacctccctctgtagtcccagtcccttgggaaaatctcagagctggagcccttccctcatcctctggctccccaccccatggcttctcgaacagtgttcccaccaggaccttgggacaggagagaacgcctcacctgaaggactcccaaaactcaggtttctctaagctgctggggcagatgccaagagcctccactgctctctcactgccaaggacctgggtgtccacctagatgtggccttcaggaggccaagcagtccttcccctcgcctttgtgtaggacactggcacctcggctgacttcggggacaagaaaaggcaggctcccgaccccttccaaagaatcatctggggttcaagatgaggcttctttctcccgtcccaagttttggtgtttcttctgagtctgctcagaaagatgaaattaggagcagacatctcaggtcctgcctgccatagcagatggctccttccctgagcctccataagcagcacagcacactcatgcacacacccactggcattttctctcacactttcatacacttgtgtcaacgcaggttcacagctcacacttaactgtgcatgcacacacagatttagcacttggattcattcccacacatgcacgttcacaacctgtgtgtgtcacccttcctcccctactcatgagggtgtatgccctggttcatacatgtaaccctcacatgtgacacacccagttcacacccattcatgcacacataccttctcttgtgcacacgtcccctttcccagtggtacaccctccttcatgtgcacgcagatgctcccagctataccagcttgctagtgttctgcacaggtgcttgccttggccctctgaatccctgacgcttggtttttctgtgttgcagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctccacaagtgcacctctgaccagttcttctctcagacagagagcctggggaacacactcctagacagaaacacaatgcgtgagctcattgccgtgagccctgtcatccaagtaaggcctctggctgtgctacacgtttctgagtagagggccaatcccacaggtggctgcacagggctgcccacagatccaaggtcacagagggatcagaccccttatcctggaagcccctctacttcctccagtgcttgccctggctctgcaaatgcccctccttgagccagagccccaggccctaccctgtggcatggactcaacattggggctagcccagccagacagaaacagcaagtgttttcatggtacagaaaagtcatttgcagacctcagtgggaggctcttggccttgctctgagtggagtgctttctatgtcccagggctctgactgggctggggtccttgaggggattggaggaaggagcatgggatggagagctaagttcaagcagcctgggatctctagtataggtggctgaggctgatagaagacaggagggacctgtatccatggggtttggccaactctggggccggtagtggaggaggggagagctggatccccagctggtgaacaaagtgtttggagggcagccgagcctccccttctgactgctatcccaccacaaccaggatcagagctgcatttgggggctgatgtgtggctactgccagcagaccccaaggtgaggtctctagatggtgagtcagcagccctagaggaccccctgctcccaccccagagctctctgtgaccctgggtcctcaccctgcccttctctcctgcccagcccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaacaggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaagcctgatgctccaatcacagactctgctcagcatccccagaggaaccactgagaagccttttgcctggataggagggggctctcccaggcataggcttgtggccacttgcccagcacaactgtgttttgtggggcgtcttttaggacttagcagagctgagagccctttgttgctcaatgctgtgagccttaagcatgtgaatccccccacatgacaagtggggagacccagggtaggctttcctttggatcatctccaaatgggagtgccatgtggcaggaaagaagcaccgatttcaagaattacttcctagagaaagtcaggaactagagaccagagtctgcaggaactttgccactgcccttcactggctaatcctgtacttctctctgtgttccttgagtgacaggtggtaaaacccttaaaaagggaggtgtgggaggcccaggactttggtaacaggtgatgaatgtgttgtcttggccatcacaggtggagcttcagttagtacccgagggattcccctggcacaagcattataggaattagtccaccactggcgtgggtgagcagccaggtaatgggaattgatcagtgccaccacccttgaccccaactaccatcccagatgcccagattccagtcctggagttttattctctcagcttgatcctttgaccaagaagatccagtcccaatatgtcacctgtgcttcatctttggactatatctcaggtgtttacgtgtcaactaatgggagcttactgggttagaagtcaggacactgagtttcaatcctcacttagtagtctgtggccctctttggcacattaacctccctccttgatcctcaggctgcacctctggcaaatgggagaatgcggctccttttgacttcaagggatctttgtgggaaccaatgagaaaatgtgtgtgaagatagctttttggtatattttaaaagtgcacaaatttaagatcttactgctttataaagtgctttatgaattataggaaaataaacacattttagatcttagaaaaaaacaaaaaaacatgggcttgtcttcagggtagtaaagaacaagatctgggatgaacaaacaattgtgggggtcctggggtctgaaggagccaagatcaaggggtcaaccatggaggggctggacaggaggtggcactgtgctcccagcacacccagatgggacatttcactcactggggcccggagtagacaacaagctttctatgtggcagctcagcgaagccctgctccagggtctccttctgaggcctgaagtcatttaaaaatctgctttgcccctaaccccaacctggctcttagctccagcagctgtcacagagcctggtcaggctgttttcccaccctctacttccccttgtcctggcccatgtccacccttctccctgcccatgtccaccattctccctatcccagcctcactctgactcctggccccaaccctgaccactctccatgcctcagagtctcaccctcagcctagccctgccagcaggccccatctcctcctctgacctcagccttgtctccgcctcacaccccaggtgcctccagcacctaagcctagagtaaggggctcccttctcatctttcctcactcctcacaattaaggaaactccatggctagtgtgcataccacccgggctggaatgcaccaaatgtcaagtcaaagggggtaggacacagggaaccctgcctggcgagaaggggagctgagctagggctgctcccggactctgccagcagagggcgctgcagcgcaccccccctccccccccccccccccgccacccggtgcctggcaacgggcatgggccacggtagtgctggtggtgctggtggtttaagctcaggcagctcagtcctttctaaagtgctatgcgtgcttcctgtggtatgggagataactgtagatacgaggcacgtggagaaacatttttttaaaatgttaaaccttttatatttagtttaacatctgttagaaacaatacaaccaggccatgcgcggtggctcacacctgtaatcccagcactcactttgggaggccgacgcgggtggttcacttgaggtcaggagttcgagaccagcctggccaacatggtgaaacctgtctctactaaaaatacaaaaatttgctgggtgtggtggcccgtgcctgcaatcccagctattcgggaagctctgaagcaggagaattgcttgaacctgggaagaggaggttgcagtgagccgcgattgtgccactgcactccagcctagatgacaagagtgaaattccgtctcaaaaaaaaaaaaaaaaaaaaaggaaaaagaaaaaaagaaacaatacaaccagctcatcgaaagtctgatttctggccaggtgtgatggctcacgcctgtaatcccagcactttgggaggccaaggcaggtggatcatgaggtcaggagatcaagatcatcctggctaacacagtgaaaccctctctctactaaaaatacaaaaaattaaccgggtgtggtggtgtgcacctgtaggcccagctactcgggaggctgaggcaggagaattgtttgaacccgggaggcagaggctgcagtgagctgagattgtgccactgcactccagcctgggcaacagagtgagacaccatctcaaaaaaaaaaaaaaattgtgatttctgggatctagttgctcagaatgatgctgaagtggaattctttaaagatccacttaggacaaatagtaagtaactccacactcggaagggacacaggtagaggaaaacttatgactgtggaagtgaatggcctgttaatttggggaaatactgggttaccagtggacttagggtgagctccacagctaaggatagggcccaagttagaactggggtaaggatggggtgggcttagaatcggggtgagggttagagctaaagttcaggggaggccccaggttaggatttgggattagatcagatggaggggcacatttggtgcttaaggttgagaataaaccttaggaattaggaattgagttagaattggggtgagttaggaatttagttagaaatggagttaaagtcactcttcaggccacaagtctttgtgactttagtaactgaaaagtccatggaactgtgaacagatgggcaggagcttctcgaccccctaataggcaccccaagttcaatctgccttttcccccaaatcctcttctagaagcacctggcaggggctctgcctgagctcacaactccaacaaggtcaatgtacaccaatcggattggagggactgaggagtgggcaatcctgcccaggagggagagcatgggacaaccaggtaagacaactgggtaccagacacgatttcaccatttagcacaagtaacctttaatcttcccaactgtcctatgtggttacagcccatcttcctcctacagaggagcacagcagggcagcaaggctgagtacctcgtcagggtcattaaacttgtatgtggcagagctgggatttgcctgcggggagcctgtgtctagactggcaccatctgtggcctacatcatggagcgcatggccacgtgttgggggacaggctgcctggtctctccttctctcctttctgtgctctcctgagttgtcagtctcaggtgatgcagaaggcaggtctctggaagctacccccaccttctcatccctgtgcttgaactttcattttaattttttcatttagggcagtgtttctggacctttttataattattattattgtcctcttaaggagcatttttagcatcttttcccaattgtgcctccctgtatgaaattttaataccatagatacactgtacattccataggattttctagatacaagatcgcatcatctgcgaatagagatggttttacttcttccttacatggacatatgtatggactgtgagcctttggagggtcagaaaccatggtaatagccaagatggtcaactgcccttcctcccctgccttttcatcctctgtggggtgataatgcctctgttgagaatgcatgatttagggtaaggccccaccccgttacaatgtaggtaagaagtggtcacgggaaggagtgggtgggatgcgggctgcacctctatgtgggtggagactaggtgggccagatggagggagatggaagggaatggagatccaggtttctgagaacacactcgcctgtagtggccttggtcctggtcccaggcacaggcacaggctgagcctggggctaggggaggaatggggccagtaccgtcacttatttttgtctctgaatccagatgtcagctccagacccgctggacctgaataaagcaaatacctgtggagactctgttgagagaagagtctagaatttcaacagattctccccatactaaaagcaaacaaacaaaaacaaaatgaaacaaccaaacaaacaaaaacaaaaaacaggaagtttggacgtctctgttcacccttacaaaatgcatttgctgtcaagtgaggggaaaattccttcattcttggctcaaggaacttccttaaactaagaccagctgcctggactgtgctaaattcagtttataaatattataaatatcccaaacttgatagccaagcacattacaaaagctagctagctaaccgcagaaattttccaaaatgctagccagtcagacaagtatgagatattgtgaaatcctgtgttgcttgtctgatttcctgaaatcattcctctcagactgagtgcagaaggcctgggggtggaattcaggagcactgactatctcctacagttctagagccttaaagccctggccgaccccagggtggattgattgcacagtaagtcagaccaaccagctgggcgcagtggctcatgcctgtaatcccagcactttgggaggccgaggcaagtggacctagggtcatgaagaaggtggaggcactgaggccctgagtgattttataaagaacaccttagcaaatatccagcactatgggttcaccttcactcaggacccacaaagccccacgttctgacagattttgtttatcagacaaattgcacttagtcatgcttcattcatttttctcggagacttcccaggttacatagacctgagataatctccccatctcgccgtcaccccccacgaagtcactccatgtttctgtttgcaatacagtcttacatggatcaatattagattttcatggtgctctttgcattttgcaactattgcttaagctggagacccaaaacgagcactagctttagagtcaaagactcctggattccagtttcagctgagagactgtgagcacatcgccagcccactctgatcctgtatcctatttgtacaatcacctatttcccatcaattgcaaggctggaaagaaaagtgcccactctggccagtacacggtaggagcttagtaagcttaagctctcttgcttccccactaccctaaagtgttaggggaaagacagatgtggggaatgtcacctgggaagctccagctgtatgcttcacaatcctactgagaggtgacagcctgctggcagccctggctcgctctcgggcctcccctgccttggctcccactttggcggcacttgaggagcccttcagcccgccactgcatggtgggagccccttcctgggctggccgaggccagagccggctccctcagcttgcggggaggtgtggagggagaggcgcaggcaggaaccggggctgcgcgcggcgcttgtgggccagcgcgagttccgggtgggcatggtccgcaggcccagcactgggagcggccagcgggccccgccagccccccgcaagtgaggggcttagcacctgggccagcagctgctgtgctcgacttctcgccaggccttagctgcctccccgcggggcagggatctggacctgcagccctccacgcctgagcctccccccaccgccccgctatgggctcctgtgcggccggagcctccaggacgagcgccaccccctgctccatggcacccagtcccatcgaccacccaagggctgaggagtgcctgcgcacggcgcgggactggcaggcagctccacctgcggcccccgtgcgggatccactgggtgaagccagctgggctcctaagtctggtggggacttggagaatctttatgtctagctaagggattgtaaatacaccaatcagcaccctgtctctagctcaaggtttgtaaacacaccaatcagcacgctgtgtctagctcagggtttgtgaatgcaccaatgggcactctgtatctagttactctggtgggggcttggagaacctttatgtctagctaagggattgtgaatgcaccaatcggcactctgtatctagctcaaggtttgtaaatgcaccaatcagcactctgtgtctagctcagggtttgtaaatacaccaatccacactctgtatctagctaatctagtggggacatagagaacttttgtgtctagctcagggattgtaaacacaccaatcagcaccctgtcaaaacggaccaatcagctctctgtaaaatggaccaatcagcaggatgtgggtagggccaggtaagagaataaaagcaggctgccccccccgcccccccccgccccagccagcagtggcaatgatgcttagattccctttgacgttgtgggggtttgttttttttggtctttgaaataaatcttgttaccgcttgctttttcagttcacggtgactttatgagctgtaaggctcacggcgaaggtctgcagcttcacttcggaagccagcgagaccaccaacccccctggagaaaggaacaagtccagaagcaccaccttaagagttgtagcactcacggcaaatgtctgcagcttcattcctgagccagcaagaccacgaaccccccagaaagaacaaacgcccaccaccagaaggaacaaactctggacacgccgcgaggcgtgtaactgtaacacacaccgcgagggtctgtggctttattctttaagtcagtgagaccaagaacccaccatttctggacacaatgccaatgaaaattctgaattaggcttcagtttaccatctacaaaatgagacaggacaggagtgggtaggaagaggagcttggctttgttagtttaaagtgggctggtctgattgtgtaacgcgggcttttgttggctccagccaactccccaggcagggcttcacttgctctgaatgtcttttggccaagtccatggctgtcgagggttggggtggggtggggaggcggcgtggaggatagtggggtgggggtggaggagggtgggggtagaggggggtgggggtggtggagaagcagttcccccatgtaacctgcaggtggcaccagagcagcgcaggatcgtgggttccgctccagccttccaggagacccaggcagggcgtggtagggcgaggcagaggtggtgcagagcgctcagctgcgcagcagcatgagcgtgactacagatcaggccgcaccgtttaaaatggatacatgggtcttctggctaacttcctgtctttggtagggtgatcatatgctttatcatccaaatccagacacttaagagagtgaaaggggcactataataattgcacgaggacagcagacataactttagctgtaccttgcaaaccagaacatatggtcaccctaccctccggtcactttttcttctttgtttccattcttttaatttttttcccttttaaacacacagcattatctttccctgagcaccattgtctttgcaaatgctcttgcaatcgggatatttttgacctggcaacatgcatattcagtctgaacagtctctctgaacctaccccaaaacctggttttagcttccaggcagaagactctgttccctggcttgcaacccccatgactcaagaatgaaagatgtcagaagatgtcacaggtgggacagtggctcttatctcaattttggtgcctctttgctaaatgtattcctgtaatttttttttttttttgagacggagtctcgctctgtcgtgcaggctggagtgcaatggtgcaatctcggctcactgcaagctctgcctcctggttttatgccattctcctgcctcagcctcccaagtatctggtactataggcacgcgccaccatgcctggttaatttttgtatttttagtagagacggggcttcaccacgttggccaggctggtcagaaactcctgacctcaggtgatttgcccgcctcagcttactaaagtgctgggattacaggcatgagccactgtgcccggccctattcctgtaattttgttctgagtgctcatttccttcgtctcttttaatttacgtatattggtttattgaattgcaagtagacaagtcccattaagcaggattcttgtatttccaagatcatctcattactccattcaaccccaaattagcatgccatttatccccttgtttctgaaccctcttcacttaatagtcttgaaaacatccatccattgcaaaaaggactcgaactgttttcacgtccatttttagttgattcattgatatccaagtaatgatttgtctaggggagtcattagtagagaactgtgccgttaaatttagttttatagttggattctgctagttaatatctctctcttgtcattctcacattgcaacaaatgactatggttcctgtcttaacctaaaatccaggttagaaatttggttttatctgaataagatattaatagataatgtgagaaaaataatttactgaaacttttctcagctaagaatgacactcgtcgtcattaagcaagtggaaaattgggctataaatatataaactcttaaaatattatgtttagagacaaggtattccttttttttttttttttttttttttttttttagtaaagcatatttgctatggttggaatgattgtgtctcctttaaaattcatactggaacttaatccccaatgtgatagaattaagaggtggagtctaggagatgactaagctgtaagggaggagccccctcatgaatggggttagtgaccttatgaaagggcttgagggaactacctagctctgttttcttttgtttttctgtcctttccaccatgttaggacactgttcaaggtgccatcttggaagcaggagcagcccttgcgagactacaagcctgctggccccttgatcttggacttctcagacaccaaaactgtgagaaacacattttttttctttacccgttacccagtctcagatattttgttataacaccacaaatggactaagacagtatcttacatacagtgaggtgcatatacctaaagttacaactttgtactatcgttttttggtttgttttttgtttttgagatggagtcttgctctgttgcccagactggagtgcagtggcaagatcttggctcactgcaacctctgcctcccgggttcaagtgattctccagcctcagcctcctgagtagctgggattataggcgcctgccaccacgcctggctaatttttgtatggtagtagagatggggtttcaccatgttgaccaggctggtcttgaactcctgacctcaagtgatccacctgcctaggcctcccaaagtgctgggattacaggtgtgagtcaccacgcccagtcaactcaatagtatttacatatgtgcacactcatgtaaccaacactcagctcaagatacaggatgttcccatcagcacagagggctccctcttgccccttctcagttgctgtcccctcacagttaaccaggatcctgacctctgtcaccatggattagttttgcctgttcttgaacttcatataaatgggatcattcagtatgtgcgcgtttgtggctggcttctttcattcaacagaatcctgtgagatttagccacgttttgggtactggtagctgtttatttttctggttgtgtagttttccatatttcatttattacccttctatttttgtctctaactcagtgtcttttggggcctattggtcctttttagctagattgatactaagcgtcttcttatcagtggagcttaggacattttagaagatgaaagcctaataaccccaagccccccaatcttaagccaagtttcctcctcacgcctgcttcagttgctcttcttcatgtggtattttttccctcacaaaactgatggaaattaagaaacccaaaagctcttcatcatgttatcagcttagggacgcttgtcatctgaataacagggtagatatttatcatctgaaatgttaaaataactagagcaaacacttatatagcactgactgctgttcacagtgctttacatatattattttcctcaaaacagctctgtgaaatagacactattattgtcattcccacattttagatggggaaatggaggcacagagagaccatgtaaccttgccaaggtggtagggccaggacttgaacctgttttctggttttagagcctgcacccttcaccaccacaccatattgtgtagcatgatacttcatgtggttaaagtgttttcttctatttacctgggagcattttctgaataatttgaatcttataaatttgcttcaaagaatacaagtaaatcaaaatggaagatctgatacagaatgtgtagcattcatgaataaattataggactctctggttttaaataataatcatttgcttcccttgtgacttttgtcaggcagggctgtaatgcgctcacctcattttccttctcttcaatgggaggagatgggctcagagacaggcacaatttatcgtaaaatctgatcacactttccctcaccatctggaagctggaggtaggtttgtgaaatcttaattgagaaagagttgaatgctgcttgtagcatagtgagtttaaaaaaggtggtttttctccccaattctgttgcacagggccctgtgagttttggcaattaacatatgtggccaacagttttctcacaaagattatcagggttctagaggaaattatcttccagttttaatctgctgcttaagtgctatatttctttatagatgaactaattaattcttggtcacttgtttttattagacatttctctgcctctgtacgctgtgctttgtctctttatgcccagccccgggttttatcttctaactgcaagaaaaaggtcattgaaattttctctctctctcaaactcctgggttcaagtgatcttcccctgtctgcctcctgagtagctggcattacaggtgtacaccactgtacacacacacacacacacacacacacacacacaaacatgcatatacacacacagacatccaaatgtatacacacagagacatacacatatccacacatactcattagatatacatttacacaaacacacacgtgcacacacacatatacacaccttgtttccatcatcttctcaggactcggggctctcagagagtggaaagagtctcataccatgagtccaggatcaactgtgcaaccttgcccaagcatcttccctcttgagatcttgtttataataataaacatccttacccaccaattagggttattttgaagatagaaaggataacagggtgatggcatgttgtatagtttcaaataaaagttaacattgaccaaaaaagaggtctggcctttgtcctagactcctgggacgtaactgtcaacatgtaatacctgataggaatatgtttgcgtggggatcttaactcatgatggctggtctaataataatagttagggtggggactagccaggccaggaaaagcaactaagtgatttagagtctgggctttaggtcatccctggaaggacaggagactggaaactgagagcagccacatggacaatcaagcatgcctctgtgatgaagttccagtaaaaaccctgaacactgaggcttgagggagcctcactggctgggaatactccatgtgtattggcacatagcaaagctgggaaggcagtgcactctgactgcatggggaagggataatggacactctgtgcatggtaccctcctggactcagccctatgcctggtgccctcctggactcagccctatgcctttcttcccctggctgattttaatctgtatcctttccatgtaatcaaaccacagctataagtataatagatctctgtgagttgtagccagttcttagaggtaaccaagcagagttgatctactgcctgcttgaaaaagctatttaaaaatccctaaaccaaagaagaccagatccctcatgaatctgacccaggaggttttgaagccaaagctgagggcatttgaagccaaagcctggctagacagagataaggctcctgggagggaacaggtgcagtcctgctcaggctgcagtgtccccgggctacagctggacaagggctccctctgggtcacagcctctagggacagagtttggggcaggtcgactgatgtgtaggactctggtgatgaactcaactgggaaactctgtggtaatgggaagagaatggttttgcttttccaaatcatctacccgctgcatgcttggatccacatgggaactcagtgtggaaactacatttgaacagcctaagcctgaactctgggccatgtgtccagtttcctggcctccagctttgttcaccccttatccccacccatcactgatgccagatccatcctcccaaatgtcctttcatcatgttaccctcctcaccacctcatggcatcttctacacaacaggaaatgcctcccacctcagcctggcattcaaggttcttttgatgtggccgccactcaccaccgcaccacatctccctgtgggccctgccaacttggatcaatttttcctatccatgagctgaactttcccacctccatactgttgcttacactgtgaccttcctgtgcgtgttcttttcctccctcttcccaagtccaaatgctatagactgaattgtgtctcccaaaagttcatacttggagccctaacccactatatgattgtatttggaaacagggctcttaggaggtaaagttaagtgagggaggaggggcagagcaagatggctgaacagtagtctctaccaatcattccccctgtgaggtggctggcttcaggtgagacccagcacattcccagctatggtggctgtggtgagagatttcttctgcttgagaaaagcagagggaaaggtaaaagggactttgttttgcagcttaggtacctgtctggccacaatggggtagaaagcaccaaatgggctcttgtggtcactgattctaggccttggctcttagacagcatttctggacctgccctgagacagaggggagcccactgccctgaagggtgagccccaggcctggaagtgggcttaagagcccatgggccctaagagaacatcgacagtagcctggcagcactccctgtgcacctgtggtggtggccacagggtgaggctcctctgcctgtggaaagggaaaggcagagtgggaaggactttgtctcatggtttcagtgtcagctcagccaccttagaataaagcaccaggtaaatttctaaggtttttgaccccagacagcatctctggacccgccagggcctgaggaaactcgttgccctgaagagaaagacaagcctggctggctttgccacatgctgacggtagagccccagggcctcgagtgaacatagacgatagccaggtagtgttgacagtgggccctgagtgagacccagtgctttgctggctttaggtctgacccagtgcagtcccagtggtggtggccatagggatgttgtgtcagctcacccccagctccaagtggctcagcagagagagagggagggaggaagacagagagagagacagagacagagactgtttttggagagaaactacaggtaaagaataagagtctctattgcctggtagcccagagaattcttccagatcttatccgagactaccaaggcagttcctctatgagtctgcaagaaccatagcataactgggcttggagtgtatctaataaagatacagttgagatcacaacacccacatcctttcaaatacctggaaagccttcccaagggtgggtacaaacaagcccaggctgagaagatggtggcagcttgaaatcagccatggaagatttgcaccatggaaatggcaaacactacagaacagacttctgttccctccccgacagagagccccttgtgtaacaacagcactccactgccccatccctgagcagagcgctgtgtgttgcagcagagtgggggcaggtgtcttctcccttgggctacagaatacacattttttttccctcagcacatggatcattctcaaggatagaccatatcttaggtcacacaacatgtcttaaaacattagaaaaaaatgaaataatatcaaatatcttctctgatcacaatggaataaaactagaagttagtaacaggagaaatgttggaaactatacaaccacatggagatgaaataatatgctctggaatgaccagtgggtcaatgaagaaattaagaaggaaattgaaacatttcttaaatgataatggaaacacaacatgccagaacctatgggatacgacaaaagcagtactaagagggaactttatggctataaacacctacttttaaaaagttgaaaagcatcaaataaacaacaatgcaccttaaagaaatagaaaagcaagaacaaagcaaacgcaaaattactagaagaaaagaaataataaagatcagagcagaaataaatgaaattgaaatgaagaaaaagcatcaatgaaaagaatagttgggttttggaagagataaataatgttgacaaacttttagcctaagtaagactaagacaaaaagaagacacaagtgaataaaatctaagatgaaaaaggaaaattacaactgataccgcaaaaattcacaggctcactagtggctgttataagcaatgtatgcaaagaaataggaaaacctactaaaaatggatacatttctagacacatccagcctgccaagattgaaccgtgatgaaatccaaaacctgaacagaccaataagaaatcatgacatcaaagcggtaataaaaagtctccctgcgaagaaaagcctgggacctggtgcttcactgctgaattctaccaaacattaaaagaagaactcataccaaccttacccaaactattccaaaactagaggccttacccaactattccaaactcattctacaaggctagtattaccctgataccaaaaccaaagatacatccaaaacagagaactacaggccaatatcactgatgaatattgatgcaaaaatcctccacaaaatattagcaaattgaattcatcaacacattaaagttggggtgcagtgtcccagcttcactcaacccttccccttttcctgtgatcccaggtggctgtgatcccaggtggcagcggtggcggcaatgttggggtgtgggcctcccaggacaaggggaatgtgagtgtgcccttctcttgcctcctgccaggcgtctgtaacctggcaccagctctggccaggtcttcaagtaagggacctggagatgttcttttccaatttctggattgggaaatggagacaaattctgggtactagagtcagaactaagatgaggctgaatcgggagagtctggggtcctgagaggccgagacctgaaaccctctagatcgtgtggggagctgggtgtgtgatctggccagttgtttctccctgtgcctcaatgttccaggtacccttggagggactgagatcctggggatgcctggagcctggctgcatggcctggccgccctgatgccctcgtgctctccatggcaggccagcaaggctgaggagaatgtctccgacagcttcatgcactccatggacccacagctggagcagcaaatggagaccactcagagcctggtggactcctatgtgaccattgtcaacaagaccgtgtgggacctcatggttggtctcacgcccaagaccatcatgcacctcatgatcaacaacgtgcatgcaccacctcatgggggcaggggctcctgtagcactggggacacaggtggccgtgttggcctggcagagatgacaaccagccctatgggaccaggtgcagggagaggggcacggtccagaccagagctgtcccatagaactataacgtgggactgggcacagtggcccatgcctgtaatcccagcactttgggaggccaaggcggaaggatcgcttgagcccaggagtttgagaccagcctgggcaacatagtgagacctggtctctacaaaaaaattttaaaaatagctgggcctggtggtggcacgtgcctgtaatcctagctactcaacaggctagccttggaggatcactttgagccaaggaggttgaggctgcagtgagcagtgatctcacccactgtactccagcctggtgacagagcgagatcctatctccaaaaattaaaaactgagtagacaggtgtcctggtggcatgataggtcctgggtcccctcccagatctgtgaccttgggcaggtgacttttcctctggacctcagtgtccccatctgagtgagaaaaagcggtggggaggtgggtcttcgagtctaagcagtgtagaagccgcatctgaaaagccatacccggggctccaagtccagcgtacagccccagcaggacctggcggcgtggccagggtggcacaggcatcaggtcccaacctccttccctctttgcccactctcagaccaaggagtttatcttctcggagctgctggccaacctgtacttgcatggggacaagaacatgctgatggaggagtcggcagagcaggcacagcggtcatgaacacaatcagcacgcccacgggggcccatggacaactcctgactgcaggtgcagagcatcctactggatgcaggtaccagggctggcccccacggccccaaagccccccagcctccatggctaagactgtgggctcttggaacaggctccatgcccaagttggcagatgtgggtgctctctagagtcctcggagagggcagagaactcatggtttatggtgtaggggctgggaatgtggagggcgttgtgtgtggggctggactctgaggcggccagaggcctaggaatgtcacctgggcacaacataactgtcgtgcagtctgagtcatgctgccagggcagggtatccagttcccagtctgggagtgccgagagccaaatccactgtagagcaggggtgatagtcagggtcccacctcctctatctgttggcaatccagtggtgatcctggataaaatcttgagagtcccatacacatggtcatcccacaacacacctcacaggccaggcaggaacacacagcccccttccctccctcccaggtaccaccatagctgctagcgtgtgactgaaggcagggtccctggcccctgctgaaacactaccgccagccagcgggctcattcaccttggcctgttgctcttaggggtcacctgtgctattcagccaaggagaccacagtccctgctggcccagctgagctccacatagccagcccacccacctcccctgccacagactctccctcttctgcttttcccagcaggaggggcccaggctcacctatgcaacctgcaggcccccacaaccagctgaggctcccctcttagacttataagtctatggccagtggcatatgcccttcctgcctcccccagggtcctttcagagggtcctgggctttctgaccacccagaggggcccctggcacactccagtccagccatcccttttagcttcaccatcctgggtcaagcagtgttccttttctatcaggcctggtggctgttgggtggggctccccaaggtgagaggtggccttgggccagtgggttggaagggagggggctgagcattggtctgaactgtggctgcactgcctgggtgccgtgggagaggccagtgtgtgtgggctggggagggccgccgcagcccccaggcactacctgtgaagctccggctcctccctccatcttcctccccttttccttccagcctctcttttccaggaaccttgccacacctgcacctgcgtcctcccctccccggccctcccacagctgctgcagcacgcctgtgctctgtgcttgcctcaccagctctctgctcacttttctctctcccgttttctctttgctttctctccaactgccaggtgatcaggtcaggcaagtccatcctgtcctgagagccccaggttccactttgacctctaaacagatcctcctcttctcggaggcctccctttccaagcctgcctgggcgggtgtcctgtgacttgacagtggctccccagccccaaagccagcccccttcatctgtgacttagtctgtcgtagtggtgagctgacacatccaggtgtgacccttgctgaaaacttgtgccccctctgtggtatgcccctgccctgttctataaatatctataaatactcatatgtatatatacctacacatggctgaccgcctcgcctctagcactgggaatctgtcaccgtgctgtccttgtggagtcttgtggcccaacaagacgaaggtctcccctgacactgcccctccaaagtgtgccacctccagtgagcctccctgtcatgtccggcctgtggacagccagcccccgccatccctcccaccccccaccaagaatgggggtgctgtgcaggcagctgtgtggcctgacagtctctaccagtcctgctgtccctcggctgagaatcaaacccatttctggatgatggggaatgtgtcctctgctagctgtgttctctgtggagtgcaggggagggaaaaggccaagccatttctagggtgctgttgggaggagtgaaaaggccacacaccctttccaagggacacttttcctggaaagcccctggagcttagctggcttttatcctgcgaagccggctctggccactagggggcagggccatgaactcagcctggaggagcctgcggggcagccagcactaacaggccaccaggtacactggagggacagacagaacaggccaccgggtgcagacaggcgagggaggcagggggatggaacggaagatgcctggggtggaagtcagtgcccttgggtgctggtatttgtcttcccggccactgctacatcaggcttctgaggctgttggctgtcagggcgggactgtgccctataggcgccatggcagtccctgtgaaatccaccaggtgtcaccaggcagcatacaggtaacaggcctggaaggtccccaagagcccagctggacatgctcagacactctagggctcctcgttcagtggcacaaactccaggacccagtgagggacacgggaatccaccaggctgagcagtatggctaaatccatttactccaaaatgaaaagcaaaataaacgggagtcacatcaccagggagccacaaccccatccccgcctccttcctctgtcctatgctatcaataaataagtttcccagccacaaatagtgattagaacctcctcctcatatgccagctccaacctcctctaggtacaatacagggggtggccctaccccctggaatatacaaaatgtcacacagatactatatgtacactgcggaagggggtccaccccagcagcctgtgccctcacctgctctacagttagccccactgtcccgcctcagctgcctctctgaataagaagatgggagccccctgagggaaaagttgcttcggtgagagtagggaggccatgaggcctcctccaaacaaaccagctctaccagcctctggctcttaaataataatcatcatcatccagaaatttaaggactcagccctggtcaaggtggcaaagggtctgtttttctccccccattagacaggggtcttgtcttgctaccctaatggtaaaggggtgactgggagggggtggtaggagcatggtagggacagagactccagccccacttctccaggcttatgctgacaggggcctgcttttatttatttttatcccatgacttattttttaatcccataatttctttttcataatactttaagcttttttttttttttttttgagatggagtcttgctcagtcaccctggctggagtgcagtggcgcgatcttggctcactgcaagctccgcctcccaggttcacgcctttctcttgcctcagcctcccgagtagctgggactacaggcgcccgccaccacgcccagctaatttttttttttttttttttttttttgtatttttagtagagatggggtttcaccatgttagccaggatggtctcgatctcctgaccttgtgatccacccgcctcggcctcccaaagtgctgggattacaggcgtgagccagcaagcccggccctttttttaagcttttcataaaacttttacgttttttccacaactttttttgccacaacctttccacaacattttttatcctgtaactttttcatcccacaaccttttttatcccataactttggtttgtgttcttcaaataaacacacttcatggttacattaaaattttataaaaataaaaaccgattatctcatgccaagcgtgcccagcatttgcacagtctcaatacctttaacaccacagttttcaagacacacaaaattttaaggcaaaaacagcactttgcaacaatttaataatttattacattacagtagcatcacagtagcagtgaataatgccactttaggcaacagtgtttcagtatttccattatacattctgtttacaagaattcataaattggtaaaagtcattctaagaaaacttggcaaataaagctttgcattggaattggcatttctttctctacttttccttcccccagtttctttcttttaaactacagtattcatattttaaaatgtcttaacttattttaaaacttaagatagcagttacatttttgaatagttatattcttttaaaatgactctttaagataaagttttagagaaactattatggataggactgatttacattttcacattttctaaatatcagctttggttttagaactgactttttttcatttctggaaaacctatcagatttaatcaaatactttaaaaatgattatatattgcaatctttaaatcggtttttaattctttacttcctacagaaattcaaatttattcagttgaacccacactttaaaattctatgtttctgattaaactctacccttctaatgttgccttctaagcaaattgaacgctgccttatactgaatgaggaagagaacaaatacttggctgaatgaggtattgcaaaggaccacatgcactttgaagaaagacttaagttgttgtcatatgatttacatgctatttaatttttcttaaatatatgacagaatacctacacaaagagtggtatttcagttaatatagtacattcattttccagactgacattcagcttaaatatgccggtgtgtgatttaatccacaggtacctgatgaacacattattgtcagattggttgcaggtgctaaaggctagctgaagatcattcctagtcatttatatttatcagggtaaaagtgaagtgattgaactataaaaatacctttgaaataatttatcaatgtattaggtaaacccagtttcagaattataaagaaaaactgttagaccaaataaggtggctaattaacagtggtatgatttctagcccgagggtctaaattggactcaaactgtctttaaactgaactcaaagaatgcaaaagtggcaagttcagaaaataaaaggcaagaacaggacttgaagtccattttaaaccctcgggctagaaatcgtcctactgttaattagccacattcgttggtctaacagtttttctttataattctggaactgagtttatctaatacattgataaattcatacaatttggaagagtcagttgaagtcacaaggacttaatatttgcactctttcactgaatgcaggcacatctgttattccatctgtaaaatcgtattattgctctcctattaatgtcatatgtataaaagtatcatgaggatgccaaatgctaaaaatggagatggtctagtaactagaaatgcccaccccagggagcgcacacacatctctccctgcatcctaatactgtgacgtattttggaacacagacattagaacttcatgaacttttagctgttgattctttcccaagcatcttaaagttatgatttaggcaatgtatgactgaaataattcactcatcacgtataggcacattaacataaatatggcacaaaatatgcctctaactgaaactgagaggtataaaaacatatttcactctttgtgaagaactttgtgaggaaacataagtctgtcattgtatagacactttttctcataatacttggacattcacaaacattagattgcactgcagcttgtaaacattttaagttgcataaacttcgccttgattttcatgtgtagtataatactgtctactaaaactcctttttgtttcaactaagtactctcacatatattggtttataataatggttgttattatttttaaagtgttttccattcaaagaaaagaagtaaattcctatgtcagagtaactaatgtggctgaagaataggtattagccagagaggtctagatgataaaatcaatcttctagcctcaaagaagctccatgaacatagaggaaggccaggtgtcacacagctttccttcactcgaattcattcttgactagagcctgtatgcctcttccagggacatttaaactcttaaaggatttcttatgatcttcactaaataccttaagaagaatgccaaccagtgcccttttgtgtactgggacatatactcgtgattaaaacaggtaacatgaactctgactttaaaatgtattgtagatataaatgctctaagctagaaaaggttttccacatccacagtcaatgatgggagcctttcattcctcagaaataatccctttttaggtcatcaagaaagggtacaactgctgcagctcatgatgcaatatcttcatgagcccagagcacatacaaatcctaagggaactaccatagtacagcgctcattcttggcaccagaacaaatgaaacacactctatcctgcacacacctgccagagcaggccactttcctcttctgtgagatttaaaaagctccccaaaatgttattactcccatccccaatacacagaaaatagggaaaaggctgtttccagttcttggcctttaaacaactctaaatgtcagtactcacagtggcatattacaaagtaataaacagtgctcaattgagggcaaaccacatattgagctaatgaagagctcactgtggttaggattcgatcaaacgtaatagcagaacataagcacattttatctgaattctggaatgaatatacatgctgcaataacattaaaaaagcatggcagcctgttccaaaccagccagaatagttttgtgcaaattagtgggtctttgtgtgtttgaattcccaccacctaagggcaaactcgatatgcatactaatgacctacaattatcaaattaaaaataaaaatgctaaaggatgccagaaagaacatcagggaaagaccaactctcccttaactttttacaaataaatttaaacggtaaattagaaacacaaataaatgtgagtggctctagcattcaaatggagtaaatgaattgtgtaggagatgaaccccgtaactttttgttgttgttgttgttttaaatttcttgaccagctcttagaagatgatgatgtttatctccctgttctcggctgcctggtagaagaatggcacgcagggtttgctgggcaagcctgggtgctcctaggtgtcctgcatgacaggagacagctgcacgatctgctgtacagtggggttgtcatggggagaaccctccctggccgctcctggtgcaggctccacgttgttgtccaggctcacttcataaaaaacttcggagagagggaggcgggggtctgagcacagtgcgagcctcccctgcccctgcctgcccaccccgcctgagagctctactcaccatcctgctcaccggcagccccaagttcctggggggctggggcccctggagtgggctcatcagcagggttctgggcagcgatgaggaatttgccatgcccctcatggttgcccacaaggggcaacaccaactcttgcagctccagcagcttcacctgaagggaggggtgctcagctcccaccctggagcctgcaccagcgcccatgcccacccccaaccccgcagagatgttgcacgccctaccttcatctcctcctccttctgggccagcctgatgacatcctccatctcctggtgccgcgtgtttggcactgccccctggctttcatatacggtgaaggactctcctgtgagaggacacagctcagacactagggtccctccgacggccctgcagctccccgtgcccgtgccctggcctcccgctcactcatgccgtctgtcactccagaaggctggacgaatccaagctctcgtctctccacctgctccgtcccgtccgccttctccttcgggaggtccataaagctgctctggagccaaaataatggggtcacatctcgggagtgacctgttctgccccgcccccacttttcttggcccatgccaggactcactccctttcagcttcaccatggcctccttcagggcccggtagctctccccacacacaaactcacccccactccctggggctggggcctctgcctctggctccttccaggcgaaggccaacagatgagccaggtgcaggcagcacagccttcacaccttccgctgcccacatagccgtgcctgctcctcctgggaactggctccagcagaggtgaaaaatgccacttgaaggcaagaggtgagtattcttgtaggggcatagacagaacaaatgaggcagggaggtggagaacaaccccttcccttggggcctcagagagtgcacctgttggtcacaggtgacaaagtgtctgaccactggctcccggaaggggtgaggggccagagcaatcagaaggtgggaaaaccaagagcataagggggtctgggagggaccacagaggaaggtggcaaagcggggcagggaaagtcaggctcaccgtggcctcccggctctccaggtcctctgggatgtttggcgtgggccgaggcgcctcctcctcctcactgtccagatgttgtcctccatctcctgtagggaggtggccagaggggtcctcagacaacccaacaagggaggtactgtgggcccacctctgtccccaccctgactgtgtaaccctgagccagcctctccccagaggggagtgagctgctgttctttatttttccttttaagaaccaagatcttgctatattgcccaggcacagtcccactaccggtcggtgcgggagtcctgacctgctccctttctgatctggtccagttcattcatccttaggcaacctggtggccccctgctcccaggaggtcaccatattgatgctgaacttagtgcggacacccggttggcataacgaccagctgttctaaaggtctcttccaacccctcaatcctatgctgctaacagtccccccttcctcctggggctctctcctcttcctctgagtggtctcctgtaccttctccagggagagccacgaggcttagctgggtctctagctgttggttctggtggctggcagcttctaggtgctcctaaggggacgggaaacagagtgagaaggcacggaggttgccaggtcatccccctcggggccccgtcctcagcaactccctcccctgggtctcctgcaacttttgtccggccatctcagccaccgctttgccccaagcttcctgctgctgcagctggtccacgaactgggtctgcagcagtaactgcctgtgcagcgcctccttctcagaggtcagctgctgataggtggccatgtactgctgcaggtgacccaggtactagtctcgctgctgctgcagactctgagactcttggctcttcagctccacctgcaggaagaccctgggcatgagggcacatggcggctggcttccagattctgggcccattaatagggtagcgagggcaccgtggggctctgtcacctgcccaggaccctggtcccttgctccaggcctaagaggcttcctcccttgcctagaaccccatacctccttccccagcctcaaatctcatgtccttcttcccaccatttaaactgtaggccacagactggtggaaaagcagagggagccaaccaccatctgctaagtgtgctacatgcctaatgctttccaggtattctctcattcaatcctcagcacctctgcaaggaaaatgctaacttccttttgaagtcacagaaacagagacttagagatgaacagtagttgaatggtgaccagtggaacccaggccagaatccagtttgaatctaaggaggcttttttgttttgttttgagacagtgtcactctgtggcccaggctggagtgcagtggtgcaatctcagctcactgcagcctccaccacgtgggctcaagcgattctcgtgcctcagcctcctgagtagctgggattacaggcatgcgccaccatgcctggctaattttttgttgttgttgttgtaattttagtaggggtgaggtttcgccacgttggccaggctggtctcaaactcctgacctcaagtgattctcctgcctcagcctcccaaagtgctgggattacaggtgcgagccaccgtgcctggataaggagcctcttgtaccactgtctcttcccctgtgattgggggctccatgtctctagctgggatgatgatgtccagacctgggaggagcccagggctacccacctctaaaagtcagagggcaggaagcaagaaacagtcatagagctgcactggagggtgctggggtcacctgcctcccagctggagctgcctttggcctggcacctcccctccccagaggctggtgcccgcctcccagcccttcttggatggggtggaggttaccatctccttcacctcgtctagcttctcctgcagctcctttacttgctgctccaactgcagtgcgctctttttctcgttgttctggacagagagaagcaatcagtggccatccactgcagctggagacaccagaccttggtgtctgcctcccatatcaccaggaagggtggaggcaggttagaaaaatcatcccttctcccccacagccatcagagcagagcccgatgagctgtagctcacaggtgcctttagaagtagcatttcatgtgagggctacactggcccattttacaggtggggaaacaaaggcctggagggatagggatgagggcaggctccccaggtggggcaacccaccagatcctcgaagctgcactgtggctcggccagctgcttgtcgagcttgtggttctgggagagcgcgagcctctcctcctgcttttgtagcctctcctccttcttccacagcctctcctcctggtcccacagcctcttttcctgcttttgcagcctctcctcctcctttcgcagcctctcctcctgtttgcgtagcctctgctcctgctttcgcagcctctcaccctgctcctgtagcgtcttctgctgctcccgaagcctctcgttttgttcacacagtctctcctgctcccgcactctctgcgcctcctgctctcggagcatctcctcctgctcctggagtctctgcttttgttccttgctaaggagactcaaggcctgattgttttccacctgggactggagctttccctccagaccttccacctcctgcctcaggtgtttggcctcatcttgtagctgttccaccacagaggtcactgctgggggcgccagggatgggggctcagctgagaaatgaagcagacaataagggcctctggattccccaacccctctacccacatccccctcaaaaaaaaaaaaaaaacctcctcttgatgcacagctcctctcaggcttcccaaacttggcctcactgctaatcattcctcgcacccaatggtagccaatttccaagccactttcacatagagagcactgtgggtggctgacaacgggcactcctccctctttgctgatggggaccctgaggctcatggagatgacaaaacttgccgtctcctggcacagacctctttccctctgcctcaaagcccttccacccacccacctccctggggcattctaagccacccccacagacctctgatgccagtcctgctccgaggtcacaccagccccatcttacccatctggtttttgagttcggacaagctcctctccagctcctgtatccgatgtatgtcacgcttcttctcttccttcaatgttcgagcctgcccaaagcacaggggaaagggccctggagagaggggctggtggctggacaggctaccatctcattctctgtccccatctccacaaagcccagacccatgaccacctctggctgtactattcccattttacagatgcccagaaagatccagtgacctatctaaagtgggggctgaagggtcagacctcacctccaccgacattttccacatcctctcctgccaccgggccctctctccttttatgtgtttagcatattcgtctcgctctagctggacttgttttagtgactctgtcacctgcaagaaatgggcacagaagttaggaagggctgtcactggtcctcacctgctcctggccacctggggtcatcttccttccacatccctccctctgcaaagcctcacctgtgtcacgtgtgcgttcagcagcgcccgctcctttatggtctgctgtaaccaccgctggaggaccgcttctctgcagctcgaggactggatggtgaagagtgagaagttttgatctggggagctcaggcagtgccccttaaaagggctaggctcaatatacaactcggtcagtaaaggtcaaggcatttccaagcccgtggcctggttattaaaagaactcagtaaagttggaagggagagggaaagagatagaatttacagctggctaacagaggcccagagagatcagataatattgctattgttattactgttattactaccactgtttgaaccgttatggagtgcttcaccaggttccatgctagcaatcccatttaatcctcacaaccaccatatgagacggttactaggattacctctattgtgtagatgaaaaacatcgagtgttcaaggttaagtgcttgcctaagatcacttagacagagctgggatttgaacacccaggtctatcctattctctaagcccatttttcttgctgggggtggggacacagataggaagggggaaattaatcttttgttcactttttgaaaggatgatacattcatatagtccaaaactcagaaggtacagaagggaggtgtctccaggcaccctgttactctctcctgagttttttatgaatgcttgcagacatgtttttgtatattatcatagtacacacacacacacacacacacacacacacacacacacccctttcctctctctacagaaatggtaacatactaaaggtgctcttctgtaccttcacagaacaactacccaataccccacctaggacttggccaaggccacagccaggaaagggcagggcaggcacttggcctctgagctctgcatccagtgctcactccccacagtgccccccaactcacccacagcagctgactcagccccaggctgcctctaacaaccatacacaaaagtagtgagaaatgaccatgctgccttctgggcaggacactccatcctgcagaagggacctttaggctcactcctctatctgggaagccaggctgccaggggatggggcagctggttggactcaccctgtcctcttcctgctgctgtgtagacacagcacagagagcccgctccaattcttgaatacgctgtaaggagtattgcaggcggccagccagatccttggactcttctgtaatgagagaggttgagatggggcccaaaagactccccctaaagacctgtcaaagtgccaggttgaaggatgacgggatgcccagattcccaccttcgaagtgtcgggcagcacgtttagtatggtaaagggtggtcttcaagtctgccttttccaatgtgaggatgttgattgtctggaattgaacgtttgggagaaaagccaaggaaatgctgaaagagaaggaaagaaacattctccagaggacaggagaaagctccccaccctccactcacctctaaccgctccatttgtgctttgtgtatttcattgtttgttttctttgcctgtaggaagaggaagacagagctcttatcacagggaggcagagatggcacagcaagagacatgcccccagaatgccaccaatgccccaggacaggcccacccatgggaccaggttatcagggaccctgtggggatggggtggaatctgatgggtgagccttcttccccaggctgggagtgggcaagatgagactggcgcctctgcatctgagtgtcccccaaacccagcagtcatgttgtgagcaaagaaatcacgttacttcttccagctgatgttccacttgtttcttctgctgtttctgtggggagagtcaaattcaggtgactgagagtggccccctcaactctattccccagacctggaagcggtaggcagggtccaggaatggattttaaaggcaacattctcagaaccaatggcaacacaaactggtcaaccctcttcaagctcccaaggacagaggacttgggtctttgttggtttttgcccacagccacagaactcgaagtctgaatctggattctcttgaaaggacagtaacataaacccctagagagggagtctcaggaaggcccacccttctgccagcttgtgatttagaaaggtgccttcattcaacaaatatttactgaacacatacgggccagctacggttcttcacagcagatataggatggaaaaggacagacaggagcccttggccctcaggtttccattctaggggcctttaaatctcaggctctcagagctaacagagaactctgatgctctacctcctccagaaacacaagcccaaggaggacaggtggcttgtccagactcaaagcaaattagggactgagtcagggcagaaatacagggcccctgacaaccagtcaggctagcgcttccctgagaggtgacaacctcagggcgtgtgtggcaaggactggagcaggggtgtctggagaagagagagtcggcaaagagggcagtgacagaagagccatgctgcgtgctccttgctctggggtccctccaggtgaggcctgggtgctccagctccccatttgcccttggcaccaggggcccccagcccctttcttcagggccccaaggggaaactaaagcccaggattggcagcatggaatcaggggaccccactggacttaccaatgattctatgttttcattgagttgactgattgtcactgagcttgactccagggctactgctagttcttggtactggctctgaggcacatgcagagaggaggagttggaagaggattgtggggagaggtagagagaacaatcattagggctggggtgtgtgtgggctgtctcagctggcagagggtcacccagcccccactgtgagaggaggttggagggctggcctgcaaagtcactgcacctcagcccagggcctcttacttccagatccttcagggtaacagatgatgcaggagtaataaaaatgagaaattaaaaaaaaacttacatgggaaatagttatgtatatggagaaagtataaaaacagcaaggagccgggcacagtggctcacacatgtaatcccagcagttcaggaggctgagacaagtggatcacttgaggtcaggagatcaagatcagcctggccgacatggtgaaactgcatctctactaaaaatacaaagagtagccaggcgtagtggcaggtgcctgtaatcccagctactcaggaggctaaggcaagagaatcacttgaacccgggaggcagaggttgtagtgagccgagatcgcaccactccactccagtctgagtgacagagtgagactctgtctcaaaaaaaaaaaaaaaaaaaaaaaaaaaaaagagcccaaatcccacgtgcctgctctgtacgttattcccagattacttttaaacttttaggcgtcaccatttccaagataataaaagacgcggggaaggaaaaaacccaatcaatcaagcaggtgaagaagcagacagaaacaggctgaaggttaatggcagcaacataaaacaaggcagaggccaagcatcccccaagccagagaagcctcagggccatgcacagctgtagacagcaagccagagaggggtcttggcactgcctcaccttccacttgtccaatgggggagcactaccccattggagtggttaaggttggacacccgcaccttcagaatgtcctgaatctacaggaggtgacaagggaaaaacaagggcagggggtgaaagacagaagtggcttagagagaagcaagaaagtcagggtaggaggaagatgtgggttcaggaaaaggaaacgctgaagaagagcagaggagattaaaaccatggcctgtgccattcttccaaatggccacctgctgccttgccaggggcaggaaaaaatagatggaaaagtcccccgagtgacgcagtcacagagtggagtcagctgaccaatgcagatcttaatacgctcactggacccctctcctcaggcccaggacatgggcgatgaatctggtagagctccagacctccacctccattaaaaaaaaacagactcctgagtaagagttcacttgaactaaggggacttcagctaaaaaacaagtttgaaagacactgatcttatccagtatcatcttacagaggaggaaactgaggcccagcagaagaagtgatttttctgtggtcacccagcaagctggtggcaagttagaccttctcttgctcctagtgccttgggctctcctcaccacaccctgggcccccttcagtgactcctagagggacagcctgatggcaagtggctgtactcattagcccagcttccccttgcgagtggggatcaggaaaatcaaacagcaatgaccatttcctgggtatcctgggtgtttacagcaggccacgtactgggggttaacatgaaaacaacaacaataaggaatctcatttaaacttcacaaatggaagtcaaacaatactacccctattttacagatgtgaaaagagaggcccaaagagctcaagcaacttgccataaatcagatcgctagcagatgaagaagcaggattcaaacccagaattcttaaccagtacccagcaatctcaacaattaccctctactgccccttgggccccctgtccccaggagcctggccagccaagactcacatccccaggtgagtggcaaccaccggaagtggttgtctcagggctactgtcagtttttttcttttttgtctttgctcctgctggaataccagggctcttcctttgctgatattcttttagctgtgggaaagaagagcagtaatactcatgagaactaccagcccttacagccacaccctccttacagtttttgcaaaatactcttatacaccatctgatttaatgccaccaacaactgtacaaggtgttgtcacaatcacttaagtgactgagagggatggatattatggctaaaaaaaaaagtgtgggggggcaataatggaacttaaactcagtcttctgactccaagctctggggttttgccatgaatcagcagctgccggggaccaaaaccagacgcagaggtagaaaagtaaacattacataggcatgaactacacgctgtgtggtttagagtcatacatcctcaaatgcctgttagtgtgaagaagtgcaccagtatctctcaaacttttatatcaatgtgtcctcatggcagaaggcagcttttttgttaaatctgggaatttatcagaaagaggacaacccaagtctcatttcagagagaagtctggtatactcttagaaacctatgtgagggtcacccctaagtacattaatgttttttctctctcaagagaatcaagggaaactgatgcttcagaaagatctcccacatttatcctgtggcactcaatgtaccctaagttgagatgatatgaggaagattcaagctgtcaagttcagtttcccaagacctattccacagaagatgagcaaatctcacttcagagaccactgactgaagggcagtctggtcccagaaccgtggagaattagaatatgaggtggagaactcggaaaaaaatgttaaagtctctctggagagtagaagcctgggagaaaaccaaaccaaacccattctcccattaccacccagagatactgtcaacgttttgagctcacaggggaagtgtaggcttttcacactgtcgatgtctatgtgaagggagtaaggcagcctgaaacctcttgctcctaggtcccatggtccccatttcccttctagctggaaatttgtgctgtgaccagaggaaccagaaatggggtgagaatgcttaggggactgggttataagatcaaaggccggtcttgcagcagtaatgacagttcctaggaggactgtgacatcactacattccactcctcctgggggtgggggaaacctcatcagtgcaatggctgagttgccgatccacgatgggggaggggggacgtggggctgggacccaggtccttggagatgccagtccagagagcccagggaggtcgggcttgggtcagcaggaggggagagcagagtctgctcagggaaccccaggagtcaccagcccaaagtcaccccgggatgactggcgatgctggggggttggggctgggggacccaggtccttggagaggtgagcccaaagaacccagggaggttgggcttggggtggcaggacgtgagggctgaatatggagcaggtatccccagtagtcatccgcccaaagtcaccgcagggtgattggcgagggcagaggctgggctgcttgctgaaggggcggggctgactgacaagacgttggtggggggagtccagaggcgccggggtaggggggcccagcccggtgtgcctcaggagtggtatggactctgggagtggtcttgtcatcagaggggatctctggctaggttggggggccatgacctttttcttggctttttacctttttcttggctgctgccaatttattctgtcgagattcttctaacatcatggggtggggagggaggtagggttggggccacatcagcgaacacctccagtcacctacaaggctgctgtgtgactgagccagaggaggcgtaaccagggccacactagaatgcagaataggggtgtggccttaatgctccaatcccattggtcaatgagaaagatgaaagggaaaggaggcgtggccaggcagcagtgtgcccagaggaacctgtgacatcacaaggaaagctgcccatgcgactgctgtccctgcccacttggggagaggggcggggcctgcctactccgggagaggggagggctggtttttgctttaaaatgttaaaaataaactttaaaaaaatatgtatttatactttatatatatgtgtgtcagtgtgtgtgtgtctacatgttcctccagagctgtcttcattatccagcttctatgcatggtctatgattttggcctacatttttcatcttcagagggagtataagaattaccagtattaccccagttaagacacaaatcctataaaaatggaaaatccatagcatgtttgatgattaatgaatgaagtggactatattatccaacatcccaataaggtaaaataatcacaatgatttctcggctttggaaaaaacatttctcttattctcctacattattaagattttttaaaaaacaagaaacatgtctaatatctttaaaaacacaaagcttttgggccgggtgtggtggctcacacctgtaatcccagcactttgggaggcctaggtgggtggatcaccttaggtcaggagttcaagaccagcctggccaacatggtgaaaccctgtctctactcgaaatacaaaaactagccaggtgtggtggtgggtacccgtaatcccagctactggggaggctgaggcaggagaatcacttgaacccgggaggcggaagttgcagtgagccaaggtcacgccactgcactccagcctgggtgacagactgagactccatctcaaaaaaataaaataaaatagtcaaaaataaataaaaacacaaagctttccatttaataagcactcaaagctctttactggtttaaagcaaatacaaggcctatttttctagaatcacctggcctctctaagccttgcaaatgaaactgaatttctcacttgatacttggctatgacttgcaatcatgaaaaccaagaattgtgttatgtcactgtgtattgattgttacctgaattccacactaggctgggatcaagggttgaatctttcatgatttgctccataacctgtgagcgtcttttcctacaccaaactaagctttgttctagagttctacaatttacagttagtagacaagagtggttctcaaaaatgtagtctctggactagcagcagcagcagaacctgagaaccttttataagtgcaaattctcaggccccaccctggacatggtgaatcagaaactctggagtagggctcagcaatctgtgctgcagtcatccctccaggtgttcaagaacctctggcatacagcaggcagaaaaatgtgtttccttctgtaggtccaaagccagggataccatatgttctgtcttgatatgaaacaatggcatgcaattaaaagacataaatctccttcctgctcccaccctccatccaatgtgttttatttttatgagttaaataagaaaacaaacggcaatcagagattcagcctaaaaagtatgtttacaagtgtcagttctcatccagcctgatctcacacaataccatttacaccctcttccctctcaggttttttaaaaagtgtcttcacaatgtaagtctcgggcacactagcagttctataataaaacaccaagtagatcagaatgtccaaacttactagagaagaaaagtggaatcactggctgtattttcaagttgcattcaacaggaaatgtaagtttttcattcttttcaccttcacacttcaatagcattaaatcagaatactccattcttccaaagcctctagccaggcaaagttttactgtattacttcttgctttcaatagatataaagcagagtcctggtaggcacattttgtatgcctgcaaagatgcagaagtaaacagttccatctattcaatattaaaacaaaagtcctgcaaacctcggatggtgagtgtaatacttcagcactagcaccaaagcctcaaatataaacagataccaatatcaccactagcaaacaaaatgagccctcggccaggagcagtagttcacacctgtaatcccaacactttggcaagccaaggtgggaggatcactttaagtcaggagttcaagaccagcctgggcagcatagtgaattcacatctctacaaaaaatcttaaaaattagctgggggtggtggcacacacctgtagtcctagctacttggaaggctgatgtatgaaaactgcttcagctcaggagtacgacgctgtggtagctatgatcatgccactgcactccagcctgggtgacagagcaagatctagataattacagtctgtcctgctcctgtttatgttaaaatgctttcaatcagcaggataaaaattaagtgaaatgtgacttgggagcttggccagaaaataggcaatggagaaacaggcacttcccacaagaataaaaatggccaataagcacataaaaatgattcaaggccagggccgtggctcacgcctgtaatcccagcactttaggaggccgaggtgggtggatcacctgaggtcaagagtttgagacgggcctgaccaacatggtgaaatcccatctctactaaaaaatacaaaaattagccaggcatggcggtgggcacctgtaatcccagctactcgggaagctgaggcaggagaatcgcttgaacccaggaggcagaggttgcagttatccgagattgcactgttgcacaccagcctgagccatagagcaagactccatctcaaaaaaaaaaaaaagtttcaaaagcactagaaaccaaagaaatacaatgaaaacaatgagattttctccttaaatatcagcaaagaggacaaatggaaacgggatactggagctctgcccctgttgggagtataaactgaaccaatttttctgcaggataatttgaaaatttctattaaaaatcttaaaactattttatgttatttttctccagaaattctacttctatgacttcagccccaaaatgcttgcttgcgtccattaaaatatatatataagaaaatttacttctggggtggcaatgattaacttaatacacatcgagcttttaaaaagatgatgccaaggatatatttactgccatagaaatatgcccaaaacatagtgacaaaagactatatattacgattctactttttaaaatgttcatatgcataaaaaaatataaaaagcaacaaaccagaatgctttcagtggcaaaattaaagacttttcttcatattttgtcttccaaattattacaaaaagaatgcaattttctttataatcagggagaagtattattttcatttatttacatataaatttcttttcttttccttatttcttctaatgtatgtatcacatgtaccctaagagcttgaatccctacttcttgaggtaaatcagaccatttctgtctctatcaacttgccttttttggacatttcaaatcaacagaattatacaatatgtggtcacatgtctggctttttacttagctaaggtttttgaggttggtccatgacatataacaggttttggtagtttgttcctttcattactgagtagaagtccattgatggatatataccacattttgtcagcagagaacatttaaactttgctttcaacttcccgtggtctaaatgaaaccgctggaacacaggacttacagtgaaacctgctgtgcatgtcaaaagaactacttatcagaaccagctttgtcatcaggagcctgaactgctgcagaaatttttatcattttgcaacttcctttttacaagcagcttttgtgctactacacatcaggacttttgaagcatctgatacatccatctaataagtatgagcatgtgtctgagtggacaagtacaaccatctatgctacactgcatattttttcctcccccagactggaccagggaatctctcaactttctagagtatcctgtctccattgacaaagctgaacagtattaaagatcctgctgcctttgttaggcagatttggaagggaggcccaacagcaagggtggagaggaaaaagagaggggagcttgtggaacaggaagccccctggggtctgcacatggctcccagctgttgaggatgttgtggatggggaagtgctgatggtgtcccgaggcaagcctagcacctgcactgggcccagaaggtcttgactttggccccttacccacgttccagaagtgtttacaagctggttttgcttttcttcttttcccaaataatcattacttggtagttagttattaacctttctttgggagagggacagagctttaaaactgaagaacataattttcattaaaatatcaaaaatggaaaaaagttactttgtaaacaatttgctatacaaaccaaatggcagctgttgagaatctcaataaagtgttaaatgcatttgctgctgttagaagaaatacagtaaaaatatttaaaataaagaaaaaaatttgctggcagtggtaccatttgcccaaggttgggttgctgtgtcgtcatactgtggtggggggtatatgtggtgtatatgtgtgaaactcttcatctcaggatggatcataatgtgagctgcagttttccttccaaatagggttacaaagtagtaaaacatgggcttggaagtgacagacctgagtgaatcagccaagcttaaagaaaaacccaataaaattaacttttaataatcctgacgttggtttttgaaacaatagatacaatgatttactctaagcatcaggttatgattttgaatcagtaatacacactgtctcgacctttttctttttttatggaaacagaggtttcacccagaaaactccaaaacagtgactttttttttttttttaagacagggtgtcactctgtcgcccaggctgcagtggagtggtggatctcagctcactgcagcctcgacctcccacctcagcctcccgagtagctgggaccacaggcaccaccgtgcctggctaattattgtattttgtgtacagacggggttttgccatgttgcccagggtggtctcagacttctaggctccagccgttcacccacttcagcctcccaaggtgctgtgtgtacaggtgcgagccactgtgcccaacctgcattgactttttaaaacataagttcaagcatctcttcctaactcctttaattggaggtatctcttctctcattctcctcatctttggtgttcccccagagttcactgctgtctggatgtacaacatatatttcaaagtcaaggctgggctgggtgcagtggctcacgcctataattgcagcactttgggagtccaaggcaggcagatcgcttgagttcaggcaaggtaaggcaggctcccaaggcagagactgaggctgacccctgcagccccctactgcagggaggaacaccgggataggcaagggtcttaacctagaaagccccagcagttcctgtgaccattgaggcttggcggtggtggaacccaggaatggtctttgaacccaccacctggaaggggagccaaggatagtcctggcccaaaggctcccctacctgcaggcagtgtggaggcccagtgagtggaccccaggagcccagaccatgagcttacctggccaaagacagcagccagcaccaagacacgaaagagggcgggtagaaagatcatcacataggggttgactgcggccggcaccaggttcctctgtacttctggaacacacaggcccctccttcctatccctgaagtgcccctgcccctaccccagcaccctgaagaccagcccaatatatgcatttgtcctgggtcagccccactgtccaagcaactgcaatttctcactagagagccagggcagggcagggtataggaggggtccctggaagatgccccccagaatgccctgatgcctaaaacgttccccgttgggccttctcagggagggagggttaagacagccttgttctctccagctacctccatcaccactggagcccttacgggcgtcaggggagagaattggctcactggagccaggaacagcatggacacagccctggggctgaggctaagtgggctctgggagaccgtcactctctcttcaagctttggtctcctggccctctacaagccaggctgtttcaggctttgcgttaggccttgctcagagacagagttgaaacacagctggtggacacagtgggctttagggaggtggcacgtacctgggggtgggggctgggtaacagggaacggaggccctggggctagcatggcctgtctggaggtggcacaatgggacctgcaccacatgaggacagagggtccacctggaggagtggatcagccagatggccaccaagctggatggccaccgccagagcctgcaggacagcagagggggctaggaagggacagaggacagctgaggggcagggaatgtgggttcctccatacagacacttgagtcttccctaagtgggtcttccccatgggggtgagggggcattcaagacacacctccagcccacctcaaactatcacaggaggccaccaccaactcacacaggccagttgcattctcacagtgaccccagaacagcacagccctgtctttcagataaataaatggagagagtgatgcatatcacagccaggagctgggactcagacccaggtccagctgcagtgctgcctcaatggctccacctgcacctcctccgggactcagttcctgctaacaaatgaacacttgagtatgggtgaaataggtgctattatcccttctggctgctggggaaagggaagcaaggcacagatgacttgcccaaggccaacatatcatgactggttcaaccccatctgtctcagccagcacatccccatggcagaggctttactgtgatccaaacctggaaggtggcactccttccaatgtcccacccagggcacagagcatgcagccccatgtttggggaggtgacagggtggggaggtgacagtgtgggaaacaatctggctaggcgaaggcctcatggagcccagggttccctaggaccaggagagctctggagcccacactgacacccattggaaacctggaatccacacctgcaggagatcaggagaggggttcggcctccgatgcacctgcagcaaggtgagacaggcacaggtgggcgccctgcttccaaccagtgtcaggtgggcaggaagcagatctcctccctgaccttcctctcctgcctcccccaagcagaggagaaggggcagccgcccatcaggccattgcccagattgaagccactgaagctaggtcccaacaggtgagtgtgacccctgactatcccaggcccggcccaaggcagtcatgtctctggtgaggacctggtagacagatgtgatgtccccaagtggttctataaaccttttgaggataatcaaggaaatgggcaagaacatcatgctcagccaagaacctgataggcacaagggggaccagggcaggtaaaagtcagtttgggttcaggcctggcccctggaaggatggtggatgaagagccagccacggtgaaagggaatggatggccacgggctgggtggtcaggactgtcagctcctgcagcccctgcagaacatccgcccaggcctggctctgtgctcagcgttctgcgtggagccacaggtgcctggacaccgatctcaagtagggatggtggtaagaaaggtacttgtggccacaggtgggcacctaagcatgggacagaggggtatcatgccccaaagaaatcatagaggccaagagcttaagcatatgtgacaccatcaataaatccccttgtcctgggtcacgtcaattaagtcagagcctaccctgaccctgaagctgcagctcagtctggttgagacacacagagatgttagtgctgggcagggggcctggcccagcctgcgatgtccagcaaagctgtgggctggacaagaatctctgaagattagtccaggacaaggacagctgtgtctgggcagggagtgggggcaatgcccagggggcaggagacctgaggacctttaggtaggatgccaggtcaggacgtgcagaagagaaggtggcatggcagcatcctgcccgaggccaggctataaacctcggggccgccccgtctagcctaaaccatgctgacacccagatgccatccttcaaatgtgaggcagggctgggagagcccccagacccctcatccctcccatcccaagctggttcccatcccttaccagaaggaaagtgaactcttctatgggacacagcctgccaggttctctatcacctgggggaaggggctgggggaagggagagctgcagctgggtgagaaagaacccaggtcccactctttccctatctgacaggtgacctccggcaagctgctttctttgcctggggctaaggagagtcacaggggagcggccaggttaagagggctccaccttggagcccagagctacccacagagaaaaccccccatcctcccaattctgctcccagctcatgctgctgggataacatcccccccatcagagaggccgtgggaggcagaggctgacctttgctccttcaggcccctcagcgggtttgggtccaccttcatcatgatcagggggcgagtccctgggattgcaaaggtgagggacagcttcttgggctccaggtgctccaagggagaccctgcagggcaccagagctagaagagtgttagggaggctgggtgcagtggctcaggcctgtaatctcaacactttgaaagcctgaggtgggcggatcacgaggtcaggagatcaagaccacgctggctaacacagtgaaaccccatctctactaaaactacaaaaaattagccgggtgtggtggcatgcacctgtagttccacctacttgggaggctgaggcaggagaatcacttgaacccgggaggcagggctgaacagtgctaggacctgagctctgcctggccatggtgactctgagccacgtaaccctacgttagtctcagtctgtcactgtgtctcacgggggatgtcagcattacttttggagtcaaagtaggtaagccagggtaaccagagttccctgcagggaccaagaccaaaggatgcaggggctgggcctatcccagaaggtcaggctggacgaggggctccatgaagttggggcagctgagggcctgcccttcaggttacaggcatctggatcctggtctagaccctcatatgccatccagagacccaaccctagggaccctacccaggctggtagcagagagtcgatccttgtactcaccccaccaaaagctctgaaatgagggggcctatgggtgggggaaagactcttcagaaaaaggttctcagggtcagggaaggtttgagctgggccttagggcagccagagaggcaggtgacaggtctcctcacaaagcctgccagagaatgcaggaggaacacaggtgtagtggtgagagtgttctggaagacagcaggaagcctcctactcactgatggggctgagtgaggtcaggtccacacaccaggagaagctggaatccacacactggtgcactttgtttcttgtttcagaggcagggtcttgctctgttgcccaggctggattgtggtggtgcaatcacacctcactgcagcctggacctcctgggttcatgcaatcttcccaccttagcctcctgagtagctgtgactacaggtgcatgccaccatgcctaattttatttttttcaagacagggtctgactatgttgcccaggctggtctgaagcgatctttccacctcagcctcccaaaacactgagactacagggacaagccagtgctcctggccatgctggtgcattttctgccatggtgcacaggaagtatgagctggggggcagaatctgctcctggacctctacccaggcctgcacccagactgacccctgggctgtagggagcaggtgtggagagaatgcagcgagcagtacgggttacccagtgatggagacccaggctgggactaggagagatagggctccaaccctcagcctagtggccctgcccaaccccttggcgccaagatgactttctaggaagccaggcatggaggccagcatgcacctgaactgaggacagaagattctgatgagagggagggggaggcctctgacatagtttggatacttgtcccatccacatctcgtgttgaaatgtgatccccaatgctggagatggggcctatagtgtgaggtgtttgggtcatggtgggggatccctcatgaatggcttagtgccctccccatggtaatgagtgagttttcttattttttatttttttattttttgaggcagagtctcgctcatagcccaggctggagtgcagtggcatgatcttggctcactgcaacctccacttcccaggttcaagtgattcaatgagtgagttttctattagttcacaggagagcttgatgcctcctctctcttgcttattctctcaccatgcgacatgtctgctccctctttgcctcacactagaagtaaaagcttcctgaggcttcaccagaagcctagcagatgcttgtacagcctacagaactgtgaggcaaataaacctcttttataaattaccagtctcagtgccaggagtggtggctcatgcctgtaatcccaatattttgggaggctgaggcgggtgaatcacttgaggtcaggagttcaaggccagcctgaccaacctggtgaaaccctgtctactaaaaatacaaaattaggcgggcatggtggtgcgtgcctgtaatccaagctacttgggaggctgaggcatgaaaattgcttgaactgggaggcagaggttgcaatgagttgagatcacaacattgcactctagcctgggccacaacagcgaaactccatttcaaaaccctgtctctactaaagatacaaaaaattagccaggcatggtggtgcatggctgtaattccagctactcaggaggctgaggcaggagagtagcctgaacccaggaggcagaggttgcagtgccctgagattgtgccactgtactctagcctgggcgacagagctagacttcatctcaaaaataaataaataagccagtctcaagtattcctctagagcaatgcaaagcggactaatataatgtctactggacctgacactcagggaagggctggtctttactctgccattaacagccagactatgacagagttgttcccctgctctgcctcagtttgtcctctctcagctgagcagagcagggataattgcttctcatgtgggccacaggacaaaacaaagccctgagtcccacaggaagataggtgggctatgtccaagggaagacagaagtggggcagtattttatgtccccagggtggcagagggacatggaaaagatgcctcctttgtggacaaaggagaaaggaagataagcagagaggcgccagacacccgcctcacccccacctcccccaccccacaccaggcccattcccactcagcccccaactcaggctgcaccattccccttacggtcagcatgacttcccagccaagctgacagaagctgacagcttggattcatcagggacagcgcgtagtgtaggtgatgtgcaggatggaagtggagaggggagacgggagccgtggtgtcaggtctggggctgccaacatggtacctgccctggccgtgggcagaccatgctggtccaccctgccagatgtggcctctaattctaaggtctctgagttccaggccaggactggagccatactccccttggggacaggggacacagtacacatagacattacttgtgctttgggcaaagccagctggacaaatgaatgaaaggggccctgctggagggtaaaactgggcctggactactcagacctgcctctgtgacaggacggtcccatccttccaatcagactcctgagctggaagcctacccagccagggagtggggaaggggtggcctgcagtctcccttgagtctgtagcccctcccacccaagtcagctccataaaaaaagatgcagaaaccccaagtgctcctcccagctgctggctgcttcccggcatggcctgaaggaccctggatgaatcaagacaggcctgccagcagctgggggaagggggaaagctgggtccccagggtggatgcctagcaggaacgtgcaggcatggcgagtgatgggccctcagggctgagccccttctgcccaggggaccttggtgacacacctgctgctgagctcagcccaaggagtaagagcctggtgccaagtggcctctctgcttatgaagacagtcctgggattgttacccctctgcccagggctcaagtatccaggctggggaagggccagcagtcagaaagaaggaggccgtgggtgtgggtcccctagcagtcaggggccttggtggactaagcccctatgagggggatgagagggaagggagactgagctgtaccccctaccctgagatctgtggtaccaggctccagagggggccccggggggagaccagcatgacaggaactgctacgatgcctttgggcacctactctgcagggctgggccagcctgaggttggcagcagaggggtgggccaggggccacaaggaatgaagctttgtttggtagagctgtgaccctcttcatcctcttctgaccccccagctgacccttgtcctcagatctctgcagaactttgaccaagcggtggtggaggaattccagtgggtccggggtggccctgggtgacccagggctcataccggggttctggggttgaggacaggaggctggaagagatgacctcccctagtcccccaaggctgcacagacccctgaagtctgtgataatcctctcagcaggctggacccactgaccgccagagtgggtgccaccttcttcagggtggcgccagcccaggccgtcatgtggcactgtgcacgccagggcctgcacaccctgtgggaggcagcgggcgtcttggtagacacggtcatcctagacctcggtcagtacctccttccctctgcaggctgcctccctctgtccctctgcctcctcccttgggctcgctgcctccacatgccctgatctgaagcctgcctcccctcctcatggagccctctaaggtgctcctagccccagctctctggtcccgcagcaacttctgggcccagattctgtcttctcagaagtctgagaggcagagccccgcctggccatagccttcttgctctgctctaggcagtcctagccccaaagcctccagcctgctggatgcctttatctccagctatgccatggctctcctcatcctgggcctcctgctcatcacagttgcccttgtcctggtgagtgtctggcttggccagggctccttcctgagtggcaggctgagcctttgacgccttgagcctttgagccaagctgaggggtgagcaggcccctttacacccctgatttccccatccaagcccagcgtctcctcatcctccagctggggccgtgggatttggggccaaagagttgggcctgatcccagtgtccccgcccttcttgtcaaggtgctaaacttgagggcatgccttgggtgctgactttcccaggaactcagagccagagagggccaggcaccagcctgaggccaaacagccaggggcttcttccttcctagacccccaaggactggacttgcagggctgggacagaggtggggtgggggaaagcaatgccttgtcaacccatgcagggagccccactcccatccccaaggtgcacaaagtcgagaaacacccctgttcccatgtccatgctcactcagggccctgctccaagtgcttggcactcacaccagcctcctgtcctccatgccacaggtatcggtctcatttacagagggggaaatggtggccaaaagcctcccccagcacacacggctagaccacacagaggtcttaggtgcagctgaggggtccacagtctctgctgtcccttctgccactcgtgctgccagggaccacgctttggagagggaggaatgagagtgagctgggtgctcacacatggggcacgggggactaaggaagggtcagccaggaggaaagggcaaggtctgatcctgtacgtacacatcacagagcgcgcggggtcaggagaccgagggccacgtcccggctctgcggctgctcggtatgtgactgcggttaaattgtctccctggactctccacgcactttgtgtgctgcgtgcaccttctaggatgagcccggaccctggctggcctcatacttactgcgtaggctgcagacccgcaagtgcttctgcaaggggctttgcttctcctcataacagcagcacgggctggccgcgtgctctgggggtagaatggagaagctctggaggtagcaggtgggggctgggcttgggctcctggcccagacagggcagggtacacctcagggtcacagggcctggcccactctctagcagcccttggcccacaggctgcccagctgcccacccacaacccgtacctttgggcagccccagctgctgcagttcactggccaaggatttgccatcgacactgtgcttggccgcaccggagaggatgaaactcagcactgccactgtggccttcacatcgcctgactctcagggacccatgcatgggacagggggtgtcactgtgggcccagccacctccctgttgccctattaacttcagctcaaagcccccaggcctcctggagccataggcactgctactgctccaccaggagctggcagaggacaggaaggtgggactgtcaatgtctttctttccctcatgctcctccactagggaaggcaggttaaggatactgctgggatgtgtgtgttggcgggggggtggggggcgggctctgtaccaggcaccaggccgaggtcccagggttgcctggggcctgtgaactcagcggggtgctcaccaaacttggcatcagctgtgagtttcaggatcttcttatactatggggaaaggagaccttcagggggtgccaggtccctgctcaccagcccctcacccccagcctggatcctgcaataaggaacagacaggctggaaagaaggaagggaggtacccagagaggttgagaggctggctcacccgtctccccgggcctagtgcagagtttcagggcagtggtggtcataaggtcatgggacaatggggtgctggatcttgtactcacatcaattccctgtcccagcagctcctttagtacctggctgcagagcagctgcaacttcacagaggactggaaaggaagtccttacatcagccaggctggcaaacctcaccccttcttcctggggactggctcaaagcaggccagccactgatcaaggtcacaaagcatggtagcacaggctgagagcactgaggccctagccccagagaaacctcaccatcctctacagccacaatccccagcccaacacccctcctccacccagtgtagaccctgtgcactcaaccatcttggccagcgtgctgatctctgccaggacccggtcaggacagtccagatcaccacagaaccgaaacctctgcaagggagggaggcaggtaatcaggctggaaagaagactgaggtgtggccaggatccctgtgtctcccacactgctgcccagcagggacccctggtccccgacatagatggataccctctggccacttgttctcccctatcaccaggctgttgagtaaactctacctgacccaccctgccaccaaaccctgctctgaggtctactccaggcattcatctgctcagcaaacatcaattgagcaccttctctgtgctagctcccactctaagtgctgggggtacagcatgggataaaacaaagtcctgggcctcacagagacgagtgaactctctcccttcttccccatacccacacaactccagccactccagcttccctgctgcagctcagggacaccagccttgcttccgctgcactctctatgtggcttgctatcctttatttcattccactctctgctcaagtgacacctcatcagaccagcccttctttttttttttttttttaaagacggagtctcgctctgttgcccaggctggagtgcaatggcacaatctcggctcactgcaacctccacctcccgggttcaagcaattctcctgcctcagcctcccaagtagctgggactacaggcatgcgtcaccacacccaacttttttgtatttttggtaaagacagggtttcactgtgttggccatgctaatctcgaactcctgacctcaggtcatctgcacactttggcctctcaaagtgctgggattacaggcgtgagccactccaccctggcaggccagcccttcttgatcatacttcctaaaacagcccctaacacaaggaaattttgggggccggtggatatattcgttatcttgattgtggtgatccaacagtcaggaagatttggcctttacttgtccagactcatctttccctaacctccagatgatactctcccagctatgggaaatgcattcattcctggggagccatgctctctctcacctgaagtctctgcacatgctgttccctgtctgaagacacacgcctcccaccgttgcctcccaacccctggtacacaaactgtacttcagccagccaactcctgccatcgcctttaaggttgaaggcatcctcaggaagcccccttagcactacacacaaggcgcagttaggtctctgcccctggagccttaactatgactgccaattcaagcctctgatttccccttcccgcggcagctcaagtcctcccagtgcctagtacaattcatggtatagactaggcactttgaacctatggatggatggattggatgaatggatggataagtatcagccccaaaactactactttctggatctgaaaagagcggagtggcttcctaacagtgtgcaagagtgagcctgattctagcactttcctgtccaagtcccacagcagggctggggaagggggtgtccttgggaggtccttttggagctagagaagacctgaaaggactcccagctccagacaagccctagttcctgccccaggagtcaggggcccttccttccgccagggaagcagggaactctaagccggccggcctgctctgtcttacccgccccattcgggagagggatggcggtggacttttctctaccagacctgctgccctgacgcccgcacacactgtgtttgcggagcggccagtgcagacaacctcaacccgtttccggagccactggcgccccctcattcccgctccagcagcccatgcccgcttcacccctggtgcctcatacatcgcgcgaggaagccagggcccgggaatttctttttccggtcccgccaggtcagctgagtcgacgatcacgtgacttggactaacggcctctggcggggcgggacctgctcgagtgaggccgggagcggaccgcagcccgctggaggtgccgggggcgaaatgctggcgtctgctcctccgtctcccagaatcctgccctggaaaaaaccagcgccaaccgccggtttaactgaggacggatttaaggcattacgaaagacagtggaagttatttcttttacttttattttcgttaacttaagggggtaggatcccgggagccagggagattcaggtcattgccatgttttccactgttaagcgaatagcattatacacagctgcgggctgtggcaaaaaacattttaaaaacttttcaaatatattacacatacagaaaattgtacctattagaaatataaagcttaataagttttcatcaactgtagacctcacataaccagcacccagataaggaaataaccaggtaacttcttcaagtgcatgggtattttatttcattttgatgaatcgtctaggtgcctagtaaaaagggctgtcataattaacatgctcaggaaaaactccccacagcttcaacatcactagatcttatcttaatttttgccagtctgatgggtaaaaaaaaaatcggttgcttagattgcagtggtagtctgattactggtagctttgagctaatgggtagtctagaacaactaagtttccgacgttgacttgaagaggcaaaaacaaaaagacaaaacaacaacaaaaatacattaaagaataaactaataaccaaagaagaaattgaatacagtcgtcgcttagtaacctcaagatactggttccaggaccccagagataccaaaattcacagatgctcaagttcctgatataatgtggcatagtatttgcatataacctatgcacatccttccgtatactttaaatcatctctagattgctataatacctaatacaacataaatgctttgtaaatagctgatataaagtatttttaaatttttgtgtttttttattgttttactttttccaaatatttttgatgcacagttggttaaatccaaggacccagaacccgaggatacagaaggctgaccatagtttgagctctctcctcaattccatgcctatcccatgcaccaggtgcagctggttttattgttgcaggctttcaagttttcaaaagacagacctcatgacaagtaaactgctctatagaatagaaatagaaagtgtcccaattcatggtaaaattgaactcatttctgaagagttattttacaaatcataagcactatcctcttgaaagcaacagtgtgttaagttactagactatcctataccatgtcaaagaaaaattttaagaacataagacctgtaatcatagcactttgggaggccaaggccagtggatcgcttgagcccaggagttctagaccagcttgggcaacatagggagaccccagtctctacaaaaaattagctgcttgtgctggtgcacacgtgtcatcccatctacctaagaggctgagatgggaggatctcttgagcatgggaggtggaggctgcagtgagccatgatggcgccactgtactccatccagcctgagcaacagaatgagaccatctcaaaacaaaaaaaggaaaagaaaaaaagctgggtgcggtggctcatgcctgtaatcctagcactttgggaggccgaggcaggcagatcacctgaggtcaggagttggagaccagtgtggccaacatggcaaaacccgtctctactgtaaataaataaatacaaattagctgggcatggtgctgggtgcctgtaatcccagcctcaggagactgagtcacaagaatcgcttgaacccgggaggtgggggttgcagtgagccgagattgcaccactgcatttcagtcaacttgagcaacaaggtgagaaaaaaaaaaaaagatgtaggaatggttcaacttttatttcatgctgtcagtaggttaaagaagagaaaaatggatagttttgggaccattttttatttaaaaagaaaattaggaacagatgaaaactgtcttatcttaagagtatttgaaaaacaaaacagcaaatttaacattagacagacaaaatatttaaattcagaaataaagttaaaaggtgggtggtgcgcccttttaatgtcatactgagcattgtttcatagatacttgttttactattaaagattgactatttagagcagtgtttctcaaacattagagtgcatcctaatcacttgcaaggcttgtgaaatgggctgctgggccccacaccagagtttctaactcaataggactgaggtggggcctgagcattgcatgtctgtgttcccaggtgacactggtgcttccaatttgagaccatggtttgaaaaccactaatgtagggaaatatactagagaatatgttatgaatatatgtgagaatatgtatatatgttaacgtacagatttcagtacagtagaaaagataactcccaaagatgacagttttatttcccaataggatttttttttttgagtcagaatcttgctctgttgtccaggctggagtgcagtggcatgatcttggctcactacagccttcacctcccagttcaagcaattctcctgcctcagccttctgagtagctgggactacaagcacccaccattgcgcctggctaatttttgtatttttagtagagacagggtttcaccatgttggccaggctggtcttgaactcctgacctcaggtgatccacccacctcagcctcccaaagtgctgggattacaggcctgagccaccacgcccggcctccctttaggatattaacaagttttgtctctatctcagaatgcatttcggaatgcccttcctggagcactacagacactgtctctcaaaacgctccttgaactagcttcaccgtgttgctgactcccttgtaaattaaagaaaatatcttatacgtattccttcattatttgtatgaaagtcaagcttttcatattgtgaaaattatacttcaggctgggtgcagtggctgatgcctataatcccaggacttctggaggctgaagtggctggatcactcgaggccaggagtttgacaccagcctagccaacatgtcgaaccccatgtgtactaaaaacaaaatcaaaattagctgggcattggtggcacacacctgtagttccagctgctcgggaggctgaggcacaagaattgcttgaacccaggaggctgaggctgcagtgagccaaggttgccatgagctgatattgtgccactgcactccagccagagccagagtgagactctgtcccaaagaaaaaaaagaaagaaaattatactttgatacagtatgctaatataaaggatatgatatggcttggttctgtgtccccatccaaatctcaccttgaattgcaataatccccacatgtcaagggtgggaccaggtggagataattgaatcatgggggtggtttctcccatgctgttctcatgatagtaagtgagttctcaccagatctgatgattttattacaggctttcccctttgctcggctctccttctctctcctgctgccctgtgaagaggtgtcttctgccataattgtaagtttcctgaggcctccccggccatgcagaactgtgagtcaatttaaacctcttttctttataaattacccagtcttgggtatttcttcatagcagcatgagaatggactaatacagtgtactaataacagcccagacagtagtatacaggtactactatactttgatgctagaggtattcccattaaggtcaggagcagtatgtgctatcattaccatgatctaacattgttccagagggttttaggtcagcagttctcaactggaggtgattttgccgccctggggatatttgacaatatctgaaatcactttggctgtcacactgaggagtgctgctggcatgtggcaggcggaggctggggatgctgctaaacatcctgcgaggcgcaaacagctccagaacagagaactgtccagccctaaacatcaacagtgctgctgtggagaaagcctggtctagacaaataaaacatgggaaatccattaacataaatgtgggtggataataaactggtatttgccaatggcagtctagctaggaggtccaaaaggagcacctgaagaacagttagattttgcaggggctgcatggtggctcatgcctgtaaccccagtgcattgtgaggtcacattgggaggatctcttgaggccaggagttcaagaccagcctgggcaacatagtgagaccacatctctactaaaaattaaaacatcagccagatgtggtgctgcgctctgatagtcccagctgctgaggtgggagtatcgcttgagcccaggagttggaggctatggtgagctgtgatcatgccactgtactcaaaaaaaaaaattttttttctctgttgcatatggggtcttgctatgttgcccaggctgttctcaaactcctggcctcaatcagtcttcctgcctcagcctccgaaagcgttgagattacaggcgtgagccactgcccctggccttacaaaataaaaattaaaaaaagaagttacaggatgttatgtggcccgttgaaagatgttggaaaacagttgcgcatgtgaccccgctataaccagttataaaagtatcaggattaagaaatgtactgcatctggctttcccaagtttaggatcctgctgaaagaatgagatggatcttttcttcctccgctcctcacctccctgcaagaaccaggactgtgcattttgacgggcaggctcttacccctggcaggccacagggggcatgcaaagcatttccgtgtgtgttttctgagtactcggataaagacccctgtccaggcctttgtttaggatatttggcccatggaggaatgagggtggaatcacctgggaggggcagaggcttcgaatggaaggaggagtgacctgagctccaggttctgggcctacactttgttcccatgcagcaccccattagtggtgactggggcctggaagtcagggaccttggtggccaagtgttaggtggacaggaggagctgagggaggtgaggggcatctctccaggaccgccccccgccccgtccccaaatcaatgccctctgatggctcagacatagccccggccagcagcagtgtgggtcaggaagggcgaatgcagtcagcacggatctgctccatagtctccacctcacttcatctcagtttggaaggtgtgagtccccgcagcactgataggatatcctgtcagctgagaacattcagcttgatttagaaagataaggtgggacatctcttgggcatggcatgtggagcagtgccatccctctgtggcagcgagccaagcaataaaccagaatgtgcaaagcctgcgtcccagaatcaccattcctggaggaaaagcctatattgtcaagatgcccactcctcagttaacccaaacattccacccagcctcgaaaaccagtagaactttgacattaatatactaaccctcaagtctatacagaaatgtgtaagaatagccacatactgtaatgtgcggtcattgagagagaggaggccgtcagaacaaatggaaccaagtctagaaacatgtctgtctaggcgcaagattccagcatgtgtgtcagccagggaagcagaccaggaggagatatttattaagatttaaaaccgggctccatggctcaggcctataattacaatactttgtgaggctgaggtgggaggatcacttgagcccaggagtttgaggctgcagtgagctatgatcgtgccactgaattgcagcctggatgacagagcaagaccccgtctcaagaaaagtgctcagatgcacccttacatgaagccaccttgggtacagcttccaagactggtgaggccttactcaggaccagggggcccagccctagctcagcttctaccacctgagtggcacctggaggtggtcacagtgtcctcagtccagtctctgttgggtttcagatcccctgatcatcatgccttttttgcccaagctctgcctcattatggccttcaatgaccgcagcctcttccacctccccaaagggacccctgctcatgctctccagcccacaggagtgcctgcttctccaggaagcccatcctgttggctctgggctctatgtaggagagctgggcaggctggatcccaccactgagttcagtcttgggggtctccacccatgctaggcttccactgatgggatataagtggccaggggggttctttacgtccacacaagagccccatggtgaccatgaatggggttctgagaggttaaatgacttgcccagggccccagagctggctagaattcctgcactgccatatccaaggccacgtttgggcctcccacctgggggcccggacacccctctgcatctactaggctgggaaacacatgtctgctgcagcttcctcccagtgacttacagcagctgcagatttctggggggacttctacggggcccaccacagcagagagccgagaattcttacagagcccttcattctctctccgcccccttcagctccgaactcgtactagttgctctgatataagaacagaccttggtgagggtgttggggctctggtcagtagcccaggccttcaggaatcaggtgatgtcaatctggagaggaggtgcctgctggagggactggggggagcaagcatggcccagggccctggcctcctgcaggggcagcccctcttccttcccagggtcccctgagaatccaaaggcatccagggtaaagtgcactgttcagctgtgtcctggggtccaggaaagccaaggagaagttgctccacctgctgtccaccaggcatcccggcaaagaacagtctcagcccaccccagcccaacaccagatcccaggaactgatccacctgtaagagggcagcataagactgccccattgtccccagagagtcccctcagtcatgggctgtgaccagggtgcaggtgggcccagcaggctggcccagtgtgggtatggctgtccattggtcctctgaagagcctcaggggcttgtggcagatgatgtgtgtctgggcttggaaatagaggatgtcccccagccagagggcaggggacacttgttttgcattccagtcctctgcaaggacagggaccccaggctctgggcactccagctctgcctgccctacccacagcttaccaccatttggcccaggcaaatcgtcctggctcccacagagggagccacccttcccacctcctgatgtttgcccgcaccagtcaagttccattctggaaaaaccctccacgtccttgggaaggcacctcctccttgaccttttcagagctatcgtccccactttcattttctacctatcattcgatgcagagaccagcttcttccctgggccagggctgctctggaggcagggaggtcgtggccaggccatggggtgtagcagagcactgggtatggatcaggctctccaggtacacctgggcagagaagtcagagacccacaggtgaatgcccctccttccggccccacccacctcacaggcagagggaggcttcacaaggaggttgaggtaaacaggagagcccgggtcacctctgtctgatctcctgccctcttaggagaaagccagaggttggagctgggaggtgtcgacagccctggcccagtccaggtttcactgatgaggctcagggaggggcggggtcagcccaagtcactgagtccataagggagggttctgaccataacccaggacgctagagttaactgaggctgcatccctttcccacccagaccaaggtagggcttctggcttctaaggctgaggcccagcacacctctccctccccttgcctgcagctgttgtcacacatcaaaagtgagcttttccccaaggggctggaggcacagctccttggactggaccaggtggccaatccaaacaagtccctgtgtgtccccaccagccaggaattctcacgccgcacagcagctgggggcaccaggataccctgggggattccagggatgagccctccctgaggcttccacagcagcactgccgcccccagaccccccaaagccccatgtccacgcagccctcaagaatctggcccctcacacacacctgccccactcctcccacctggctttcctgtgaaaagtgaaactggttccacctgggccagctggagaagggcctctggaaatcaccattttggggattcattccaatcatccattcatttattcaccaaatacccactgtccacctttctgtaccaggccaggggtaatgggtcaagcggaacacatgtcccaaggagttttcctctctttagagacagacaggtggactctcagactatgaggtgccctctgggctagggggtgcccagggctggatgcaatgtagggcctcgcccacaggaggtgctggtgggtacggacgtggaggccaccacagggtgagggtatccagacagaggacctagcatgtgcccaggcccagggtgtgacctggggcaggtgcggggctgctctatctggaaggcttcctgactctgccaacaataggccgtggctggatcaggcttcatgtcaatttttaacatttaataccttttgattatgtaactaaacattattgtgttaaaaattaagaaatatagaaaagttaaaaacacaaaagaccagcaaacaccttctctccctaagtaactgcttcaacagtattttctgactttttttctcatgtatctgcagctataaacataagttgcacaagatagtatccttccccatattctgttttggagctggatttttcactcagcagtgaatagaggcaggctttaaacaggccacgcattgtgagggccctgggaaaggagactgaccatgttgctgggtgaccttgggcaagtctctccctcctcagagcctggatttcctcagtccggtgaagggcaggaagggctgcagtaggactacatcagcgcttcccaaactcagaaccgccacgtggagctgtgtgagctgtcactgcacaaccccaggggcaggagcattcttgtcacagcctctgtgagtggggctcctgcccaaaagtgtgctgtgccaacctggggcccacaggaggattttaggcgatacggggatgaattgatttttaccatttccttctatctgtagtgaatgagaccgattctcaccgggagggcttgttaaaccacaggtcgctgaacccacgcctcagaggttctgattcaggaggtctggggtggcgcctgagaatctgcatttctaacaagttctcaggtcatggggatgctgatgctgttggcccagggaccacactttgagaaccactaatcacaaatttccttttattcatttatttatttaacgcagggttttgctctgtctcccaggctggagtataatggtgcagtcacagctcacggcagcctcaaactcccaggcttaagcaatcctcctgcctcacttcccaagtagctgaaaccatagacgcatgccaccacgcccggatgtttttttattttttgtggcgacagagtttcaccatgttgctcaggctggtcttgaactccttggctcgagcaattcacctgccttggcctcctaaaagtttcctttttaaatacatgtatttaggttttaaaaatgagttgacttaaagcacaagaatagatcttcaacactaaccactggggaaatgcaaattaaaaccacgtaagatatcactacagatctattagaacagctcaaatcaaacatagtggtaatatcaaataatggcgaggatgcagacaaaactaactcatacatcgctggtgggaatataaaatggtacagacactctagaaaatagtttggcagcttctttaatcaaacatacacctcaatatatgacctagcaattgcttctgggcatttgtaccagaaaataaaactgatgtctgcataaaaactcatacatgattgttcgtggcagatttatttgtaatagcctcaaactggaaagaaccaaatatcccccaataggtgaatggtaaagcaaactgacatatccattctatgaaatactattcaacaataaaaaggggaccaggcacggtggctcacgcctgtaatcccagcactttgggaggccaaggtgagcagatcatttgaggtcaggagttcgagaccagcctggccaacatggtgaaaccctgtctctacttaaaaaaaaaaaaaaaaaaggctgggcatggtgtctctcacctgtaatcccagcactttaggatcctgaggtaggcagatcacctgaggtcaggagttcgagaccagcctggccaacatggcgataccgcatctctactaaaaatacaaaaaaattagctgggcgtggtggcgggcacctgtaatcccagctgcttgggaggctgaggcaggagaatcacttgaatccaggaggcagaggttgcagtaagccgagattgagatcgtgccatcgcactccagcctgggcaacgagaggaaaactttgtttcaaaaacaacacaaaaacaaaaaacaaaagccaggtgtgttggtgggtgcctataatcacagctactcaggaggctgaggcaggagaatcacttgaacccaggaggtggaggttgcagtgagccaagatcgcgccactgaactccagcctgggcgacagagggagactccatctaaaaaaaaaaaaaaaaaaaaacagaaaagcaataaaaaggagcatgcacaacttggatgtatctcaaagggcatttgctgagtagaaaaaaaaagccaatctcaaaaggccacatactgggtgattccatttatataatgttcttttttcgtttggtttttgttttgtttttgagacaaagtctcactctggccctactggagtgcagtggcatgatctcggctcactgcagcctccacctcctgggttcaagtgattcttgtgcctcagcctcccgagtagctgggagtacaggcgtgcaccatcatgcctggctaatttttgtatttttagtgtagacagggcttgccatgttggccaggctggtctcgaactcctggcttcaactgatccacccgcctcggcctcccaaagtgctgggattatgggtgtgagccaccatgccaggcctctattcattcattcattcattcattcattcattcattctttgagacagagtcttgccctgtggcttccacctcccaggttcatgtgattctcctgcctcagcctccacgtagctggaactacaagcccgtgccaccatgcctggctaatttttccattttataatgttcttgaagtgagaagattataaagacagcagattagtggttgtcaggagtaggaatagtggaggggaagagcctggaataagtacagaggaatagcaggagggggattttcgtggtggtagaacagctctgtatcttgattgtagcagtggttaaaggagtctacatacgtgataaaatggcatagacctagacatgtgacattgttagatattgttctacactaatacaaaatagaacctttggaggaaactgagtgaagagtacatgaaacctctctgtaccatctttgaaatttcctctgaatctatatttccaaataaaaggttaaaatttttaaagttgctttaggcaaaaatattaaataaaaataatattgattgtatgcaggtctggaaaaacctttgacacattggatgactggcatctataacccattcaatgcacaattgcccctggccaggccgtgtcctaggctaggtcacctgctggaagataggactctggactatgtcctgcttggctttagagtagagatgccagataaaatataggaagcccagttaaatttagatttctgataacaaataattatttagtaagtatgtaccatgcatatttaggacatacttatactaaaaatcatttctctaaattctcttttaaccatcttcaccaagggttgatatttctctaaattctttaacgtatgtatgtagttactttaaagctcttgcctgctaattccaatgtgtgagccatttatgggtctgcttttttttttttttggaaatggatttttgctcttgtatcccaggctggcatgcaatggtgccatctcagctcgctgcaacctccacctcccaggttcaagcaattctcctacctcagcctcccgagcagatggaactataggcgcatgttaccacgcccagctaatttttgtatttttagtagagatggggtttcaccatgttggccaggctggtcttgaattcctgacctcaggtgatccacccacctcagcctcctaaagtgctcagattacaggtgtgagtcactgtgcccggccctttttttttttttttttgagacaagatctcactctgttgtccaggctggattgcagtggcatgatctcagctcactgcaacctgcacctcccaggcccaagccatccttccacctcagccttccaagtagctgggaccacaggcacatgccaccagcagtcctgactggtttcacggaagacaatttttctacagacggggtcaggggtggtggttatggtatgaaactgttccacttcagatcatcaggcattagattctcataaagagtgtgaaacctagattcctcacatgtgcagttcacattagggttcacgcttctatgagaatctaatgcctgctgatctgatggggggcggagctcaggcagtaatgctcgctgtccaccactcacttcctgctgcgcagcctggttcctaccaggtcaccgacgggtacagtccacagcctgggggttatgggcccctgcacaccaccacacccaactcagttttgaatttttagtagagatggggttatgccatgttgcccaggctggtctcaaagtcttgagctcaagtgatctacctgccttggcctcccaaagtgctaggattacaggcatgagccaccatgcacggtgcatctgtttgtattgactggttttctcttaattttaggatatattttctcgctttttcacacatctagtatttcttgagctgttggacgttgtgaaccttcattgtagagatgtgggttatgttatcctactctagtgttgagttttattttggcagggaattaaattgctgttgggttaacttgatcttgagtgtcaaggctacattttaggttttgttagggtgagctgtttttcagttttgctcttattcctagagaatcttccttaatcctaaggcatggccttctaggccctctgtgaatgtctgggatattcatcaagacctgagattccaagagtggagactctggctgagccagaattcagatgtgtttccagcactctgtgaccactgaaatcgctgtttagctctcagctccccatcagctgttctgtgctgggccttgcagagtctcaatccacacattcagagtttgggatttggccaaggacctgcagcaacctctataagatttctggggcttctcctctgcaactccatcctttctgatactctgccacacacattttagcagccctgagcagcagtctctgtttcctccaccaaacaagactgatcctcattgcctgaactctgcttcctcatgctgtcattgagggtttagaaactttccccaccagaaaaacacagcagtcacttcatgtgattcccttctctcagattgtacctggaactgcctattgcccaatggctgaagacaatttcttcatgtactttgtccagctttgtagttgtttatgctgggagaccatcatcaatacaggtactccatcatggccacaattcgaagtacgattaatatcatattcattctattctaaaagtagagaagacaaagaccaacagttctaagaaaaatggaaaaatatatatgaaagttcaaagaaaaagaagcgcaaatgccactgacacacaggaaaaaatgtttaacttcactgataataagaaagatacaattttaggccgggtgcagtggctcacacctgtaatcccagcactttgggaggctgaggtgggaggatcgcttgaggccatgaagtggaggtggcagtgagccgagatggcgccacttggggtgacagagcaagatcctgtctcaaaaaaaaaaaaaagatacagatgtaaacaacatcctgcaacctctacatgtggccatgattgctaacagggaccagatttgcctcccaccttgaacaactagaaaaatggaacaacatatataaaacaatagttttcagacatcagagaacaggtcgagcagaactatgatccctaaaagaaggtgaaccctacagtgtcctcagtttactgccggaagcacttacaggctccaatgcagggagggaaatccaaagtccagtggtcttggtggattgaggagacagagatcagagcttgggaagatcttcaaggctggtagaatttgtgaggtagagtaccagggaggaggtgggagaagagagcacatgaactctggagagctatggaagatgccctcaagcctttggcaaagggctgatatggatgtatgtgagaagaaagtacccagggaaagaactgccagaaagcagacagaagaatccccggagctcacaacaggctagagagaattcatattctcactagtcagaatgaaaacacctcataatacttaggaaatggaagagaagctttagaaaagtattgccttaatagtggggctaaatgagcactggagtaaaggcttctctgaaactgtcctaacaaagattgaaagcaaaccttgatagatccaacttatttaaagtaacttaactagtgctggaacagagtccctcactatttaaaggaaaacaaaatccagcagtcacgacacaaaaacacaatgtctaccagtaaataaaacattgccaggcaatggccaggcacagtggctcatgcctgtaatcccagcactttgggaggctgaggtgggcagattgcatgaggccaggagttcaaggccagcctggccaatatggctaaatcctgtctctactaaaaatacaaaaattagccaggcatggtggtacgcaactgtagtcccagctacttgggaggctgagacacgagaatcacttgaatccaggagatggagattgcagtgaggtgagatcacaccactgcactccagcctgggtgacagagtaagaccctgtctcaaataaataaataaaataacaggcaaaatagggcctataaccaggagagaaataaatcaatggaaataggcccagaaatgacagagatgatgtaatttgcagacaaggacattaacatattataaatatgctccatatgttcaagaaggctagaaaaatctgaacatgatgagaagagagaaatagaagatatattgaaaaaaaaaaaaaaaaacaacacaggctgggtgcggtggctcacaccagtaatcccagcactttgggaggctgagacacaaggattgcttgagcccaggagttcaagactagcctgggcaacatagggagacctatctctataaataattcaaaaattagccaggcatggtggcatgcacctgtagtcccagctactcaggaggctgaggcaggaggatcacctgaatccaggaggtcgaggttgcagtgagctgtgattgtgccactgcactccagcctgggcacatagtgagaccttgtctcaaaataaaacaaagaagaattactagagacgaaaaagttaactctgcagatatgggattaaaagcagttaaaatactccataaggacaggtgtggtggctcacgcctgtaatcatgccagcactttgggaggccaaggcaggaggattgcttgaggccaggagttcaagaccagcctgggcaacataatgaggcctcatctctacaaaaaaaaaaaaaggaataaaaattttcaaaaaatttaatgaaggcaaaataaagactttttcacacaaacaaaagccaggataatcaccagcaggcctgcactcttgagaagtgttaaaagcagttctttggtcagaagaaaaatgacactggatagaaatttggatctacacaaaggaatgaagaccactgacataataaatacatggataaatagaaaagatcctattttcttattttttgatgtctagaaataattgactgaggcaaaagtaataacattatggggtttataacatgtggaagtaaaatgatgatgagaatggcacaagggacaggtggggaaatgtaagaataccatcattataaggtggcagtcacagttgagggaggtgataaatctctgtgattccacctggaatactgcattgctcctggaagtgggaagagggagtttcagagacttcccctgggctcttcctactatagtggctcatacccacaggtcagggagtaaagtgagagctctgttagcttctaagcatactcatatcaattgcatatttagggacagagaaatgacaaccagatggggctgcagcctcttcatccagggatccatttattacctagccttcacatgtcctcagtcttactggggaggggacatggtggcattgtggatcttatggtggcacggtcagctctaatcctatatgaatgaccctcaaacagtctgggtattcccttttcatcagctacagttactttcatcaatgaccccagatccctttggagaaggactgaggtaataattaatgaatatcatggggtaatgttgcaggatctttttctaagaatacccagcctcccctacaatccatgagctataggtctcaattgtctcagtctgaaaactgggtaggaaattgcaattttttgttgcaaccttctgtggccagatcttgttgatgttgtttcctgaatacacaaatcaggaaatatcttagggctcacacctgtaatccctacaatttgggaggttgcagcaggaggattgcttgagctcaggagtttgagtccagtctaggcaacatagcaagacctcatcttcactaaaaattaaaaaaaaatagccaggcatggtggtacatgcctgtaatcccagctacttgggaggctgaggtggaaagattgcttgagcccaggaggttgaggctgcagaaagctatgattgtgccactgcactccagactgggctacagattaagatcctgtctcaaaaaacaaaacaaaagaaaaaaccaccctagtcaactgcctatgtaactctcccctggaatgccatcagtttgtagctaacacaacagctccctggaggtcagggcatcctggctatcactctagccttcctaccaattaagttaattacatccaccttgtggatgatggtgaagggccaccacctggcatccactgttctcaccttccaccattcccactgacaccacgaagcctggtctcatggcagcatctcctcttatcgatcccggcctaccaaggatagtgccactgagtctctcaaacattcaggtgcccttctcgctagtgtctgctggcatataatgaactgttgggggaaattcagccagatatcaggcaaaattcacccccgatatttcacataggttcttttctattttccctaagtgtcggctggtctgagaaataaagggaaagagtacaaaagagagaaattttaaagctgggtgtccgggggagacatcacatgtcagcaggttctgtgatgccccccgagccgtaaaaccagcaagtttttattagtgattttcaaaaggggagggagtgtacgaatagggtgtgggtcacagagatcacatgcttcacaaggtaatagaatatcacaaagcaaatggaggcagggcgagatcacaggaccacaggaccggggtgaaattaaaattgctaatgaagtttcaggcacgcattgtcattgataacatcttatcaggagacagggtttgagagcagacaactagtctgaccaaaatttattaggtgggaatttcctcgaaaataatggggctgatagagtatccagtgtatcttagtttttggataattatcactaggcatttgatagattggttggagcatctgaaaaaatgggtaggtaattggcaaaaagaaaaataagcaaatgaaggggaaaaatctgaagctattattattattattattattattattattgagatggagtctcactctgtcacccaggctggagtgcaatggtgcaatcttggctcactgcaagctccgcttcccaggttcatgccattctcctgcctcagcctcccaaatagctgggactacaggtgtccgctaccatgcccggctaattttttgtatttttagtagagacggggtttcactgtgttagccaggatggtctcgatctcttgacctcgtgatccatccacctcagcctcccagagtgctcggattaccagtctgagccaccgcacctggcctgcttttattatttttaatctacacataattgtatatatttatgggatacagtatagtatttttatacatatgtacaatgtgtaatgatcaaatcataattagcatctccaccacctcaagcatttatcatttctttgttctgggggcattgaaaatccactcttctagctatttaaaaatatataataaattgtcattaattatagtcacccaatagtgctaaagacactagaactattccttctatctagctgtactctttttttttccccagacagggtcttactctgtccccaaggctggaatgcaatggtgcaatcacaactcactgtacccttgacctcttgggcccaagtgatccttccacctcagcagcccaagtagctgggaccacaggcgtgcaccaccatgcctggctaatttttaaattttttgtagaaattggatctccctatgttgcccagcctggtctcaaactcctgggctcaagtggtcctcccaaactgctaggattacgggtgtgagccactgcactcagccatgtactcttgtatctgttaacctgttagccaacccttggctaccccctcccccttacccttcctcaccgctagtaaacactattctaagcaaatagatcttaaatgttcttaccacaaaaataataataataaaagtatgtgaggtgattaaaatgttaattaacttgatttaatcatttcacaatgtatgcatatatcacattgaacactggaaatatacacaatttttatttgtcaattatactttaataaagatgagggaataattgaatataatgttaaaacaaaaaacaattgcaaaacctaaagaaaattaataatctagagcagaccagccttttatacatgaggtcactgaagtgcagagaggtgaactgacttgtctcatcttacacagcaagtcactggcagagcttgacctgaaacccaaagccaagcgttttctattacctccaggtccttcaggccagccctcccagggctcggccttgggaattggtattggtgacaaagggaataaagaggaacatgcatagagctctccatttagattgacatattcacactgtgccagggcatcagcaagaaacagtgcaggctccaagcgcttgccccaaccccatcctctctcataaccaacttcagctaaaaggtctgagaagataagggaatcttaggtgactctcactagggtgtaaatgactcccaccatgatttttatcttatcaagacataactctaaaaacagtttgatggatacgatgccaggcagtaggatgaagacagatggggaaactgcctaccttaggtcaggagtttgagaacagcctggccaacatggtgaagctccatttctactaaaagtacaaaaattagccgggtgtgatggcgtgtgcctgtaatcccaagctactccagagtctgaggtgggaggatcgcttgaacccgggaggtggaggttgcagtgagtcgagattgaaccactgcaaaccagcctgggcaatagagagagactccatctcaaaaaaaaaaaaaaaaaaaagtcagaccaacccacggggaggcagagggtaggtgaggggggtgtggctgggtttacggtggtgcactcatagagtcggcttgggaacagggagctgtgtgtgtgtggaagttaaaagataggctttggagggacctggctttaaatcccagctttgctgtgtgaccttggacaacctgcttaccctttgtgatctcatatgcaaatgggggtgataatgcatacttcacaaattgtgaggattgaatgagacagcatatagaaagtactaaatttagtgattggcaacacactaaaaaataactctatacacccagcaccctagaccagaaggcattgtgctgactcccagaatgcactagaaagcagtctgcttcttcccttcctgcccttcctctcctctcctctgttctcctttcctctgttctctccttttttctctcctcccctgcccaccctatccctcttcccttccccttcctctctcactctcctctcccctgattccagcccatttagtatctaggtgactctatcccaagcttcttctcctggtgcctttgtccccatctctccaagccaccttgattgtctcctctacctgacagggtcaccctgctggctgcaggctggagggatttatagcaattccctccctccttgcctgcacggggctaccagacagccggaagatatgtgggttggacacagtggggccctgggagaggcaaataaatacatcaagttcccagctgagtctggagataaggacgcaggaagatggggctgcaggattcacagatgctgcactgcacggggtcactcttcatagcctgattcctctggcttccccaggaaagtctatttggggcactttgaagaggacacagaagaggacagcacctgagcaatcttttcctgggaggcgctgcactgaggcacccttcctcagcttggatttggtagggacaggcttgaggagtgagaatgtgacagacccaaccccaagatgaggcaggaaggagggaaattgagccccacagcacaggaggggaaactgaggctgagaagggagaaagacttccaaagtctcacaggaagtcagtgaagagaagttacagtcccctaacccctgatctaccactttagacccccttacactgaattgtgcctggcttcccccagacttggccatttgaactggccttgcctgggtacagaattccaggtatctctgcaacatgccaggatccacctcagggagggttctcctccctccagatctctgccccagccagctgcctgatgagatgccctctctatggggcctgatttggggtcagcatcctattatagataactcaagggtacaacatcagtctctcccacacatggatgggattctgttctagtgcccgtgggcaatggagtgggggtacgggggactaacgcaggagacctgaagtgggggcgcctgtcccatccaccccagagacagctgcccttgccactgtcgaggccacacctgcccaagagcctcaagggcctcctaatcagcaagctcacccacagccaccaggcttggcacgtccttgacccagactgcccagataggctggggacatttcccattcccaactgctctgtgacctctctttggcctctgtctccctcccagtaaagtgaaagggatagaggacctccaggccccaaactctgatgctgggtgactctctgatccttgaaggctgtcattgcatctccctaaggtgggtgcagacttcacagagtctttccaggctactagagctgattgcctacaggcaaggagaggggaaagtgcttgggagtcccatcccccaggggcagcccttggccaatgtctgactgctgtgcatctgtggaagtgagcttccctgcctctcattgggacaaacaggattcattttcattctggagcttcctgggatcagtccaacattgagactgtgcctgaaatcacacctttgcttagcttcttcctcttcctttcctacttccccttctctcttctggttgtttttcgcttgggcagttttttaaacagccacctgcacacaaaacattgtctcagctctgcttctgggaagccactttcaagagtaaatgaaaacagtctattgaaagcaagagactgaaggtctgagggaaaagtcagttttatttcagcccaccaagtgccctccctgtgctgttctgggctttgatggggacagtggaggggaaggccctgcgcagccccccaaccccaggagctttgagtctgggggatggaggaggaggaggagactctgggccagccctcctgcggtctgcaggaggccacaggaggtggtggggggttctctgaatgtgtgtttattgtggcctttctgtgtcctgtgatggccccacggaatggaggactgagagttgcagagcaggaaggggtggcagccttgttctttcctggtcaatgtgccaggctcccaaaatattcagtgatcagattttaacctcaaatagcagtgccccaaccgcccctgaatcttgctatggaaagagcctttggtaagtgttttgaagcaggaagactccctctgcccacagagcagtgcacagcagtttgggggaggggctagctcctgggacccaagcgggcctcaagagatgaggcgggaggcgggttgcagtgtgatgggaggggagacacagaaattgccaagggccatgaggaagagaggaagccacaaccccaggctcccaaggagggtgtcttcctgcaggaagccctgtcagatggcagcctgcggcccaaaagccccaactcaacctgcaaactggcttcttctaaggccacagcacccaagggcctcaagacacacatctagcccattcccctaccattgcatgggtggaaacctagaaggagagagggcaaggagttgcttaagaccacttagagagtttgtgaagctggagtgagctttcaggttgtggagctccaagcccagtgtggtctgccccactttgcactgccccacatttttcctaagaccaaggtagaattattcctcctgttttccacctcaacagtaaaagtgcctctcttctctgccatgggactgggagacatgttcaggatgtgaagtcatatagggacatctttgagttcataaacatctcctgttcataaatatccgactaaagactgaagcttccactgctcccaaaatagctttggatcccagcacaggcatttccaagaacagatttttatcctttcaagaattccgtgaaagagctgggtgcgatgtgtgcctctaggcacagctacttgggaggatgaggcaggaggatcacttgagcccaggatttgaggccagctggacaatacagtttgatcctcagcccaaataaataaataagtataaaaataaatcaatcgatccaagaattctgtgaaagcaaagaatcctctggtttgtatgcctaccagagtttcctgaagttggtcacacacactgccctgaccctgactgtgatctcagactgtggatatagattggtctaaactccagataaggaagtatctagtatggtccattataatcctggtcattctcatttcaattcattttgatacaatattaggctactctgaacatgcaattccccaatccttctatttaaaagggatttcttgcttgtagtgagccttgggattgactcctctatagccatatcagggccagataattattctgaaccaatcagtttcatccccttcaccagtgactggttcagagataaacagtcctatgacaataggtgtcaagacccaggggagaggctgtggcttcggaaaagagaagcctgtctttctaacccactagtctgttaacattacgtttgtggctgggcacagtggcttacacctgtaattttcagcactttgggaggctgaggcggaaggatcacttgaggtcaagagtttgagaccagcctagccaacatggtgaaaccctgtctctactaaaaatacaaaaactagcggggtgtggtggcacgcacctgtaatccaagcaactcgggaggccgaggcaggagaatcacttgaacccaggaagtggaggttgcagtgagccaaaattgtgccaccgcacttcagcctgagtaacaagagtgagactccatctaaaaagaaaaaaaaacaaaaaacacaataggtatgtttccttggtggctccggaagccctccagtgacaccaaggcaccaagggacccagtccttgggctggaagccctattaagggtggcagaggggagagatgaaagaacttgcaactgctgatgtcactgagccgctgaatcaacagccgggaagccagccttgcttcctgctttgtgagacgatacacttaatactttccatccttgggggtgggaatcttgttatttgccgatggaaatattacacatcatccccagcccccactcccctgcctcacccggccctaccctttaccatggcaagtcctgccacggaggagctggctgcctcagaaaatctcttggggaaaccagtcctgcctgaattggggtgggattgccaagcattttgcatcccgccccccttacttgttttttggtgtttttttgttttgttttttgttttcgtttttgtttttgttttgagacagagtctcactctgttgcccaggctggagtgcagtggtgtgatcatggcttatggctgcctcgacctcctgggctcaagcgatcctctggtctcagtctccctccagagtagctgggaccacagttgtgtgccaccacgcccaactaatttaaaaaaaatgtagagatgaggtctgactatgttgcccaagctggtcttaaactcctgggctcaaatattccttctatcttggcatcccaaagtgctgggattacaggcatgagccatcttgctcagccatgttcccctttgaatgcaggagtatcgcctcttccaggcaggagttcctcttattcagtgagacaagcacagacccagataattacatgagctgccactggaagagctgctgttaattttgatggcaataaaaggccttgccagtacgttaagctaatttcatgaaaatgctgggaggagggtcatgggctggatcccagattattaataatgtcgagcttcatttgaaccattcagaaaattcctctcagttgcctccagcaaactgcaacaggttgctactttcctctgaaatcaacagtcttctcataggcaaatgtggatttttttgtttttccctagaaaataattaaagtcacaaagtccaataaatacttaaacagaatgtagttttaattaaaaaccttccaccaagtctgcagttgcgggtctctctttgcaaacaggcatgctgacaagcatcagtctaagtatctgaaactagaaacctttacaaataataatagtaaatctggtttctacatatacccatggtgtgtgtgtgtgcaaagggggtggtggtggtgaagaggtctgggggcagagccaaggtgctcccctgtggaggaggcaggacacaagcctgtaggggtgtgtgcagcagaaccttttatcaaacttgtgtcccactctgcaaggcaataataatggctaattcagctattatataaaaaacgtatctcaagtactgagcactaagtgtcaggtactaagtgctttgcgtacattgattcatttaatcctcaaggtgaccgaaaagcataggtatttttttttttttttttttttttttgagacagagtctcgctctgtcgcccaggccggaatgcagtggcactatctcggctcactgcaacctctgcctcccgagattctcctgcctcagcctcctgagtagctgggattacaggcatgcaccaccacgcccggctaatttttgtatttttagcagagacgaggtttcaccatgttggtcaggctggtctcgaactcctgaccttgtgatccgcccgcctgggcctcccaaagtgctgggattattacaggtgtgagccaccgcgcctggtcagtactcttatttatgcctttttttcttgaggcacagagaggttaaatagcttggctaaggacacacagtcagtacataatggagtctgacgctaggacctgcccgcctgacgactacatagaacctgtacaaggaaaggccggaggagggagtataaacagggcctggcttccctgaggagtgatctttcgactggaaattagaaaaggaaagcagcttcttgagggtgtggggctggagagaacatttgtgtgtgtgtgtgtgtgtgtgtgtgtgtgtgtgtgtgtgtgtgtgtgtgtgtgtgtctgtgcgcgcagaagctgaaagatgggaagtagtgagtgttcaggggcttctgactggagggcagccttggggaaggtctccgcagccttaaccggctgctatgctggggatgtttgatgcccatctgggccccggctttcttattctcagaggcccttcccacatctttaggcaagtccattaaatcctccgcgtgccacattaaaatacaagggcaagtacaactctgagtgcagttgcaacagaatcgtttgcacaatgtcgcatgtcttaaacattcaatcaaacatcgattacttccaattttgcagttttctttgcccctgttagcgccaacagatttttttttccagatctcagacatttattttaataggcccctgacaaagtcataagactcagagagaagggagagtgggagaggtgtataggaaggttttgtgccagggactagtcgctcaagaattaggagacgccctgggcactggaaactacgcagcgcgaagtagggacagcgcctgtgttgtgtagtggaccagaggttgctgatacctgggacatagactgggtgggcacgggaagtaaagcctcgggactttggttaagcgcgccccactggcgtatcgcgccgcgggactgcagagccgtgagcagcggtcgccttggtgcagggttccagccacatcttcctcgcccagccagcaccctctgccgttgacccgcctctgcgcccggcaagcggcttccagcagggggcgcgcgcggaccaggcttgggccctagaacagcgcggatggagtcgctggagcaagtccccagatccaaccggtttcaaccctccccaccctcccgacgctccgggttcgcgacgttgaagttaagggtcgatccgcagaaagcggccaggggctccagctctccattcctgggtctgtctggggtcggctccagcctggttagaagccttagtctggattcggcagattctgaatctgggaccctctgcgctagcggcttggaaccttgtcaccctcccctcccccacccctacttccacacacctgattagttgtctgtttctttaatgatcaaagacgtgggcggcggcgggatgaggtcttggttcccggctccacagccctccctaactgtcattattaacgttataaacattagacccgcttctgcgcgccggacggcgccggacgaggtgcgcgcagtcttctagctgagctcggaggcagatccagaagtcgcggctcccaccccaggcctcggcggactctgcctggggcgactcgggctccagccctgcccgggcgggcactgggctctccagggtcgaaggcaggggtaaggggcgtctttcccccagggcagcctccgggaacaaaagcatttgctgtagagtgagctagagcctccgggcccgcgggagtcagctcccgcccaggggtggtcaccgcgtccttaaccaccccaggagccccgtctccctgccgaactccttggcttctgcaaccctgtcaagacagcaaggaaagggggtcttccctggtcctcgggccccgaagtttcggggttgcttataggacgggttcctgcagtccagggaagctctgggcagatagcgagcccattctcccttccattacccagattctgcctccctgcggaaggcaaaaaagaaagaaagaaaataggtaaaaaccggcggagggccttgagcctccccgcctggcgcccctcactcagtcccgaaaagtcccctggacacgccatgccggaccggactcagctcccgctgctgggcccctgcctccaaatatccttcccaggcacaggctcccaagaccgccccctcagggttcccaacacccggacaactgcccaagacgccgctccccgcccccacccccaccttgttcggcagacaaagaagggtgtgctggccccgccgtctgcctccttctcccgaccccacaaggcctagaaacctcagggactcaccccgggctagggacccaatcctggctgtcccaccacaggatccccggcagggacgggtcacagtgctctcacccctcgaccattttcgaagacaccttccctgaaaggcgccttgcgccctccccatgggtcggcggggggggactccaggcccgagcaggcggtgtgaagttctgtgttctgaactggggctgagcaagatgcgatggtctcagcccgctgggccgcccgtagcgacggcaggagtaggggagagggagggacgcttggagtgtgagcgcaccagtctgttcatatttaatttacaaagcagcctcggaaccccgggccgggtggtctctttagacgctgcgctcttagcctgtctctcttccccaccccctcccctagctcattaagatgctcaacactcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaactgggctcggtgactttttgtcaggggacagagggaggaggcctgggcgatgaaggaggaaaccgcggaaggaaggagcccccccagagcctcccgttggaatcttttgagtgatttcctgtttgcgtgaccatcctgtgatttttttgccaggtgtttgcacccagccctgctcttagtgtctccaactccagggtggggtgacaaaaaacgagggcaggctgcaagtgagtagggggaggttgcaggaaaggaaggcgggtgtctgcagaccctgaacacagggagtctgagtgtgcgtgcaagtatatttgcactcaagggtgtgcggcaccctctttcacttgagactgtctgtgtagtggggtgtggctgtatatggtgtcacactgcccagtttctgtgtctccacatcagcctttgagttccctgagaagccggtgggaagaggatgggattcatagggacaagaccgctgtggcttgcacaagagaagtcacaaataacacaaagtacagagcgggcaaatgatgtaaagcaggaaagggggagaacctggccaggccgattgcccagagcgagccggcacgtttggcctgggagccaagtgtgtgcgttgtgtgggtgggtggggagcactcagtgaatgatgcatgcacaaccgtcagggtgtgccaagggggtgcacctggggaatcagggttgaaaacacactgatttcatagtcctagaaaggggctttcttgggtgaggaacaggagagacagggggatcaagaaaggagactgtgctcctggccagcctaaaacacacgggttgggctgctgtgtgtctcagctgaatccccctaagatgggaagaggcggggaagagagatggaagaggaaagcaacagaaatgggaagcagataaagattctctctctcccctcccttcttcctgcttccaatttcttgtcctcttttgctgtctctgtgggtcttcctaattggaccagtccaggctggcaacaggcccaagttccaatgctcagggtcctaccccagcctcaggtctgtcctctggcataggtggtggctgtgacacttcttggggcctgagcccagattcccttcccagaccagcaaagctgttttctttcttttttttttatttttttatttttaaaatagatcagttttattctgctagttccataaaaacaatgtaaacacaagcgttctgtacatcttcttggtgaattcacataatgctttgttccctgatcctttaacctcctcgtcttcttccagtcattttctgtttggaccactggccacaggagtggagtggggttggggcttaggagagagcaatgtggctttttcgtatgacttgttttattgcttgccctctcagcacactcctgttactcctaacacaaagtctgagatttaagcccttaaacctgtaggtttcaccatcagctttttctttttcttttctctttttttttttttttttttttgcataggcattactagggatgtgaatgggagactggtatagaaagtggtgaggagccgaagccaagaaattgctttaaacacaagatgaaaacgctctgttctgtacacaaagaatcacctaatactggtgtgaggcatctcacttagctgtggagaagtccttggaattagatctcagaaagacagttccagctttaagacagtaaaacctttaggcaatgggctaattgccttaaaggaaagaagagttctacttgaaagagcttgcaggtgagaaattgtcctacaaagattcttagaaatgttagcggagataactgacatgggtagctgtgggccaaccaagaactgtcaacagcccgatctcatagcaaagctgttttcaagaaaaattcccttctgagggccacagcctgagccctgctcctggtcacagcccaacactgcagtccaccccactgcctgggacacaactcaagaatattatctcttaggaagacacctgttttgttctacctgcaaatcctaccgctgagcacggggcaaggactggcccaattcctagggcctgtttaggaatccagccacgtgattgcttctgggaacaggcctggctgggccagtgagtgctcagcagttttggtgcaactcaatcatctggtcatgggtctcttgtgggaagacaggccccttcctttccctccctgtcctaagaattgggggccctcctcgagaccctctaggatcctgagtgccactagggcaggtggagaggaggtgaaagctctgcccctctttgtccagggccacgtatcctaatggatgagcaaatactactcagctagaccttgtgccttctgggcttggccaggcccaaaggctccaaccacaggtaggaatgaatacgtgttggaggccaaggaccagggtgctgggacactctgccaactgcccactgaaatcccagccctctcaggaaaactctagtttctgtccaaatgtttggccaatgcacagaatggtccccagcctctggccttccttcctacctctttttaaatgtaattaatttaacttatttaattacattaaaataaaatgtcttcctttcatttcctctccctcattcctctctgttcttttttgaattgttccagttcaactaccaatttgaggttgaattcattttcacagtgtccccatcaggtggttgtaaaactctggcttatacttatccagagatggggagctcacattccactccccgcttccagggaatcagttgtttagcagtttaaaatgtgtctctgcctgggttccacccctcaggcctgactgccactggcaagttctctgggagaacctaccaggtgtggaggtgtaatcttcacctctgaccctctctccctggctccaaggctttccattcaatgcaacttttttgagcctttcctgtatgcttcatgtgctgtgctagcttcaatctctccagtgtgtcttgctgtaaaacttatttggatactacatgggaatggagtctaacggcttgaggagtgtgtgtgtgtgtgtgtgtgtgtgtgtgtgtgtgtgtgtgtgtgtgtgtcttgagagacctggaaaatggtcggagaatgcaatatgacagcagtagcctcagaactcagagcaatttatcaggagcagtaattctctgagttacagaaaccagatggccaggatgtggccttgaatcagatcagaaacctgtctaaagaaaggttatttgaaaggagtgcctcctccccctaaatgtttcctaaagatcagctgaaatgagaaccatcttgaagatcattaaagtccattaatataaaagaacaaaggaaggcagggcttctttgagaaagaagcagctggggtagggtcctctggtcccagatcttgtgtctggaatgcagccctccacccatgacatcaaaataacaaccacaactaaagctaacatctccaaagattcgttgtcagtacatatatggcctgtgacttcctggtagacatctcagtttttcctccttgatctcagggaaatgcattttggtaggtagagggaaaggagtggcatcttgctatgactaccctgccccacatttgttaacagagccccagttatgagacattccatagggaaaaagggacctgctctctgcacaacaggaggtgtcgcctgcaaagaaaggaccatgactatgtaagcacagagcaagggaaactgggggatctcctttctctgcagaaatccaagcctgtattctgcagaaagccaagccctagtaccaggacataagaaaggccccttgttgaggctataaattgccaagtctgacctaacaaatacctttaccttatacatttccaacataaaggtatagataagagaaatcctgctgggcagttcggaggaagcaagtggagccatttcagttgtaatgtgtcaattcattgattacatttgaaatgtagccacccacacctatctgttcaatgataagattttgccttaggactcaatagagaataacattatattgaaaatgaaagatctgctgtgactggcatatagaagagattaaattttaaaatgttttgcaatattcgcattttgttcaaaatatgaccagtgttcctaatgagacttgatatggattttttaaaaagccatccaaaggccccatgatgggcacaaaaacaaaaccaacttgttgggttaaattagttggaaagactttgtatcattccattgttgaataagtaatttatgggatttaaagacaggacgattttgaaaattgtgctaattgtgtgtgctttgtttgaacatgtgaatgtaagtttaataattaagtttaagtccacatagaacaaggagagaaaaagtgtttgtatttttatcaactgtttactgcttacatgtattcccttgtgtattaggagttaatttggttttggcaaattaaatgcattttctcccagcaacattctcaaactgtttcttaaattgaatctaaaagccattcaaggcatccagccatttgagagaaaaatttctatgattatataaattaccgaggaacttcgtaagaattgatcattgtcgaaatggggagagaataggaatggagaattaattatcaaatgcgtcttaataatagaggcttgtcacacatctagactaagaatgctaatagtcaccacctaatattagtataaatactaataataccaatagtggctaacatttattgaactcttactatatttcaggcacatactatggatcttacaagcattattttgtcattccttatagtgatcctgtgaggtaatattattattctaatttacaggcaaagaaaccaaagagcacagagggttagtagtttgttgaagatcacacagctggcaatttgcagggttgaagtttgtccttttgttatctgactccaatgccagagatcttagtcaccaagccaaacctcctcctgaagcctctacaaaccagtgaagtatagaataacatattttctatatggttaaatttgcggctaattacagagtttgtctagaaaaaggatttctcttgctgtttctcttatttctcaaaatagcatttttttttttcctgattataaaagtagtgcaggccaggcgcagtggctcatgcctataatcccagcactttggcaggccaaggtgggcaggtcacttgtgatcaggagtttgagaccagcttggccaacatggtggtctcaaactactatttcatgtctctactaaaaatacgaagaaattaggcaggtgttgtggtgtgcgcctgtaatcccagctactctggaggttgaggcaggagaattgcttgaacccgggagttggaggttgcagtaagcggagatcaggtcactgcattccaacctgggcaacagaacaagactctgtctcaaaaaacaaaaaaaagaaaaaagaaaaagaaaaaaagaaaagaaagaaagaaagaaaagaaacaaatataaaaataaaagtaatgcatgcttcaactagaattgtctttggttgccattgggaatgtaaatgggcatagccactttggagaaatatttggcaatctagaaacattaaagatacacatacgtctgactcagtaatctcactcttgggtatatactcaatagaaatgaatgtttacatccatcaaaagacagaagagtcctttggtggatgcaagtgcaacgatgttcatagcagttttatttgtaatagccccaaattggaaacaacctaaatatccaacagtagaatggaggaagtaacctgtagtatattcataccctggaataccacagagcaatgaagaacaaactgcagctacacacaacatggatgtcatcacagtgagtgaaagaagaaagacacaaaagattatggaatgagtgatttaatttaaaggaagttcacatacaggcaagactaatttttggtggaaaaagttggaaggtactaaccgggattaggagaaggctcaagggagacttctgagattctagaaatgttctataccttgatctggatggtggctacatgggtgtatgcatatgtagaaatccatgggctacacacttgagttgtatactttattgaatttgttatacctcaatttgtgtgtgtgtgtgtgtgagtatgtgtgtgatggagtttcactcttgtcgcccaggctggagtgcaatggcgtgacttcggctcactgcaacctccagctccctggttcaagtgattctcctgcctcagcctcctgagtagctgggattacaggcacctgccaccacacccagctaatttttgtatgtttagtagagatgggctttcgccatgttagccaggctggtctcaaactcctgacctcaggtgatctgcctgcctcggcctaccaaagtgctgagattacaggcatgagccacggtgcccagcccttattatacctcaatttttaaaaatggaaaaataacccttggaaatcaggcaccaaagtaatacgtgctccttattgaatagcactgtccgatactagccactagccacatgtggttatttacattttaattttaattaaggtgaaataaattttaaaacttgttcctcaatcccactagccacattttaagtactaggcacattgctaacagcaattgtttatttggacagcagagctatagaaaatttccatcctaatggaaagttctattgctagtgttgttataggaaattgaaaaatatagaagtgtattaaaaaaacaatttattatttataattccctcatccaaaaaataatgtattaacattttatgttaacttctaatttctttctaaaataaattttattaaattacaagagtaacatatgaatgcattcttgtcctaagataattaaatattgataaactgaaactctctttgaccattgcctgcaatcctagagctctccccagtggtaaccactcttactagcgtactatgtacctttttattttttttgagatggaatttcgctctctcgcccaggctggagtgcaatggcgctatcttggcccactgcaatctctgcctcctgggttcaagcaatcctcctgcctcagcctcctgagtagctgggattacaggcatgtgccaccaagcccagctaatttttttgtatttttagtagagacggattttctccatgttgatcagctggtctcgaactcccaacctcagatgatgcgctcgcctcggcctcccaaagtgctggggttacagatgtgagccaccacgccctgcctggtaccatgtatcttttcagaccattttcgcaggtacttataaacatgatgtctgtgtatggaaatacacagcagagccattaacatcaccctgactcaaggagcttccacctggttcagttcagtctcccgaagtgcacaggaagggtgttatccccatcatccacatcccacccagtgtctagggctctcttcctattcatctcgagctgctgtggtcctgggatattgtgagaggggacgtcacatggggcaagtcagatggtcactaggtacagtcacactgcagaactggcaatgccactcctgttgggtgttcctagggcaaggtgtaactgtaaatccaggggagccatcactccacactgtctgtatgaagagctagcctgtggtgcagctctctagcctgaaggtggtgcttcctaaggtagagtctaggaggtctgcaggcatgactcagctccctctgggtcctctcgcagaggtcctttgctgctttcatgaatgccacactggagcatggaacccttttgtgaagctgccccagatccccttggtaccaacatcatcattttctctctggtataaggcacaggctccgtctgactcagaccaatgcacctctcagtgtttaccttttgagttcaattctgaattcacgaatttttaaactttcttcattttaatgtatgcatttacagctattaatgtcctcctaagtactgttttaacagtattccccaagttttaataggtagtgtttacattgccatttagttttaaatattttatttctgtgagatttgttccttgactcatgaattatttagacatgggctgttacattttcaaatgtatgtgtttttttttctgacacttttgtttttgataccacttgcattacctcgttgtcagaatacagactgggtgatgctgattatttggtaattattaaaacttgcttggaggaataggatgtagtcaattttttgcaaatgtttatataagtttgaaaagaatatttattcttgaattattgggttatgatttttatattttaattagatcaggcttgttaatattattgattacatattctctatttcctcacttaattttttgtttgcttgttttattaatttctgagagaggcatgttaaaaatctcttatgattttagacttgtcaattatttcttgtaattctgctcatattgcattgtatatttttgaggccatgtcataaggtgtatacctttttggttaaatttttgttgaagtctaacacacgttcaggaaagtactttcataaagagaaaatacctcttatgaccagtacccatatcaagaaaagaaaattaccagcactcctgcagcatcttcatgctccctcggagtcactcctccatccccactctcctgacttctaatatcatagattagttttgcctgtattgaaacctcatatattccaggagtcttcaaaatgtacacgaaaaatgcatattatgaaaaaactaaccatgatttcaaaatgttttcactaacttgtactaacttgttataacatgtctgaacaggatctagtttgaggctctaagaaggataagatatgagtttgaaaagaacctccattacagcaacatgagttctgctaaaatcaaagcaagaatgaaaatcaaatttatggtgaagcttgggtggaagaattatgaaatcattgataccttaggaaaagcttatggagacaatgccccaaagaaatcagcagtttacaaatggataacttttcttaagaaggaataagaatatattgaggatgaagcccacagcagcagaccatccatgtcaatttttgaagaaaaaaatcttttttttttttttttttttttttttgagacatggtctcactcctgttgtccaggctggagtgcaatgatgtgatctcagctcactgctcccttgacttcccaagctcaggtgatcctcccatctcagcctccaagcaagtagctgggactgcaggtgcgtgccaccacgcctggcgaattttttgtatttttagtagaggtaggatttcaccatgttgcccaggctggtctcaacttcctgggctcaagcgatccatctgcatcagcctcccaatatgctaggattacaggcatgagtcactgtgctggccaaaaattaatcttgtttgttccctaattgaagaggactgacaatagcacaaaaaatatccaatgccgtagacatgtcagttggttcagcttatacacttcttactgaaaaattaaagttgagcaaactttccactcactgggtgctgaaaccattgctcctagatcagctacagacaaaagcagagctttcaatggaaattttaaacaagtgggattaagatccctgttgcattcttcaaagaattgcaacaggagatgaaacatggctttaccagtaccatcctgaagacaaagcacaatcaaagcaatggctaccaagatgtggaagtggtccagacaatgacaacagatgtttgggatgctcaaggcattttgcttgttgactttctggagggccaaagaataataacatctgcttattatgagagtgttttgagaaagttggtcaaagctttggcagaaaaatgcccaggaaagcctcaccagagagtccttctccaccacaatgctcctgctcattcccctcatcaaagtgggcaatttgcaagagtttcaatgggaaatcattagccatccaccttacagttctgatttggctccttttgacttctttttgtttcctaaccttaagaaaaatattttaaaacacccatttttctttagttaacaatatttaaaagatggcatcgacatggttaaattcccaggaccctctgttctttagaggtggactaaatagctggtatcatcagttacaaaagtgtctagaacttcgtggtgcttatgttgagacatagagtttatatttcttatttttatcttttaattccatttttccacaaatggtttgaagtcttgtcatatgctcagctttggtagatactgccaaacagtttttcaacatgtaccaatttacacttgcaccagccgtgagagtcctcatcaaactcagtattatctgtttttggttttagacattctgttgggtgtgtagtggtattgcattgtgtttttaattggcattaccctgacaattaattaagttgaatactgttgtttcctgtccatttgaaaatcctcttatgtaaactgtctttctctctttttcattgggttgtctttttcttattgatttgtagaaattcttcatatattctgggtatgagctttctgtacagaatgtcttccctctctcttcagcttctcttttcacactttttgtagtgtctttttatgaagagctgtttttagttataatgtgctccaatttatcaattttttctttatggttagaactctttaggaccatatttaagaaatctttgcccaccctaagatgatgaaaatattctcctatgatttcttgtgaaaaacattatgattttaccttttttatttccatctacaatgcatgtggaagttacttttgtataaggagtgaggtggggccaagattcatttttttcccatgtgaatatccagttgacctaacaccttttattgaaaagattatcttttcccccactgtaagtaaggccttagcacctttgtcatcagtgaggtgaccatatatgtatgcattgtttttccccttgcagtccggactcggcttctgtcatcacatctctttgtctgactctctttgctgtgtctctcttccacttttaaggatcctagtgatcacattgagtccacccagataagccaggataatttccccattttaaagccagctgaatcacaactttaattctgtctgaagcctgaattctcttttgccatgtaacctaacatattctcaggtttgggggatttttttaccattgatttttgagagttctttatgtattctagatactagagagttctttatatattcttcttttctttttttttcactcttgttgcccaggctggagtgcaatggcatgatctcagctcactgcaacctccacctcccaggttcaaggaattctgcctcagcctcccgagtagctgggattacaggtgcacgccaccacgcctgcctaattttgtatttttagtagagttggggtttcaccatattggtcgggctgatctcaaacttctgacctcaggtgatctgcccgcttcagcccctacagagtgctggattacaggcatgagtcactgtgcctggccaagagttctttatacattctagatactagtcctttgctggatatgtgatttgcaaatgttttcttctattctgtagcctgtattttcatcctcatcagggtctttcacagaggaagacttttaaaaactttttgatgaggtcaaatttatcaagttttccttttatggatcatacatttgatgtcgtctaagaactctttgcctagtcctagatcctgaagattttcccctatgtttttgtctgaaaacatagttatatgttttatagttgcacatatatagttttatagttgcaagttatactttttcagttaatttttgtataaggtgtgaggtttagatgaacccattgtctgtagatgtccaatgtttccagcaccatttgttaagactatccttcctttgttgaattgctattgcacctttgttaaaaaatcagttgggcatgcttgggtgggtctatttctgggttttctattcaattccattgatttttgtatctgtgcctccaccaataacacactgtgttgattattgtaaccacatagtaggacttaatatcaggtagagtcgttccgcctacttttttttttttttttttgtaagattgttttagttattctaggggctatgtctttccatataaattttagaataagcaaatctatgtttacaaaagaaagacaaagacattgcattaaacccataaacatttttacaatgttgaaccttttaatctgtgagcacatgatattgtctctctacttctttaggttgtctttgacttttttaatcagcattttgtaatttttagcttgcagatcctgtatgaattttattatgtttggccgggcgcggtgactcacacctgtaatcccagcactttgggaggccgaggcgggcggatcacgaggtcaggagatcgagaccatcctggctaacatggtgaaaccccatctctactaaaaatacaaaaaaaaaaaaaatagccgggcgtggtggcgggtgcctttagtcgtagctactcaggaggctgaggcaggagaatggcatgaacccgggaggcagagctcgcagtgagccgagattgcaacactgcactccagcctgggagacagagcgacactctgtctcaaaaaaaaaaaaaattgttatgtcccaatttctttgggggtgttcattattagtatataaaaagtgatgatttttgtgttgatcttttttttttttttttttttttttttttttgaaacggagtctcgctctttcgcccaggctggactgcagtggcgctgtcttggctcactgcaagctccgcctcccgggttcaggccattctcctgcctcagcctccctagtagctgggactacaggcgcgcgctaccacacccggctaatttttttttttgtatttttagtagagacggggtttcaccgtgttagccaggatggtctcgaccgcctgacctcgtgatccacccgcctcggcctcccaaagtgctgggattacaggcgtgagccactgcgcctggccttgtgttgatcttatatctgcaaccttgctgaactaactattggttttaagaatttttagtattttccttgggattctctaggtgaattattttattttattttattttattttattttattttattttattttattttatttgttttattttattagacacagggtctcactacgttgagaccaggctggtctcgaactcctgggctcaagttatcctcccacttttgcctcccaaagtgctgggattacaagtgagaggcaccacaccaagcaagatgttttaaatgttatttttataaccaatccttatttttatttattcacatgatcatgtcttcattatcactcctaatgttgttttttatgtctcctctctttttttctgttaagattcccaagctgtggtcttttcacaaaacacctagcttttatttttattaatcaactctacatctttttctgtctagttcattaaatttttttttttttttttgagactagtcttgcttggtcacccaggcaggagtgcagtggcgcaatcatagctcactgcaacctccaccttccaggttcaagcgattctcctgcctcattcggcctcccaagtacctaggattacaggtgtgcacctctacatccagctaatttttgtatttttagtagagttggggtttcaccctgttggccaggctggtcttgaactcctgacctcaattgatccaatcgcctcagcctcccaaagtgctgagattatgggtgtgagccactgcatccatcctagttcattaatctctgatttttatctttaccagtatttttatttctactttctttggatttatttatttttcttttttctagctttttgagttgagaccttagttaattttttaaacatttattgcttttgggtgaatccattggttatagatcccctgcatattgttttggatgaatactgcaagttttactatgtaatgttttaagtgttcttgtaaaagtttgcatctcagtatgatgatgaaaaagttctagagatggatggatggatgattaactacaatatgaatgaatgtaatgccactgaactgtacacttaaaagtggtgaaaatgttatgttacgtatattttaccacaatgaaaagtttgtaattcttgtttgagttatttctttaacccaataatatttatatacatatttaaaacttttcaggatcattttgtggttgctgttgctgttgctcttgttttatttgactattcttttttttgttttgttttgtttttgttgttgttgtttttgacggagtctcgctctgttgctcaggctggagtgcagtggtgtgattttggctcactgcaacctccgcctcctgggttcaagcaattctcctgcctcagcctcctaagtagctgggagtacaggagcgtgccaccttgcccaactaatttttgtatttctagtagagtcggggtttcactctgttggccaggctgatctcgaactcctgacctcatgatccacccgcctcggcctcccaaagtgctgggattacaggcgtgagccactgcacctggcctattcttttttcagccctaattttattacatgtgacttgtgaaggtgtcatgtatgacttctgttttttgagttttattgatttcttttgtgagctagtacatgtttaatttttttttgaaaattttgtgtgtgcttgaagagaatatgtattttcttattgggtaagatattttagattacttttaagatcaagttccttaatttttatcaaaccattcatatccttacttattttctatctgacctgtggacttctgagaggtgtattagaaatctcctaatttgatttgagatttgttttctctttatatttctgtcaaagctatattagtagatgcatgaatgtttgtgcctattatatcttcttggtgaactatcctatgttttaatatgagtagcctccttgttcttgttctttttattgtgttttgccttgactttctcttttttctttttttttttgagacaggatctcactctgtcacccaggctggagtatagtggcataatctcagctcactacaacctctgcctcccaggctcatttgatcctcctgcctcaacctctcaagtagttagaagtacagacatgcaccaccatgcctggctaaattttgttgcggtttttgtagagatgaggtttcaccatgttgtccaggctggtcttgaactcccagactcaagtgatcctcccgcctcagtctcccaaagtgctgggattacaggcctaagccaccacacccggtcctgaatttatttttctaatattaatattctcactcccactttctttttaaaaatatattcctaatatatctttttctagtgttagaattcatttttaattaataattctctaaggtttataatgagaaaacagtcccatactttatctctgattccagttcctagtgctttcccttccactttgaactttttcagttttttctgctgtttcctaccatattaaaaaataacatgctttcctgttattttttcaattttatgtatcacctattgacttcctatggaggttgaataaattcgttctttcacaaagacacaaacacactcaactttcctttcatccttccaatatgattaaattgcaacttttgctgaaatgattgttccaatgtttacattataataattatgcaaacacagttcacagctgatccatgtactgaattctgtttttatttcttttctcatacaacctttcttctcccgcggttgataattaccttgttttttgtttttttgtttttttatttgttattttcttagtttctattacgatatcctaaaatttattgcagaagtataaatttcccctcaatatgttttaaaaattagatatttgatcagtttctttttctttcttggagacactcccagagctccccatccttctgctcccatcctggctgctgaaggcctgatgcacagctgtcatcctgggacttccgtgcaccatcatccctgtttccggatcctctgtcttcctcttcttggtttattctctctttttgatggagcacattctctagagaagcaagagaggatcttgatcttgtgaggcctaaaattatgcaattatacagaatcacaaatggaaaattagacatcaaagaaatgtgggaaaagaaatcacaacaaactgcagtttttgaaaatggtgacaattaccacaaaccacaaaatccaggaaagtagtcgaacattaaactacatgacattgctttataatgattttctcctgaacttttagttgtatctctgaagacctttgtatcagttgaccttcaatcaaaagcagaagcagatcctgctagaaggatatgtttctctctctctctctctctctctctctctctctccctctctttaaatggatttgctgtagggcttcaacattacacaattgtggaagctgactaagcatgctttgtaaggctgttaccttgcatctgatgctggagtttgaagtctgcagggcaggcagggtggaaaggaagagggaaataaaactccagggagagcaagaacaagctagagtccaagaacatgaggtggaacctataaggacagagcagaactgtctccaaccttgatgatgtgggtgtcttgtgggagaagctggtgccctgcctcgcagagcttaacacacacctgggccaggagtcagagcaactgaaagaggatcaggagaagttggaggaggtacaagcccagctgctgccccatgcccaagaggtcagccagcaggtaagcaaccaaatggctgctgcctgtcttccaccctctaaatcaccttcaaaaatgtctctgtggctgggcgcggtggctcacgcttgtaatcccagcaccttgggaggccgaggagggcggattgcttgaggtcaggagtttgagaccagcctggccaacatggcaaaaccccgtctctgctaaaaatacgaaaatcagccaggcatggtgatgcacacctgtagtcccagctactcaggaggctgaggcacgagaattgctcgaacctgggaggcggaggttgcagtgagccaagatcaagccctgcactcgagcctgagccacaagatgggactccatccccaaaaaaaaaaaaaaaaaaaaaaaaaagaaatatcgtgtggccaccctacttggaaacattccagaaaggcaattctgaaaaaaacagttcagcctagccaagttaacatagtacaaagccactgtgcttcttcttaatggtaatggtttgtaataatttccagaaagaaaaataaaaagacaattcagtattttcttcagtatgtttgatcaaaatttgttttttattattggtgatcttgaagttataatactattgcagttttgtgtcccacagacatagggattctgataaattcgatttcatgtgattctcactcaaaaataaaaaaaaaaagtgccctgacaattaatagttttgctggacgtagaattctaggtttgaaactattttcccttagaatgttgaaggtgttggtctattttgcaatgttgaatacattattgacaggagagactgctggctttgactaaacgttaatgagaactgagtactctcctcgcaaatttctatatctaatgggaagggttttccctagccaagctttttggctctgtacatctcaaaatttgttttttctctactacccagctgcttcattgccaaatgccttagaacaagttcatttttgttttgttttgtttttgagacaaggtcttgctctgttgtcctggctggagtacagtgacatgaacacagctgactacagcctcgacctcccagtctcaagcaatcctcctgcctcagccttccaagtagctaggactacaggtgcacgccaccacacctacctaatttttgtattttttgtagagatgaggtcttactatgttgttcaagctggtttcttaacgcctggcctcaagtgatcctcccaccttggcctcccaaagtgctgggattatagatgtgagccaccatgccagcccaagttcatattgtgatacatttgaccctgacctttcatgtcacaatgcctgtgagtcagcccagtggacagcaagagtattcctaaatggtcatttttacaataggacaactaccacatggaagagaactgaggcgccccagtcaagacaattactgacccccagacatgcacgggggacatcctggagtctccagctctggctgagctgtcagctgacagcaaccacatgagtgctcccaacaagatcagcagaagaaccacacagataccagcctacaggactatgaaaaatgatcaatcatcttcatcttaaaccattaagttttagagtggtttgtcatgtagcaatagataactgaacacttgtaaatcatctaactggattttcaaaaacccaatttgaatgtctttcctttaatttataacaacttattcataatttcttatacttaatgatatgtttgggttgattcctgacactttgagttttctatcggccatgcttttttgcctcccacccccatttgtgccctttgttagataggtcaggttttatttatggtatttttcttcttacagtcaggaagttataaatcctatttccattcttcgggcttttctattcaagaaacaaaggaatatatctgtttcttcatctttctttggcgattgggtgtgcttcgggtttaattaggttgaattttacccatcagaaggaagctactgttcgtggcctagaaaacgataaagtatagagtaaggcaatcaaaatcaccacaggaaaggagccctgtgggtctgtctgtgtgtggatgtgtgagcggatggttattagaaaatggttgaggaatgcagctcatcagctgaggctcggtgctcatcagccacccatctgacactcatcaaaagcatcggttgctggagattgaccaggtgtccgcagcggcctgtttcttaccgtctgctttggcttggccaaggtttaggcagcttctctctttcctccaggcttctgaggtctgctttcctccaagcctgagcaagcataacagaaagtggattgtgaccccttatcagctcctcctgggaatcggctgaccctgtctttcctaggcacactcccgccagaccccaccccttgtgtggccagcttcccttccaaacgtttgcttacctctgcttgtcctctctttaccctgtgaaagaaaaagttatttctgtttgattttgagacactcacagatttctgagatgggagagttctccatattgcaatcgtctttctaattaaagcctctccctccctctctaattctggatttgtttttatttgacaaaatatagtcaccattttctggggatgaaaacttagtcaatatcagaaacctgactgcagtcaggaatagagctcattcacctttcttccctagaacttagactgtgcttgaggcatagtgggtacttctttatgtgttttatgaatgaatgaatgaatgaacgaacagatgctgaactcaggagacagagaaggaagctgggagagctggtgtctggcctctgcttgctccaggagctatgttctccctgttcacagctatagctgccagggattctggaaacacatcctgctgccatggaaatgaatgcagtcacagagtgggaacagttaagttacttttctgagagagttacatcatttagaagcagatctctaaaagtccttgctcctgcaggagttggtgactgagtggcagtaattgtgttcacatggttaactatgacagtgtcacatgaagctcaaataatgggttggaaacgcacaaatgattgctagttgcttgagctctctgctagcccttgccttgctctctccatatttactttctccagcttgcaactggatatacagacgtgtctctgcagcagcctggcccaccctattgactgaggcaggaagttgatctgcgggttgcagctgctcttgaggaagctgagtctactaaaatctgttcaccctttccctgacactgctgctgaggccggtccccatccccggcagcttcgctgggccttgtttatcttttcatcactcttgactggctctggcctatttctggatctcatgtctgtcctctgacaaaccctgcctctctgccagctttctggaatctgtcaatctgagaggcatgggaaaacgacattgcccaacagaaccagcatctcaatgtggcaaaaatagactcatccaaagcaatctgggcatacactaatgtccccagcactgaacatccccaatcactggtttcccccatctgattaattttttccccatagagaggttttgcaaacatttatgcatctttaagcattttagtgatctgattttcttaattttgatggatttttctttttttctttacctaaaaatatcatttgaatccattttcagctgattattcctttttttctgtttgtaatagcaacgagctagaaacaaggtaattatccaacaataaaagacattttccctccactttgtgtgctctttgatgctcatgctgcaggccgagggtcacttatatcctcccactggccttattgctggctaacccgtgacccggtagcctagccctctgtctttcctgggaatctcttccaaccagctgacctctgcctggtccttcttagtttgacagagcacctgtttgttcctagggtgccgaatggagcactgtccttctcctggataactgatgacaaagatgcatccaacctgcacacgcaacatgctccctcttccatgaatgccggttgcacccgatgatctgcgcctgctcactctacctgcctccctgcccagggcagagaactgaggatgttatgttagtgaaatcctcagatcactcacagcgcagaacactccccaacttctctccatcatgtgtcaggcccagaagcagttacaatcattacaacatcacctcccacctttccatctacacggttgaacagctgtgcattagtctagaaaagtcaccctgaaaactggctctagtttggggaggtgacatgctcttgctttgtccccagagatgttcttctgttgtccttgcagtgcagggagtacctcctgggctgtgtgcagcagccctgcctgaggtaggggagtgctgttcactaatatagatctgaatctcaccagtctaggaggggacaggtacttctaagtcaatcaatcaatcaatcaatcatcagtcaatcaatctttcaagttttctcatcttccaaaaagacactaatgcccagttgaaagtggtagccactcaattcacctgggcttatcacacaaacaaactctcgttatcatattttttccttgatgctgtatgaaactgagtgaagtcacatttcctgattcagaagttgcaactgaaatggcccaagtgggaacaaaaggggaaattttgataacagatgggttgaccctttatggtatagagctgattctgagaactactccaacaagcatgcattctaaactctatcaagcaatgtgtggaatcacggcaacaaaaacatgttctccctagctcttaagtattttttatttggaaaatggagtttcaagttgttttcctgacttctatgaagattgtgatgaaattgcagaatatataaaacaaaagattgttgatattgtgttcaaatgcaaactagactgctcatctatctgcatatttggcaaatggtgcaaatgtaaatattggaaaattccattcagtctataaacttaccaaaggaaattttaaaaatttcctgctaaacgtcctgacccctctgtaccttttacataacactgctaaaaagaggtatgatttgcctactgtgacattgacagtttcataatgacatttttggttagttttcagtttcctcaaagcatgcagaggcgctttatgagatttttgatttttatgggcgtggtaggagatagccttcttagacatgcctacaagatgtcttgcagaaaagatgttagcatgttggcctactataaaatcatattttcaaagtgtaggatgagaagaatgtccttcactactttggaaatacattgaggatgagaacagagaaaaggattactgtaaaatggaaatttatatgccgtttctccaagactgtttcataatctttaaaaaagctacagaaaaggatgaactaagtgcatctaactcgttccatttaggtgtaggttgtgacaaaaactcatctagtgaacaaatgactcatttcttggaaataagactgctttgaaacttaaaaaattatcactaggaaaggacagccaagttaaacaggattttctcaatttctttactaaaactgtaacttatttggaatccagcttcaatttcacaagttcaaagtacctccctgctttgaaaccattttttccagagaaaagaggcttaccttatgatgacatccaatgtgctttgaagtgttttagaatgacagacattttagacatcgatagcctgtgtgattaatttattgaagcaaaagaactgattgacgaacagctggcctaccaaaacaagcccatagatacaggggatggacatttatggagaggtggaaattaactcctacaagtctaaaaacctgctgttgctagtaaataaaagcctaggtactccatgccctcacacagtattgttgagaagctatttagcattgtgttatcacatcagactgacactagaaatcagtgtaatgtgggcttgagaagagcagagccgcaggccaaagtgaatgttatacttatctccattcagttttatcattgcataaaagaaaggatgggtgtcataaatgccacaggcaattcagagaactattattaagacaggaagctgaaagaataaaaggcatcttactgtagcatgggacagaaggaaactgacattaaggcatcttactttagcatgggacaggaggaaactgacatttttaaaaaatcaaatatatgaaatacctgtttcatcattcctattctattttcattttcctttttaattttttgccttccttttttttattcttttccaacttttaagtttaggggttcatgtgcaggatgttcaggtttgttacacaggtaaacgtttgtcatggtggtttgctgcactgatcatcccatcatctcagtattaagccagcccagcatctattagctattcttcctgatgttctcctttctcccacccctaccctctgacaggccccattgtgtgttgttcccccgatgtttccatgtgttcccatcattcagctcccacttataagtgagaacatgcagtgtttggttttctgctcctgtgttagtttgctgaggataaaggcttccaataccatccatgaccctgcaaaggacatgatctcattcctttttatggctgcatagtattccatggtctatatgtgccacattttctttatccagtctatcattgatgggtatttaggttgattccatgtctttgctatcgtgaatagttacgttttcctttttagaagtcttatgtttatatatcttaataatataaaataaatagcctataaaccttaaatattcaataaggacttttaaaaagttaaaaacaaattgccatatacaaggataaaaacagtgtaaaaatattgttttattttttcacacatatttaattggtcttactattaattgtcactacttgttattaactagtcctattgtctggtttaaataacatttatataacagaaaggtaaataaatcagaatatataatttcaaataagcacctatcttccatattttatggtaatattttaaaatcaatggcacatccgtgtataattatttattatatatggtattatggcttttgtattcgtctggcatggcatggcatggctgtgtcccgggttgtctttctaaaatattggtgatcctgtctgtcacttgcatcatgtttcttttttcttcatcatcttcttctttttttttttgagatggagtctctctctgagcccaggttggagtgcaatggggcaatcttggctcactgcaacctccgcctccgaggttcaagcaattctcctgcctcagcctcccaagtagctgggattacaaacatcccccactattcctggctaatttttgtatttttagtagagaaggggttttgtcatattggccaggctggtctcaaactcctgacctcaggtgatccacccacctcggcctcccaaagtgctgggattacaggtgtgagccaccacgcctggcccggcatcatgtatctatggttccatccacatggctgtcgtgcatatcagtagctcaatcctttagactgccgagtggtgttccattgtatggatacaatgagcccctggtggtggtggtggtggtggtgtttttatccattcactagctgatggatatttgggttgtttccagttcttggtgattataaacatgtgcataaaggttcttgtgtgcacatttttatttttcttgggtaactgcctaagtgcagaattcgtgggttatattatgaatgtatgttttactatgtgaggaactcccaattatcttcccaagtggctgaaccatttttgcattcccaccagcagtgtatgagctgctttgcatgctagttagcacttgataatttgtttcatttttaaaaattttcagctattctaatagatgtgtagtggtattttcttattttaaaattttatagcagtcattttgattggcattcacaactgcctcagagggaaccaagacaaaaagaaaacataaagaaagaaaattctgcctgtggagcggaagaatgggaacaggtgcggaaagggtcccaggaatgggtatgacattgagcatattctgggtaaaaaatcagctttggctgaggaaaagtgccccagggaggtggggggttatgtcaaccagactgccccctctcccagagctcagacccagggctctgagagtcctcaggtcttcgtgtctcaagaggaaaaaaggagttggggtggggggagggcagaaagagttctgccctttattatttattatttatttatttatttatttatttatttatttatttatttgagacagggtcttgctctgttgcccaggctggagtgcagagacatgatcatggctcactgcagcctgaaactccctggctcaatcgatcctcccacctcagcctcctaagtagctgggactacaggcatgtgccaccacgcccagcaaattttttattttttgtagagatgggcttttgccatgttgcctagaccaatcttgaactcctaggctcgagcaatcctcctgcctcagcctcccaaagtactgggattacaggtgtgagccaccacacctgacccagaaagcttatttttgatgggcagtgtccacgtcaccatactgtgagctccatgaaggcaacccatcgtcactcttgtcccctgctctgttcccacacctggcttactgcctgtctcatggttggagcccaggaggtacttatggagtggatggaataatgaatatttctagaccgctgaagctgctttagtgaacgtcacacagaacagtgactgcactctttctgccagtctagtgaaagccccctttgcttgccctaggcccagtttatgacccatcttgtcatttcttcaccacctctcacacctgttcactttactaccccttccctcaccactgcttcttctctgggctgttgacatagcctccttacaactctcacagcctcccccagtcctcttctgtcccccagtttctaatctgtcttatctttgccagatgttggattcataagccttgctcttatcctgacctgtcacatcaaagcccctgtactggctcttgatatccacaaaagaagagccaacaggaaactggccccagctcccttcctatatcccagctcccattggccctctggagggctcttgattttggtcaaagtctatctgcatgtttgttgttgttttttgtttgtttgtttgtttgttttttgagacggaatctcgccccgatgcccagctggattgcaatggcacgatcttggctcacagcaacctccacctcccaggttcaagcgattcttctgcctcagcctcctgtgtagctaggattacaggtgcaaccacaccctgctaactttttgtatctttagtagagacggggtttcaccatgttggctaggctggtcttgaactcccgacctcatgatccgcccatctcggcctcccaaagtgctgggattacaggcatgagccactgcgcccagctgccttcatgtttttaaaactgccctttcctgctgaaaccgaacctatcctgtctgcatggcctctcaaaagaacgaaagaaccagggcttcgggatcagagagatgtgggttcaaactctagtcacctatttcctaaccaaggggacattgaaaaattccttaacctgagtctcagtgctcttttctctagatgggcaataaaaagtacctacctttacttgggaggctgagacaggaggatcctttgggtccaggaagttgaggctgcagtgagctatgaagcaccactatgctccaacccgagtgacaaagggagacctcatctctaaaacaaaacaaaacaaaaaagtacctaccctgggtttgtgtaaggagatggtatgtataaagggggcctggcatatactaacaatgtaggaatttaaaacatagtagatatgatttttggtaattcctgcctaaagaaaaaaaggctaaaaataagggtataattaattaattgttttctaattctttcccagccgtaacactgaaggttgcttccctagggagggaattacctgggtagagattaagtgtgggtgctgctgcccccagcctaatgggtcacatgccctaaagagaagctggtcagtcacaatgctccctccagctcctctctaccttgggatagaggcctcatgggttaaaagaccaaccaaacaacaacaggacacaatagagaaaatagccagtgagggagaactttttcatcctttcccacagacatatgggatcatttcatgtgtgaacatcatgaaggaggaagacaaagacaaacagaaagtggtcctcctaactgggtgctccctgagggagaggcatgagcctgatgatgattggagattgctatggtttgtataatagtgtctcctctgaaattcatgttgaaacagaatgccccatgcaacagtattaagaagtgtggtcttgaggtcgtgattgagtcacgagggctccataatcataaacggatagggttagggggttagggctcttataaaaagacttgacaggccaggtgtggtggctcacgcctgtaatcccagcactttgggaggccggggcaggtggatcacctgaggtcaggagtttgagaccagcctggccaacatggtgaaaccgtctttactaaaaatacaaaaattagccgggcatggtggcaaatgcctgtaattccggctacttgggaggctgaggcaggagaatcacttgaacccaggaggcagaggttgcagtgagcagaaatcatgccactgaactccagcctgggcaacaagagtgaaacaccatctcaaaaaaaaaaaaaaaaaaaaagacttgacagatggagttcactcttttactgcccttccatcccttctgctacttgagaccatggcattccttccctctggaggatgcagcaacaaggtgccatcttggaagcagggaacagccctcagcagacataaccaaacctgctggtgccttgctcttggactttccagcctccagaactgcgagaaaattaatttctcttttttataaatgacccaatctcaggtattttgttatagcaacaaaaatgaactaagacagagttgctccaagaagaagacgcttaaaacctttccaaagcaaatgggtctccttggagtagaaagctccccaacatcaatgagattctagagggaacattatgatcacatatcagggaagagagtgaagcttcaaatgggctctgattagatgctctctaaagcccagcttcattctgggttctgcaactgaagaggctttagggttaaaagggcttccagttgcttgaaaagcaaaaataaaaagaagaagctcatatgtcaataaggtaagtcattaagaaagtaggtgcttttaataccaggtaatgtcagcataagaatatgtatacaaaggtgggttatttttagtattggttgaaggcacattattcttttgacaattagaataaagaaagcaattagaaactccaggaaaatgaaaagctgtgcagaaaaagctgtagcccaaatataaagcaaatgaaatgtggcatgtctttgagcagctgatggagcataagaaaattgaatacatttgaccttgatgctaaggaccccttctgagcagcctgggcatcatgacattggatcagaaaggaaagaaatgtaattcttggatattccttggctcagcggtgacagtgaactgtactcacacaggcatgagaatgtaatattggtttattgattttttcagagtcaatttatggacaaaatgcagctgttataataatgacttcagaatagtatctaaatgttatcatcatttaaaatgtaaaagtaagactattaaagacttgagagatagaggagagatagaagtcggtttcttattttacatagtgggaagtcattcgattgtatcttcactctatggagtaggatgtaggtctattacttagagctcaaaggtaaccagtggaagaaccaagaatattttaactcgcaaaaaccaggaggaatgaagagtgatgaaagggagccatgcgtatgaactaaaaccttgtttttcccagcagagtgaatgagtttcctaggactgccataacaaagtatcaaaaacagtgtgactcggccgggcgtggtggctcacacctgcaatcccagcattttgggaggccaaggcgggcaaatcatctgagatcaggagttcaagaccagcctggtcaatgtagtgaaaccctgtctccactaaaaatacaaaaattagccaggcttggtggcaggagcctgtaatcccaactactcaggaggctgaggcaggagaatcgcttgaacttgggaggtggaggttgcggtgagccacatcgcaccactgtattccagcctgggtgacagagcaagacttcattaaaaataaataaataaataaataaaaataaaaaacagtgtgactcaaacaacaaaaatttatcatctcacagttctggaggctgaggttgaaatcaaggtgtcagcagggttggtttctgcaggggaggatctgttccaggcctctctactaggatctgttgcttgctggcgatctctggtgcttgcagatgcacggctccaccagctgctttcatctccattttatgttctccctgtgtcttcaccttgtcttccttctgtatccaaatttctcctctttatgaggacaccaagaattctaaattttgaatttggccttccacgtagttattaagacacatttgtcatggattggagaacagaacatattaaatcttttgtagaatttataactttaaaatatttacacatatggccagatgtggtgtctcatgcctgtaatcccagcattttgggaggccaaggcagacggatcacctgagatcaggagttcaagtccagcctggccaacatggccaaaccccgtctctacaaaaatacaaaaattaaccaggcgtggtgatgggcacctgtaatgccagctacttgggaggctgaggcaagagaatcacttgaacccaggaggcggaggttgcaatgagccaagatcatgccactgcattccagcctgggcgacagacccaatctcaggtattttgttatagcaagacaagagtgagactctgtctcaaaaaaaaaaaaagaaaagaaaagaaaagaaaataggccaggcgaagtggctcacacctgcaatcccagcactttgggaggccgaggcgggtggatcacatgaggtcaggagtttgaggccagcctgaccaacatggagaaaccctgtctctactaaaaatacaaaaatagctgggcgtggtggtgcgtgcctgtaatcccagctgctcaggaggctgaggaaggagaatcacctgaacctgggaggcagaggttgcagtgagccgagatcgcaccattgcactccaacctgggcaagaagagtgaaactccatctcaaaaataaataaataaataaataaataaaatatttacacatatggtatatgggcctccaattattcttttgtcacaggccctgcaaatgttatgggcaggcctgacgtgtgtaaccacagccgaagaagaaccagaaaccatcagttgttgctctggagagtgcataagagaaggcgagggtgggagaaggaggatcgtagtgttttgttagaggcctctctgtcaatgtgatgctctgttttgccatttgcatgcttcacttcaataaaacttatgaaaattatccaagttctcacctcctcccttgagtcttcctgatccgcagctctcacctctcttctctcagcttctacaaccctcagcagctgtgccgccttctgtcctgcttggcctgctctcccagaggcccctgaagacaataccacctccccaggcccactggccacctgtcttcttgtctcccccgagaggttccctgggctgaggtcagcacagcctgcttgccctgcctcctcttggtcagcattctctgccagagcttctctcctccctccatctctagcctggtgctcccacctgtacctcctggtagcccctcagggttgggagaaggccaagctctgcccacagtctctgtctggtggctgggggtgggtggggaggtgttgcatggaacagcgctgcagcctcacctcttcgtgagaagcaggtgtctgccaagccagatgggtttctgctgtcagtgagaggctccaccttcctcctgactgtcccaggcctttgccaccactgttctctttatgtctcagtctccctccctcccccttccctcaccctcgctttctgctgggtccccccgtttctccttttctctctctctgcattaccctccaagccctttaccctcaattccatcttcccctggagcagagggattattgtgactcccccattccagaccccagatcctgcttcatcctcagggttaaactaaccctgccccacccactcaacctgcacccgcgtctaatccagacccttcatgctgacccctaacaaatggcccttggcccattcctagtgccccacagctaacagagggtcgtgatcctgaccctatagcactggttccaatctagaactttaaactgaacactcactgtcattcataacactccccagtcccacccctaccctttgggaagggctggggctgaaaactcgaggtctgtgatgtatcctgggggtgcggccaagttctgcattcctggaaactgggactggcttggggaaaaacaaaaataattcctatgaagtatgcttcaattggtgctactgctgaaaatagtccctgaggatgaacatgaaggtcaggagagagcagtgggaatggtgccaggagaggggaccagaaaagtggctggagatggccctgagtggaagggcagtgacagtcagcagggagggcttaggaggccctgggcagacggaggagggaggagagaggggggcaaaggctccagctggaaggtcaaggttattgttcattcattcctttgttcagcaactatttgttaagcacctactaagtggcaggccctttgctgggcactagggggatagcagtggacagaacgaagtacccacctgtgtggagctcacattcagattgcggagatagacaggaaacacactaacagagatgtcaggggaggggagggaagaaggacaagtaaggcaaggtgaggagacagcaagggacaaagactgtttatatagagtggcctgggaaggcctttctggggagctggcatttgaacaaacctcaaaagacaagaggaagggagccctgcaggtgtggacagactttgtccagttagaggaaatagtaggagcagcagccccaaggtgggagcagggcacacgtggggctgcacacagtgagcagggccagagcaaaggggggtgaggccagggaaagtggccaggttgcccaccaaggctcacctgggttcctaggtcagagatcctgagaagaggggagaagccctcatgcccaagtggtgggaaggggtggaggagaatggggaggaaatgggagtgaggccaccccaggtaaggtcagctgcaacctctgggctagggtgacgccagaagagaagatagggcctgcagtgcctctcccccatccacagccctgggtgcacatgccacgagctcctgctcactccacctcacatccccacacttgtgcatgaacaacacacacacatggagaatagtcacaggctcacctttcacatgcatgcacacagaaattgtgcatgaacacacgcatgcacacgggccccttgtgttagtgtagacatttttgagaattctaaacaggcagaatataggggccaaaggactttagaccaactctcacgtatgacagaggcactaaggcctagaaaaaggaagcctcataatttggtgacctaggcagatcactctatgtccccccatgcatgtgcatgttgtgtgtgtgtgcgcgcgcacacacacacacacacacatgcacgcacgcagtcccaccagctgtccaaagctccttccataaccctatcttctcaacagcctctctctcccaggacacccacaggcttaaccaagtcccaccaggagtgccccgagtttcctcccagctattccagcaggctgctggggggaatacagtgtcgggaccaagatagactctgcccctcttggtgggatggctacagcccacaaccacagctgaccacagcagcccccgactgcctctctcctctcagagcctgtttccgggttcagaccttcttcctccatctctctttctgggtctttctcccttgcttcctttctctacctccagaaaggaggctgtgattctctgtttttccctctctttcctggtgtctctctcatttctctgtttctctccagttttctgtctctgctgggcttgtccctctcgctccatcttctcatcaggatctttttttttgccttccaggaaaagctgacgtggtgcccctggtcagtgggagtgaggccttctggggtgggggagtcctggttgagcagccacagctggggtgcggctggcgccctggctaggggcagcaggagcaggagcagagcgagaggcagcggaatgggaggagagagggctggacctctgcaggcaggaaggggagcagggggaaagaaaaactgtgggagggagtgagcccccctcccctgctagggtgaccaactgtactggtttgctgagactgtctcgattttagcatggaaagtcccatgtcccagaaaacccatcagttccaggtgaaccaggactgttggctggtcaccctacaagctgccagggacccacaggagacagggccaggactcacaggaggggctcccaagcttggcctcctagttctggggacagtcagggccgcacatactcaccaagggtccccatctcaggcctgagcccaatttagaggaggccaggagaggggagatggcagcccagacagcccacaggaagctcccagcctgaaaagatcagggagcccgacttctgacttgtctccctgcctgctggcatgatctcctgtgaggtgggctttacagaaagaacttgagctctgacagcaagagaagagcagaggggcaacccaggaggtcatacgccccatcctcagaggcctgcacaactgctcctgggctctgctgaggagcaggcccacctgtcccactgtgagacaccttggagagtcaatagtccttggctgagatcctggcggccttattgtccttcctggtggaagcgggtatggccacaccttgcaggcagtggcaggacctgagcagaccaggaagatacatcagtgaccagcacgcacagtctcatttctgcccaggtgggctggtccctcccacttttcccgccctcagccccccacatctgttttgaggtgggagtctgagcttagtgtttggctgtcattaaggtcttaggtagggaatgaggggacagactccctgcccccagaaggctgctgacatactcacccacccaacagagcatgggtctcctacactgtatgaaatattctctaaaatgtcttgggcatgccccttccctagcctgggcccaaaggccctatctgtaagttgatgaggagatgaagtgggtgagctctaaaatgcttccttctgatgaccacccaacttgtccatcatgccatgaagggggcgcttacagagtgtcttccctgtgctggagatcaatagcacctgggaagttaaggcctctgccctcagtgggcttcctctctagtaaggggtcgcacattaagcacgcatgaataaataatcacagcttataggaggagctatgaagaaaagtcaggaatgtctgagagaacagtcactgggaactgagggctgaggaggtgcttgtactctgaccctgatgtgcttgcaaggagggaggtggggtgggaactatgagctcctcagagcaccctggaggtaaagctggtggcacagactttgtgcaggtgagggtgtgtgtatgggctgtgcagaacatagtgaagccccctccaccaggaagccctccctgactgacactgaggtcactgagtctcccctctggtttactgaaccctggatgtgtttcttgcagcctctggttggcccaccaaattcaggactttcctagaaattctccagcacagtcaggatgatgcaagagagggcttcctctgcaggggaaagagagggtgctctccattggaccataataatatcctcagcatcagactcgggtgttttgcaggcagcatgctggggacttctgtggccttgcttggtgacagggaatggggtgtgatgagctggggcaggcttcctggggatgctttcagccaaagatgagccctgtctgcccttggccctgctgagagggtaagttgagtcatgagcagaattcaaccagttatcagatggaaggccaaggaagcttggggagggctactgaggggatacggtaggcttgtctgtggagagcaaaattcttcagtctacaaagttcttttctgggctccttcatctttcggtttctcttccagctccctcgttttgggcctcttttgtttccccattcccctcccctgggccttcccgtttggaaaaggggtcacatatcctcaccctggaggcgtctgccccttccacacagttggtgttggaacagtggagctcagagaggccgatgctgaccgcgtagatgtccagcaccaacagtgggattttgggccctgtgggggacacagagagaactctccgggagtgcggccccttggcctcccctctgggtgcccagtgggcagtgggcctgggtggctcagaatcccagccaggagcactgaaggtcaacaggctcccgccctgagttttctgagccaggcctccctgtttcctccccagccagtggggagcgcagtgaggggcggggcctggagtcttgggagctccctggacaacaacatgcatttagcgcagctcagtctcagagccagcaggatatgttttcttaaaaaaaaaaaaaatgcctaacatcttggctttcaccgaagggttggtatctgctttgtacactttggccttcttggcttttcactgaaacacacacacatggatgcacactcacttccacacacaaacccacaccaagacagacacacacacacactcacacacaaactcatgtacatggtttcatacccacatccatgcaaacacacatacaaatccagaaatacgcaccctcacacccacaaacttgtacacacacacacacgtatacacaccaacacacatacaaccctggcttggacaaaagcttcccgttttttcttgtttgaagtggaaatctcccaccttccatgagattcaatttctcgcccttcccccgctaaaatcctcctggccccatcatttcttgggtcctttccagacagtgctgtgtctttaaggaagttgaagctgctaaaagtgagtgagagagagagaaaaaacacaacccaaaaaaatttggcatctcttcccccctcaagtttctggtgtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggccaaggcaaagcatacctatggggggctccggtgggagggactgcggccaggatgtgggagggcagggggaggttctgcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcccctccgtgtctgcctggaattttgtctggatctaggagcctctgctgggagataggatcaggagctgaagagtcagggcagccagcctgcctgcccacagtggcaggggcctctgagactccaacagactgtggaggcacaggagtgctggcccgatgctgtgtcaggggctgggccttgcggtgagctgagctgcagatgttcccttcctccaaaccatcccacaggacagctgggggcaggagcctggggtggctggcgaccctgagcagcgcctgatgtcagcagtggcttcaagagaggcattttggaaaggcgcaaggaaatggaagtgcctgggtggtagctcctcttccctgtcctgctcctggaagagatgttaggaatgaagaggaaagaggggacaggtggggcaagatggaggagacagatgaggagaaggggacacaggacagaggaggagaaagccccagagagactgggaataagagaacatatttacatatttgagggagaaaccaggggggaaacaaatcgtacttatctttctcccaaagaagaaatggtattccaagaggaaagtccaaatgaggactgcagattccctgtaggaatctttccccacagagcaagtggatcagtaactggcctgggccgtgtgtgtgtgtgtgtgtgtgtgtgtgtgtgtgtgtgtacagcaacctgagcggtgcgtgtgtgtgtgtgtacagcaaccttcagcctctccagtgcatgtgtgtgtgtgtgtgtacagcaaccttcagcctctccagatgaggagcataaggatgaggtcctaacctggagactctgcacaacctcctatctgtgccaggtaggatatatgtcttcctactgcctctatcccatccctttcaagatcgaggatgctgcatgcagagacaatggcctgggggagaggctctgtggcctttctccagagctcccagaactgctgagctcagcaaagtggaggcaggatgctaaggagtctggggtagcagctgtgagccttggctgctggccagccccattccctccctccaggtccacatacagcacctccccctgcccactctcccctcatcaacttgcagctcctgctgagctgatgtcaccagcagcatgtatcaagaatgactcctaatctaaaataaaagttgaaaaaaatgactcacgtctggtggaaaacagcaggatggagccaaattccatgcgctaggccaccttgggtaagtcattgcccacgtctgggcttcagttgcctcaaaaaccaaatgacatggtaggactaggtgctacttcatggtccaatagactctgattgcctaaggcttgatattcccagcctgacttggacatccctggctccattcctagctgagtggcttggcttcttggagtaggacatggacctaagacctaacacagggaatggctgtgccttgagtggactagctgctcccctgctttaaggtcttccgtggtccccactgccctccaggtaaagcctgaattccccacttagagcctctctgacctgctcctccaacaagcgcacccttccttcctcttcttggaacagctatttaattgttcccttaatgttccatggtgtgccatcctctgcacctttgcttatactgttccctccgcccaggcaccctttccctgttcttcatttggctaagtcagtctttgagagtgggctctggcatcaccacctccagaaagccttcctggatgttcccccatccccaatgtgaacaggccccctttctctgggaacctggattctcctcccctgagaccctgttagttgctgaaacaaggtcaggaagcctttttcaacgggctgcagtgggatcacagtgtgccctctttggcctcctcggggcagccttgaaagtgggtttcaggtccctgaccccacccctggctttacaggtatttgaggctgtagcaggaacctgagcttggggcaggggactgttgatctccactaactgtgcaggcatttctcaaggccctgctgacctagatctgtagggtggccacatcttcctaccctctgtagcccccagcccctcagtggacccagggcatgttctttattcatataccccgccctccacctccaccaagcccccagtagggaaaagaccccagtctgtctccaccctcctttcccctccgtattctcattctcctcccatcaggacagcctacgctatgtccccccatgtgacacgccccttcctacctccacacctggagtcacactgcttccccagcattcctgaagtcgcttctcctccccagatcctgccccttcttcaagacccagaataagtcccacttccaaagccagcattcacatggctcaggggtggcatcatagggtccccagtctctttgccacccaaaaggatgcagctatgggttctgccttccacccagtgtctggcccagcatgtgaccagaacaccccaagccccatccccatcaatgcacagtgttcctgacagtgtaggcggggttttccctgcatacccctcccgctatgaggacagtttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatctgctcctcccggaaggcagctccccccttctccagtctggctctgcccctcctcctgccctcacagacctcccgcccttgattccgggatcagaggaacccaccccacccccatctccagctcaggcacagagcaggggctggggccccacacaacacacagggcggcttgtctccagcggtatagcctctccacacccccaaaccgtttgctcgaaacttgatctccttggccctcagagtcacctcagtggagaagcctgcacagggctttgatggctgagtttccccagatgtggccttagagaagctgaggaaccccctacttacctccatttgtccccatccatcactcccagggggccactgcctgatgaattgccagaggggaaccaccagctcggctcttaataaccggatctgcatcctgctgctgcccagctgggctgagggccctgaccacagctaaggggagtcatcacagggcttcagggctggaattccaggtatgatctattcccaggggaagtgaaaaaggccccctcggagctttctcttctatttctcacttctcacagacaggctggggttctggagtcctgctcttcaccccaagtacatgcctgcaacctccaacgctgctggacagtcggctgcatcccccctcacctgagcacaggctctccctacccctccctccccttcctagagggggtatcctgcagggatgcagacaagactggggaaggaaatggtgctcagagggtgctccacctaggtgctgtggcaagcagggcagggagagagtagataaaggccgggccaagaagcggggccctaaattctcaggagaagggccctggagaggcagtctcttccttgaaggagaaagggagtgccatctataaaaaggtgggaccacaggcttttgtatgtgagattggcttccaatgatagtaaaagaccctggaagagagaaggacaatgccagagccaggcctgcccaggagaggcagggagagagggagagagagagcagctcaagccgagaaagggaagcagccagccagcttggatctgatcaccatcttgtccatggagaagaggatttttagttccaaagggttaaacccacataaagagaaaattaacctttggcacacttttaggaatccattcccaaggaatgcctgcatgcatatatatggagacaaaattcccaaggccgtttgtaatggcaaaaataattggcaacaaccccaatatccatccatcaatgctgataagttgacacactgaagtactattttgctgataaaaagaatgaggtaattctctggactgacgtggcagaacctccaagacatattgccaagtaacagtaaccaagaaagcaagttgctgaacaatacataaatcgtgatctcattttatgcttctttaactaggtagacatatgtgtatgtatgtgtgtacacataaaaagtgaatctggcagacacacagcaaactgttcacagtggtcacacttgggggaggggtgaattttggagaatgaagcaggatttttcacttgtttgaaatgcatattttaaaactcatactgcatgtgtaattctttttaaataagcctgctgtgagtaaggagctgtgaaggcatcactgagctgtgtgaatttgattccgtccccagcccaatattgcacacttcccagtctcccttgaagctagatgtagcccttagactaggtattggccagtgacttggaaaaagagtgttgagcacaattcccaggttgtgttctcaaaaagagaggtgttctctttaccccctcctccttctagctgggtgaaaaacagttgtgatagctggatctcaggcagccatcttggactatgagatagaagtcatgagttaagtagaatagagcagtaagttactggcaaagacagagccttagctaaggccagattataaggctgaaggagactcctgctgtaccccagactccaacacatccaaaagaaacttaagcccagagaggccacatgatgtgccagggtcagtgactgacctaggggaagttttgccagagattcccccccaccactacgcacgcacacgcacacacacacacacacacacacacacacctcactgctttttcccccaagaacattccttcctagagcttggactccgtttcattctatggctgggagactccttctgggattgagggaaggccccaagtgttgattaagccaaattgcaggattgggacacacctctcaatactctgtctgataacacagcagaacccctgcctactgctgggtctctctgtcaatatctgcccctggcttttttttttttttttttttttttgagatggagtttggctcttgttgcccaggctggagtgcaatggtgctatctcagtccactgcaacctccgcctcctgggttcaagcgattctcctgcttcggcctcccgagtagctcggattacaggcatgcaccaccatgcccggctgaatttttttgtatttttagtagagatgaggtttctccatgttggtcaggctggtctcgaactcctaacctcaggtgatctgcccacctcggcctcccaaagtgctgggattacaggtatgagtcacggtgctcagcccctttctctctttctatctggttgtcctcctgtctgcctttctgcccctgtccatcagtctctctgcctgtccctggtatgccactctctgtttcaccctctctgtgtctgactcagtctccctcctttccttctgtctctctctactttccttctgtctctcctcctccttctttctctgtctaactctgtgttttctctctatcactctctctgttgtttcctttttgtttctctctcctgctctttgttttgctccccactccccagtctggctgtgaagtttgtgtctctcctcctaaaggttttaggcagtaccttttctaagctagcctgggccatgcctaaatctctgatcttgggccttgtcttgtgctgactcagtgctgcccctgccatctcctgccctctttcccgccttacctgctctgtctgtccccagtgctgcaggatgagtggcgctggtctcgggatccgcagagtctacagggccctgggcttggacaccgtctcaggggtttgtgccttcagagcctggtggagcagccaagcaactgggcacatgaagacaaaggtcagtgctgctgagcagtaaggctaccttctccctcccgccagaccaagaactttagcccctccaaggcaagtctggcagaggggggctgtcagggcaagcccagggatcactgatgctgccctagctcccctcctccagctcctgctcagctggaggtcagagcaaaaggacttgagggatgacccaagactttcctgacagtgcttggtgctggagcccggagcaggaggccaagagaggaacggagtgccatccaatggcactggcgtggcagacaggatcacagttactactcatggcagaaagcttcaaagtagccaggcccctcggtggaaggaagagacgaggcttctaattttgtttttactacttactagctgagtgaccacaaatgcagcctgttggaactcagaaaataacacccgaaaatgaaagcctcagaagcaaaagtgaccttctagccttctcctgccctcctgtgtctcaggcccgttttcccccaaggacggacatagaaaagagaatccctcctcctcaaggcgggttatagaaatcaaaaccccttttccccaaagctagccataaagcctacaaactctaactttccccaatttctgtgtaaaaactggccacaaataaattctcaggcctaggtggggcatggtggctcacacctataatcccagcactttgggaggccgagtcgggtgtatcatttgaggtcaggagttcaagaccagcatggccgacattatgaaaccccgtctctattaaaaatacaaaaattagccaggcagtagtggtgtacacttgtaatcccagctacttgggaggctgaggcaggagaatcgcttcaacctggaagacggaggttacagtgagccgagaacgctccactgcacaccaatctgggcgagagagcgagactctgtctctaaaaaaaaaaaaaacaaaaaaaattctcaggcctaccttgtttgattgtaggtcagacctccattccagaaagtcctgccccatacccacacccagaaggaagaaatgcatgctcagaggggccaggaagaaatccagagagacaggccttgctgggtgtccccactccgtctattcacattcgatcattgccctttttgtccagtcatatcgctacacagctgtccatgtgtccttgaaactcagcataaaagtggacaattttccctgtatctctgggtccttgttctgaaggctcctgtgtacatgttaataaggtgtacacctttcctcctattcacctgcctcttgttggtgatttctagccaaccttcagagggtggtggggaagctttcccctggccgctgcaagcccctccgtgttcggggttccagttttcccatttgtgtgacggagggagactggctgccattcttccctttgctggtctgagcctgtgatcctgttgccctgtgggcctctggcactgtggacttgaagggaagggagtgggaagtgggcctggggtgacgtacccctgcgggggaagggaggctgctgcagggggctgggtgctgaaggcccagggtggagcagtgatgatcgcatgatcacctaatcgcagtggcccaggagtcaggagatcagaggtctatcccttcactagccacgtgctctctctgcacctcagattctgcgcctgtggaaggagatgagtcccagccccagatccttggctccagagaactcatgggctccctgcttgccaggattcagctctgcctagaggaaggaagtaaagtgggggtggggagggagttggaggtggatcgttgaagataggggtctcagagccctcaggggccatgggggtgtgtcagcgggggaggttgaaaggagccattgtgggaagcaggaagggggccctctggggtgggctaattataggccctggctcttccaaacaaagccagcggcctctgagtggccattctttgggggaagaaagaagactggagggccccattaaggtctttcacgctgggactttggaaggtggcttggaagttcgccttccaaggctgctcccttcctgcctccctccactcaccccagcccacatcccttaccccttcttgaacccctctggggaaccaggccctgccccccagagacagtctcacctggagtttaaactttttgaaaaccgtgggaggctgaatcagggaggcagccaggagtagagagaaccctgagaagggaggagggatctggtgctgccctgcggccctgggctcagtttcttcatctgtaaaatgggcttgccgtctagccctgacttgctgaaattcactgatgtttccagatttctacatagaactgaggccagactcagagatgcctgagcatcagggtttctgcctcctgtcctatttactaccctccaacactggtaccctccctcctcaccacctgcttgcccactgaggcaccaggttgcatctctgagtctaaatttgactcaaaagcccaaatggtctttgcttgtcacagatggactccaaatgaaatagccaaaagaactcttattcctttctgcataagtagaagctgggttgaatttcttcatcacttcattcattcatgcattcattcatttattcatccataatgctttaaccatttcccaggcacctatccctcgcccagcgtgggcacacaaacatgattcctgaaacaacattcagggcaatgaatgatgacttgtgtgggcaagtcatcatttgagacaggagaggaaaatgcaaaatgggatggaggagggagtcactaacccgggtcacaggggaggaggcttttagccagtctgcaggatgagtagggctgctgtcgggtggagctgggcagtttgggtagtggaaatcacaccagcaagggtagggaggtgagaaagggcagacctggcctggagcaaaagggaaccttccccaggacattatgttaagtgaaataagccatttgtgaaaagacaaatactgtaagattccaattctatgaagcactgagtattcaaattcacagagacggaaagtagaatggtggttgccaggagctggggggaggtggaagaagttgttgtttaatgggtgtagagtttcagttttgcaagatgaaaagagttctggagattggttgcacaacaatgtaaatttatttaacaccactgagctgcacatttcaaagtggttaggatggtacattttatgttatgtgtatttgactacaatttttttttaaaaagtaactgtacacacacaccaaaaaaaagtaccttccccagagataatgggagaggggaggcaagaaataggagtgggtgtggacattaggtggtggaggatcctaaaaccttgctaaggccaacagagccacctcagattctttgtagaaagttggagggaggttagccgggcgtggtggcgcatgcctgtaatcccggctactgaagaaggctgaggcaggagaatcgcttgaacccgggaggcagaggttgcagtgagccgagatctcgccactgcactccagcctgggcaacaagagcaaaactcgatctcaccaaaaaaaaaaaaaaagaaagaaagaaagaaagaaagaaaaaaagttggagggagggaaagaagggagagcaaggggtatgtgggaagtattgaagggactcgggataaaccggcgtgattctgagcgtgggccctgcttgcaggggatggggccaggatacgtgcacaaaggttggccctagggcagaagcaactggactcctatcttgtaacatttctgctggtcacttcaaatatgcaagggaagagagctgctattactgagtcactaagctccaagacctcagacctggcagaggtacaccaccgcctccagacccacactggttggccatgcccagccgctgaggcaaaggtttccaggtagtctctgccacctaccctctccccaaaatggccatactgtggtctttcccgacatgaattatagaatttcagactatcagagctgagagatgacttatctgccccactaccccaatcatacagatgggcacactgacacccaaacagaagggatctcctgaatttcacttacaagtcaggcgactagaactctttgtctcagcttctccctgggggatctgaagaaactgaattttaatcattgcagaggaagcctgctgtatacattgggacctgtagctgggctggccaataccactttttttttttttcccgagatggagtttcgctcttgttgccaggctggagtgcaatggtgcaatcttggctcactgcactccagcctgggtgacaaagtaagactccatctcaaaaaaaaaaaaggtaaactaagggcttgctccctgagaatagacactgtctcccttcccttgagactcccctacaccccaagtcaagaactcttgagaaagaataggcatatgaacaggctctcccagaatgggaagttctggataccacgtacccatgagctccccacaccagaatcttcttccttgtccctgctctaattttttccatagaacttaacatcttctagcatacattataatttacttattttccatatttagtgtttatttttgtctgtctctacccacctcccccactagaagataagcttcagagggctggagttattgtttggttcactgctggattccaaatgcctaaaatagtatctggcacacagtaggtgttcaagaaatatttgttgaaggaacaaatgctaaaaggaagggatcgatggaaaaaaacttccctgggtcaggcccagcttcctgccttgttacctggtttctcctcaaacaaacagaggtgggtggggagtgtccctgagcacccagcctgcaggctttcagactgggtccaggctgggctgtgggtgagagggtgcagtgctcagcctggcagttggtctctcagtggccatggcattcagggggcctgaaccctgggtctctgcatccctgctgagacagaggctgaaggccgaggagaagacgctggatctggagttcgaagttttgagcgtggggtttaatgaggcgggtagatacgccctgagactgtcagcagagaaccccctgcaggtgggctctggggctggggtgcagttgcaagtgaatgatggggaccccttccctgcctgctctgctatcactgatgtcattgagcagcaggagcctggccagagcctcaccctcaccaggagcaagtttatctttactttgcccaaaggtatgaagtaggggtggggtttgggggagagaaagaccctggaactcctgcctgagtccctttctgggaccccagagagcctcaggagaactgggagggtggggtcagagctccagactgcatcccaaagctctgccggtgtgaccttgggcaaattctgggcctttgtaacccgtgcctccttcagtgtggcatggggacactggtgcctgtcacgcaaggtcaggtgagaaggaaatagaagggcagatgagagatggctttgtaaatgtaaaagtgctgagcacacagtgggtttgggggccagtcctgagcagtggacattacaccgagtaatattatactcagccctgtgtgcctgtccctgagccccactagattgtgggtatgttggggtggacagaaatgaggggacctgggccctgccttctggaacttccagagcaggtggagaggaaggaactccaagcagagaaaagtaaagtgagctggaatgagaaggaaatccatgcctagactaaggccaccctggcaggctgcctggaggaggagggatgtgagggaacagggaaaccaagtcccagactttaaatggctataaatcaggggcaggctgaactcttccccagtctaggagtctatggtggtggcaggacctaggatcatcccacaggctaagccctcccttcctcacccctgcccggtgggcttggattgggcatcagcaaagggagggagccatgggtggggcctaggagggagtcgcctaccagggaaatcttagccaagactgcttggctttgactcaaagtctgggcagcccaggtttccccagggccctgcctgtcctcctagtcacctggcagatgcagagaaacctgagaccatctctgagccctgtgttccctcatccaggtttctgcaagaatgacgggcagcatgatgctcagctgcatgtggaggcactgaggctggacgaacccttgggacgggcagcccagcgggtgggtgaggccatcttccccatctacccgaggccagaccaaccccgcatgaacccaaaggctcaggatcacgaggacctgtaccgctactgtggcaacctggctctgctccgggctagcacggaccccacagcccgacactgtgggagcctggcctacagtgtggccttccacgtccaccggggccctcagcctccagtctcagacagccctcccagggctggccagccagaactgatgtcaccatgcccagagccccagctccccatactgcaggtgggtgcttccctggtcccagttcaggttctgggctcaccgggtacaagacccagcctccgtgataagccaggctaccccctgtcctgagctgagctgagcagagcagcagagctcccaaggctgccatgttcagtctgaggaacgtgcagtctgaggatggacatgggagtcccagttacaatgggcagacagaaaatggggcaaaggccacacagagcagggagccaaccaagtggggtttcttttgccctgtgggttagtgtcccctgagacccttcagttcccaacctcgttctcaccagtttttgtgggaggccccgagtgaccaggggacagaagcctcctctgtgtgcccaccctcaagcccatctagcatccaccctgaccaggaggggctcaaccccaacccaggacccaggtgagagagtctagtccttatccgaaatataggaggcttctcccctatgaccatgttctgtgaccagacagcatgtctagtaggcctcacgccagcacagatagaagctggtagagcaagtagtagcccatttgacaggtggagaaacaggcccaaggtatgcttgatgccatttaatgtcaacaacatttcctggaaaccttagtgtataatagtgcacagaatccaaaagtgacagcacctaagctcagggtgtcgcctggcttgaagacagttgggtatagtgagggtatcatctatggtcctgtagggcatgcctggcaggagagttctggtgagggattgtacatgtcagattttggtgactaggaacggcttcttggaagagggtttatttgaggtgaatcttcccattcattccttcatttacccttttatccattcattcatccatcagacatttgttaaatgctaactccgccgactgcctgccaagtgggtaagacttagggatagcaatactgggctttggggagggtattccaggaggagggaccatgatacactggctaagaggaagggagaggttccgctggcagtagaagatgagcagagattggagccagaagttgacaaccaaaggctcttggcccatctgcggtgcttctctccctgcagtgcattggtctggtgctgaagtggagcccaggtggtggactgtcaggctgggagagggcctggggatgggagaaagtggagggagtcgagggcaccaggaagagcagaggtggatgttcatttcaggaggcagtggggaacaccagaggggtttgtgcagggtttgtgcgggagaaagaccagatctgagctgtggtttaggccaagtgatagggcagcatgtaccaggataactacgaggatgaccaaggacgcagggacccagggaccagcttctcttgcccagtcactcagcctgttgacatggcccactatggcctctgtccattaattcattcatcagtcaatcaacacatacttttgaccacttcctgcacacccagctctgtgctgagtgctgatcttgtaaaataaaatgcatgtcacctgcattcctaggtgacattctgttcccttagactgcaagctccctgacttcagggcctggtgtcctacagtttgtcacaggactaggcacacaaaagctgtgaactcggaagaagctgtcccctgctctccaggtcccagagtgccctggccacctgagccacaggccacgtggacgatgctcttcaggctgcagttctgaatgtgtgcgagggaggggaaaggggactggcgagatggctgagtcgaactcggcagctctaatttctgttatttaaagccatcatctccccaccatgctccctcttaaagtgtcagatgtctgcttctgccaagacaagaaaatggctttcaagggagaggaaaatcgcttccctgggggagagtggggggagagtcagcaatcataaccctgacgacagggccaggaagcacaagggagcagacaatgaagacaggtccttcagagaatacaggggctgtttcagctccagataacttgctctagcagttcaggctaaggaaggcaggcacctttctggtgctgctacttggaggctcaaaggcacagctggaaggacagcagcaagagtgggctgtcagcgagcaatattcagatcaaagctacggatggatttctggctccagatgcaaatgtctaggctcaaagtcacctcttccaggaagccttcccagcattgattttatccctcccaagttatcctcagtcctgactgtgatcaggcatttcaacaattgaatctattcaattcagaacttggttgtaggctcacaagttgttctccagtttgtgtagtgtgtggcactggtttttttttttttttttttttttttttcaccagaactgatgatggtcatggggggcagtggagcaggggcaggagagcaggatgagcaggaatgcaataatcaagatgatccagaatgagaaggaagcggaagacaaggctcagtgtgagaccagggtcagagctcagcaaacttccacgactggctttgaatcagaatcattttgcttctcagccacggcccctgggttacacagccttaaatggccctgccaatgctggtcacagcattccctagtcctggagactcgggaactaaaacaatcaattcccctgagcaataaaattatggacagtgaacaccttcgcttctccagtccccaagcttcctgctctgtgtgggtggggaggtgatggtgggagggactgtcctccatgaatatttccagcatgcacaatcacagctccaagatagaggtcactccctgagcccttgacccaaggatggggatgctgggagcatgcaggcaggggctgcagagggaatttacccacctagagggctaactatttccaggttcctgccagccagagcagcagcccttcccagaggctcagggtgcttcctttctgggtagagctccactacactcgtcccaccccctcagcgctgcctcctgtcacctcttggcaggtttgagaccatagagctatgcctctccagctcccagagcctctccttccccggggtaagggggagttcatcagaccagatgagggtggcctgttcggtgctggacagagcaccccggggtgaggaaagcagcaaggtgcaacccaaagccggcaaaaaggccatcagatgtgactcggctggacatttttaggggaaaatgatgactcttggagggctggaaagggcgggggagaccacaacagctgtgggcctggggctgggctctcagaggccacaacgcttctggtacctcactgccctctccaagagatccctgaaagtctactgacagtctcccactggcatagctgttcaagagggaaactggaaattcccagagatataatttctggaaacgcaaattttaaggttccttgtttgtagctctgggagccatcctgggggctccctcgctagaaggccgggaactccctcccacacagctctgagctctggaaggagaaggaggggtgcactgctcctccctcccccagcatttacctcttcccaacaatcgcagttttgtttcatagaaacgatttcgtttcccaggagccttttaaatgacactttcaaggttgttttttttttctttttcttttctttttttttttaattccttccgtttaaaacacctttttttcccccaaggggaaaaaaaggagaagaaaagctaataaagcaatcaccaaacgccaagcacctggctctaagcctgtggattctgattgtgaatttggcacccactggctagggggctttcattaaggagaagtggaggggaaaggagagcggccacggagctgttgtgaacggctttcctagcgtcccctcggccacccctacccccatcccaccccactcccccgacccccgccgcctgcatgtctctggtcccagttctagttggagctccaggccggcgctctcccagccccaggcatcctcttgcctttaaggcccaagcactccgtcctcactccccccgcccccatggcctgcttttaaattcattatgccttttattgctcgcgattgcatacactatttctattgccctggagactggaatggttcaagcagggagaggcacatgatgtggatttcattaactttactctttactgcccgtttaatctcaggggtgcagcacgggggtgtgagtgggggctggcgtggctggggaactgggcacctcttcgttcatgccccatcccctcagtgctggacccttgggttagctggtttccctcatcttctgaagcctccccttctgccactccctctgctctcctggtgaggggagttgtcactggcccatttcacaggtggggaaagagaggctctagaaagcaatgcttgggctgctaccaacaaagtggtgggaggtggggaaggtgagaacaggttagatcaggactgccagcccctcccaggctgatgtcccagcccttgggtactggggttccccctcctcctcctttcctgcgcttcaccaaacacagaggactggaggccagtcagctcctccttgcaaatgaggcagttttatgggctttagaaaaacactccaattgttccctcaattaccctggagcggattgaatatattaatctctctcttaactcgagttagagactctgctgccacccctcccccagccaccagtgcccctctacaggcacgtgccagagattgactcccagcccccaccctctgggcctcaggcccgagcaggtcagccccgtccaggcagcatgcttctgctgaggctgtgcccaccgccagcatacacacacacacacacacacacacacacacacacacacacacgcaagcatgcacacacacacacacacacacagcagacagcagacagctgctttacatttctccatcaatttacattgattttctcctctgccactatttggaagagccttttccttgagtaaacacgatcatgggggctcccccttgagtagggggtgggaaggggactgcaggcagctcccccttctcctcctttgacaactgcctccagcttaaacacactctgccccaggcagctgagccccgttaaaagctacctgaggtttccctttgtagctcgattttcttttatttcaggggaacaaaggcactgtcatggcgttctcagagaatgctgtcacccacgcagggaggggtgcagaccggcaccatggcggagagagaggtggggcaggcaggtgctggccctggggaggctggggtggggggcacttccagcccccacttcacccctgcacctcccaccctgtcagggagagaggccaggggctaaatacatcgtgatcaccctgcaggcagcctgctggctccccttcctcctctgggtgcgttgaaacactctccattcatggggtccctgaaggagagcccagaggtcctgggcagcatggacgagactcaaaattgcacagtttgagggagtcccatatttgtgtccttgcccaagcctgtccctccacccctgtgcttccagatttccatgtcatctgtatatgcttttagggtcctaacagggtctgtgcctggaactcagcagagtagaggatgggagggatttgggattcaaccagcttagggtgagaggcaggtgcatggaagtcaggaggacctggatgctgattgggctctggcattgatttagcagcgtttgacctggtgcaggttatataacttccctcagcctccacttccacgtctgtaaaatgggagagagcaatttctgtgccctttattgctggcaagatgaaatgagctagtgtacagttagccttgccctgcagtaagtggttaataaattcctgctgttctagtaatgatttgggatgtctgtattgggcaaagaggatgtgtctgggccttggtttctgcacctagaaaataggattgctccttcttgcccagccagtctcccaagggaggggtgttaggagcttgtgagtctcactgtgtctgggcccagattccaggttgcagggtggagaaggccagcccagcctgggtgctagtctgggaagagcctccattagcagattgttgtaaccgaacacaccagatggccctgctgtcctccttcatctctgcctttcctcaccccagccaggggctgacgctgactcacacctcctggaggcgtgtgtgtgtgtgtgtgtgtgtgtgtgtgtgtgtgtgtgacagagaatgatgtggggggagatggagaggaaggggttgcctgcctctgatgtcttcccaaccagaccagccccagccccagtgagcagctgatgggctccagggaagggaaatgtggtggccttctcatctccagaaattatcttcacagtgaaggaagcgggcataatgtgcaggaaggcccagtgacgatggccttttcttaaccttacacccatggaaagcggatgtgcccccaactcctgaacaccctccacccacccccaactccatccaccctcatggatgctgcgacacacaaggacacatacacatgcacacatacgtgaatatacacagacctccagcatcctcaacatgcagagacccccctaccctccacctccatctcaatgatagattcaccccgagacaccaatggacatgcctgggaagcgcacatcctcccacacacagactcgcacctccctggatctcctgcgtctccctggttccatctctgtacaacaaccccaagtgcagcaccaggtgagaaagggacttggggacatggcatatgtgatatatgaggtgagattaaaaccctgcgtgaaacccatctttaatatacctctgacagtggattagggtggggagcagcagggtaggaaggctgacagcacccagtgagcccaccctggccctggtgaggggtagggctgttaggccagcccagccacccccagcctgggtcctgggctagttctgcagagtcctggggtcaggagcagctgaggccagcaggtaccaggccccgtcccagggaagatggagaatgcgtgtgggacgtccttcctccacctggacctgacagcctgccctgggctccaaaggtccaacctccctcagcctgaggtgatgatcattcattcattcattcattcactttcccaagcagtaaactgggttgctgtatgtccagccttcagggagctgccaggctgggcagggagaggaaataggaggagttgaggaacaatcactttccaagccgattgtggaggaagtggtgggcatgagctgggtggtcgtcaaggactcagtctgttggaggaagacagttctgctggcagtcagaagacttagtttagaacctcatttcccagttgcatatgagcagttatgacttggagcaggtcccttacctccctgggcctcaaattcctcatctgtacgatggacagagtcctatctactaacaaggaagttatgaggctcaagtgaggaagagattgggaaattgcgtggtgctaacaacccatcccacaaatgtcagggagacagttgcaccctgcctctatggtggggtgggattccagcagagagtggggagaatggttttcaagggtgagccaggcacggtggctctcgcctgtaatcccagcactttgggaggtcaaggcaggcagatcacaaggtcaagagttccagaccagcctgaccaacatggtgaaaccccgtctctactgaaaaatacaaaaattagcccgtcgtggtggcatgtgcctgtagtcccagctactcgggaggctgaggcaggagaatcgcttgaacctgggaggcagaggttgcggtgagccaagatcacaccactgcactctagcttgggcaatagagcgagactccatctcaaaaaaaaaaaaaaaaggtggaggacagtgtgagcaaaggcgtggaggtattcgagggacaagcaagtaggggggaaacaggaggtggagagagctggttcgtaggatggaggtggtagggagttgcaggggatgccaatggaatgcacaggaggtgccatctctgagtacttcgagctctgtactatcccctctgtaccagaggctgctctgggccaggctggcagaggtggaacttatatcacatttggcagcctgcagagcccattggagcatcatactggtcttgggaggtaggcagggtaaccttgatagagcccattttctgaagcaagaaactgagcccctagaggagatagacagcttgcccaaggcagtcagtagcaaggtcaagctggaatccagatcaccatatattttggtctttctgagccagtagtcagcacacaggtgggaatgactaacagcatcctttcccagggagactcacactttgcaagctgttccttagcccatttgcaagctgttcctcagcccatgcagcactaatgctgggctttctgggcacgtgaaaggatcacggggaagcactttgagggaggagatttcttcctggtggccccaaatcacaccgagtcctgccaagacaggttacttggtattacgctggccccaacaatgagtgctcatttattgcactgaatggtttgggagcaaggctggggatggagttggggctgtcagtggctcagagtcccagagcaaactccctgaaccactgctgttggctaatgacacttagaaaaaagtgttgcataagtagccctggcccataattaaggcctttccaccctgtctgagaagtgacagtgagttacagtcaagaaggttcagtagacaaactttggactcaggcttgagttcaggttcctggtctgccttgcaataggtgttcctgagcaagtcattttacttctctgactattttctcatctgtaaaagggggataatgatgtctacttggcaatgtggttgtgacaattaaataacattctagcctcagtgcagtccaagaggtctcggaggagagggggttccaaagacttccagaacacaggcagcctggaagccaccctgattcacagccttggaggcgggggtggggggatgggccacccatctccaccccattacctctgcagagaggtgttactgattcctccatgcaggaagcatttgttgaaccctgattctatgccaggcctggcctctcagagctcttggaaagacaggagcaccacagggagagcactgcagtccctgggtatagaaggggaagcagctggacccaccttgtggaggctgaaggcgcagtagaggggtggaaagtatttgatcagggcagaaaggcagagaggagagtagtgatgggctctggtttcaatccttctctgccccctccagctgtgggacttcacctctctgcacctcctttcctcatctgtaaaatgaggatgataacaacactcgccagcaggactgttgaattcaatgtgtagtaaatttaaagactatagccaatgctcacaaaacgctggccattctcgtgacgccgagtgaatggcagcttgccaggtaggcaagggttggacggaaaagcttgaataaagacccaggggctggagagactgtggcttctttggggaacttggaagctctctggggagccagtgattgtgggagcagttgaggggctgggccatggggcccccactccttaccccacccggaagcctggtcttgagtcactattgggccagtggagctcacggatgggcatgggagcgaggaggttgtagacattattttaatcttcctcttaaagcataattgctttttgtcggcgggtgttcctggagacgcctccccgtgggattgttttccaggctcctctcttccaggagacaggcaggggccgggccagctccacgctgcattaatacgctgcaaatgcgatttcatggcctcaaatgagattagggccagaggctctgctctctggtagagatggcgggtggtgtgagcgaagggtggcgggcgctgagcagggaatctgagagggagggagcccgggctgacttggcctgagtgagcagtttcctgtaattggagcccctcggacttgctggcgcatcccggctgcagagccaaccctgaggccctgtccagtgggcgaggtacccaaggctgtcacccccacccccaggctccccacaagcacctcagtaaggagagtgctgtgattaaggccacagtctctgcagctaggtggcctaagtctgaagcttgcctccattttcttatctttaaaatggggacaacaagctgggggcggtggctcacgtctgtaatcccagcactttgggagaccgaggcaggcagaacacttgaggtcaggagttcgagaccagcctggccaacatggtgaaacccagtctctactaaaaatacaaaaattagccaggcgtaatggcaggcacctgtaatcccagctacttgggaggccaaggcgggggaatcgcttgaacttgggaagcggaggttgcagtgagccaagatcccaccactgcactccagcctgggtgacaattgagacaccgtctcaaaaaaatagaaataaaaataaaataaagtggggacaatagtagcacctacctcatatgtcattgtgaggactgagttaacgtatgtaaaacacacagaatattgctcactgttagctattattatgaggttcctatacacacccgtgcatgccctagcaaggcgagaaggcactgggggcttggactgtggagagggagggtttgggggagcaggcatcactgtcccaggctgaagtagcaggaaggaggaagatacttgacacaaatgtcatccctcactcatacatcaagcacccatctggtgccaattctgcaccaggcaacatgctgggccctggggacatggtccccgcccttggggaagatagatcctgtcccagagaagcccacagtggatcatgagccagggcaggggaggcccatgggctgtggatctgatgtccctgaggtcgggtgggggaaggttgcagcgaatctttgtgcaggttgtgcacaattcaattgtgtcttgaattattcaggctggctggggaagagggatggcccaggcacatggaacagtaaaggtgaaggcctgaaggctggagagaccactgctccttcacagggaccacaggcatgtcatgagtgtgggtgtgagggcctggggtgagcagaccaggaggctggcaggggtcccctgcagtgatggggtcctactaaggtgttttttgaagcagaggagggccttggtcagatttggaggttggaagagttggggtgaggggacacaggtttgctggaaacaggttgagcctattgtccccaccccaaggcctctctgccctctgagtagaccccccacccaaccttggcagagcactgcttctgcccctcctgatggaaggaaatggcaggcagcttcattgctcactcctttattcagtcccttgttacacgagttattgatttttcaaaagaaaaatgcccaaaagcaacgttgcatctttagcaaagtgatttatgacatgatggagggagctgggccgccccaaatgagagctgtggttgccaaatgccaagaggaatccttcaacatggcaatccataaacgtgcctgctaagcaaatggaagccgcgttgtccaacaacgagaacatcacactctactcgtcacccccaagtctcctgttgccaaagcttgggccagaggtgctccatcttggcatacattggtgtaagtgtgagggaaagctcactgtggggctgcctaccatgtgaaggcatccattctcttatctaatcctcgccaccaccctgcacagagcctgctggtagacctgctctgcagatgaggaatgggaggctctgagggatcagggggtttgcccaaaccctcactccggtgcctggcagaaccagggttagagccaggcctgacagattccaagtcatcatgctttttttctttgctgccaaatctttttgcctatttggtggtgaccagagcccacaagaactaggtgcagcaagagagggtcaggactatcacaaagtctgctctgagacaaaacacagatacacaagggtttagcccagtagccgtttactgagctgatagaagtcacctctgcacggcaagcaaccagggaaaggtcagaagggcaggcccccagagcctccaggatcccaccctggcccactcagcaagcagaccctaaagacagcagcctgcatctaacaggcttagctggaaatgggagcgagctacattagtgatagagtcacagtctggggtgttatgaccccaccagccctcataatcaaacagccctgcagcccctctgtgctggatagaagtgatgtcctccaggccccctggctctgcccttgcttatgggggccggccagccatgcccagctgagcctctggggcacaccacctcaatctcctttgacaccagtgtctgcaggctgcactgccgcagagccattggtctggcctcattcaaaaggccaggtgttttcatctctggtcttgaatttttcatgctgccccagtttctggagagaggaaaggagagctgcgactcctttcccagagtgaaaggaaaaggcagcgtggtttggtggtaatgatctcggactttggagccagcaggcctggagtcaaatcccagctgtgccgcctcaaagccgtgtgaccttgggcaagtccattccctcagagcatttgtgtcctcaccttaaaaatggactctggccaggtgcggtggttcacgcctgtaatcccagcaatttgggaggctgaggcgggtggatcacttgaggtcaggagttcgagaccagcctgatcaacatgggaaaccttgtctctactgaaaatacaaaaaattagccgggcgtggtggcatgcctataatcccagctattggggaggctgaggcaggagaatcacttgaacccaggaggcggaggttgcagttagctgagattatgccactgcactccagcctgggagacagaatgagaccctgtctcaaaaagaaaaaagaaaagactcacagcaataactccgggagcgtaaatgtgaggatgaaatgacatggcgcaggtcaactcttggcatgagacctggcacacagtaagtgctcactaaaagttgggggtgtgaaggggctggtggtgacgatgacagcagtaataccaggacatcaggcggggcgagagattgggccatggagaggggctcacacagcaggtatatcagccagggtcctgccaggaaaaagaaggcattcaaattcaggagcttgaggggagtttaataaagggactatttacaatactgagggtggggtttaggaaaaacaagagggagactacagcgccttgggggctggaacctgtgagaagccttccctgactcctaggtttgaagagacaagagggaacaatgaccataacctggaaaggcacttgtatggagagagttggctgccaggcagagtccaggaaagtgtgcctctctcccagagcccccacacttggccttctcttttcctgactcttgccccttcccccatatctccctatcactctttctccattgcttttgggcagctgagttggatgaggtgggaaatgtaggcagtgtgattttatagcaaatggcagctcatagctgtgtgatcttgggcaaaatgttaaccctctctgagctttggttcccgtccttatccagtgggagaatcaggactgctctgagggccgaatgagaccatgaaggtaaagctcttaacgcggacagtgaagtcccccagacgtgcttgcttttttccctgctaaccaactttggacttggtgagttctcccccactggaatgggccagagaagtgagaaatggccatggggtgaagtctgcatgtctccaccagcgcttgagccttcacacccacccagaccagatatcatcccaggcccacttgccctcttctctatcccctctctgttcccggcttccaggcccacgcccatggccgcacctttctcaggtagcccttcaacagaaatgtcccctttcctacctaaatccaatgtgttctcagggtcctgctcaaggcccttcatcccggaggccttcctcgacccctttatctcctgctctgaacgtgtgtgcagtcctcctggtccacagcaacacctcctgtgtgtgtgctgcttctggagctgcaagttcactcctggtatgtaagaaacatgaggcaggggcgtgggaccagggcaagtccctgcccctcctttgattattttgactgttgtctactgaagcatttcctttagagggtctctatgctcccactgccacgcaccctcggccccagtggtgtagacagcaggtcttcacttgttggctgaaggatggaaaactctgagagggctccccgctctgaatccaccggctgctggccaggaccttcgagggctgctctgacctcatataagttatgaggctcagcctcaggagtttctgcagagagattggagagctggctttgccctgtgcttccacaagggctctaactgggccccttgaggccagttcacaccccaccccttaaggtgctgagctgggtttaaactgaagtcactgccacccagagctgcactagagagaacttgccaagcccaaggttggttagcagggaaaagcgagcatgcctggagctcataaccatccgtgttaagagctttacctgcgtggtctcattcagcccacagagcagccctgattgcctcactgaataaggatgggaaccaaagctcagaaagggttaacattttgcccaagatcacacagctttgagctgccatttgctacaaaatcacactgcctacatttcccacctcatccaactcagctgcccaaatgtgggggtgggacaggactcacagggaaggaaaggccaagtcaggaggcgggggcgtctctggaagacagacacactcccctgagtctcattgcatgggtagtttgtcctcacaggctgcttcctcagactccaggccccagacatggcatgaggaagcagggctgactatgagccacatctgtctacccagattcttcttgctgtccagccagcaagatccctccttccccaagagccagccccagatccagcctcaggggcttgcccctcccagaactatgggctctctagtggccacatttaacccctggcccctcctagtgatatagctccaagtgctgtctcctgtgggtagggggtgggcacagttatctattagctgtgagattaatcattccctgctctccctcaccctggaatctccctgaatcatcacagcttggggctggcccctggacatttgaggagcaagcccacttctctgggctggggatatagagctcaccttgctggaggaaggggaggagaaggtagagcagctgggctcatgctgctaaggccttctcacaggcaaggaggaagcagctctcgggggaggttaggacaggcacaggagctggtgtctcaggggtccttggtctggggaggtgaacaaccagcaagtcaggaggtagaagggccctactggtggctgctgagtgcacagggcccacttgcaccctggagccagacggcctggaaccagtgcccaatcgcattatcttcccaggcaggaagatggcaggggcgtggctgcagaggcagaaagctcagatgccaaggagggtagctgggtgagagccccgagccccggggactgaggcagagctgcagggcagggcaaggaccacagtgaggcaggcaaggtggccagggcacaaaatgtgaggctctgtgtcgggagcggagcgctcgcacagccctgagaatgagtgcttcattaaagtttgcttcctaggcacctggcttgcatcttcagtcctgctgctagagaaggagcaatggctccccaccccctgaacctgctgccctagcctcctagactaagcaggcctgagaggttgggggagatgcgctctagagagactgggggagcagccactgagacctttccacacatacacactgtgctgggacatgttggcccacaagggagataaagcacagtgctcacagccaggccattcctggtcaggcccccagccccagagccccaggagtaccactcttggcaggcctagacggggagaaaattaggagtggggttcctgactaccatcccccaccagtgtctgggtgaccttggctggtcctttcagttctaatcaaaagcaaagcctcagtttttctgtctctaaactggggagaaccacatccttgctgctgctctctctggagtgggggtagagagggaggctgggaggcctctgcaaagccggagtctcctgcctcctggctgccaggctggtcctgctcttcggccagattaaaagaatctccaacttggggcccaaaataggtagaaatgaggcaggccacaggggccccccaaacacttctgaacactgcccagtaccccaaatccctcctcttctagcccaggatttctgatcattcttcgaagcccagttcagacctcacctctctatagagcaaccccccaccccaggccaaggactagtctctcttcattctgccatctcacctcaccaaaagcacttaggaccctgcctggcgtgcagcaaatgctctttgtctttgtaataatttcttgcagtgctcagaactgaaccataatctttggttcgtactctagtgccatcactgacccatcatggctttctttaattgtttaattataatttattttcaataatgtaatgaatttccattaactgaccacccaatctaaaaacccaaaagtttagaatgtatgctcttaccctcttctctccccgatcttcccacccaccctccaagaagaaaccatcctcttgaagtttgtgtttattattatcaaataaatggaagactataggtacccaaagaggcacgatggctggtagattcttcaacagaagtagctgttttaccgatcaagctgcaacactcttgagagcagtgtctgcttcctcttttgctgcagcttgagcagcatggggctggccacaccacagggttggtggagactacttgaggcaccaagagcaggaagggtggggcctgagtgccaggcggcaggtggaacacagctccaggaatagggaaaagggcttcgcgttctagctcactgcacctggacaggtgcctgtgtgacttcggccctgccctgtgacatcacacagtgttgcccaggtgacccagctaggtggaagagcttattgttttccaggcctgggcagagacagggcccccctgccccatctctccaccgtcctaggtgtgccaagagtcaattgcctcattgctgaccctgtccagctggccatggccctcaacccccaaggcccttccacccacagaccatctcgctgctgagagatccaggacctgctcccacctggccaccctccccctccccccacatccaggccccagggctggtgtgtggcacccctgagaccacattgacctccatactgtctactacccataaggactccaagacgcccaggccagctgtctgggcaggactgattcctgatcacccactgataccaagtactcatccccaagattgttaaacaaggccagacactcctggcctcaagaggatgggactgaaaaacaaaaaggtaaggccaggggcatgggccatgcacctgcatgaatccgtccctccttcaaagtccttccttcaaagttttgtttgctccttaatcatgacaaaagcttcccttccctgggtctcagttttcacagctgtgaaatggggagtgaggtggtctctgtggctctcccaggttagctgccctatactcttgggccacacgggaactggaatgcagtgtacttgcaggtgttgtcaatgctgaccacccttacctggttgtttctgcactcttattgctggggtcacacagtctgagagcccactgagatggttcattacccctgtccaagatctcccaggagattcccaggctgctggcttggcagccctgatgcccccattgcccccatgctctccaatccctggccctgattttctggggcctaggcccctgtcctggaacacagatgcttgggtctctgaagagaagggatttttgtgtgttttgttgatcaccgtatccccagcactcagaacagtgcctggcacatagtgggtgcttaataaaaagctgtggcccagcagcagggctctgtcaggaagggactagaatctcagtgtgatgagatgtaaacagttgaatgtaagggaccccttaccttcctctcactagcaaggctgagcccctgccctagatggtgttaacccacagggatagcagaaggagctgagaccaaaggcacacagatacttgcaaatgggggataccctctttgtagttacactcaggttgaataagccaaatagctgggggtgcccaggccctagtgtgatttccacttcattactcttgattttgatgtctctggttcctgatgttctctgcccacagctgccccccaccccctgcagactctgccctccccattaagcctctttctgtaatgccacacactcagaaccggtcaccaggttgacctggcaccctaagctgccagctggtccccacctgccccacagagctggatttggggatctggggagtgtgcgtgggagtcctgaggaggagccaaggttgctttgattagtagctttgagaagcgcttttgatagctgggtagaatcgcctataaggatgctcatcatggccgggggtggtggctcacgcctgtaatcccagcacttggcgaggccgaggcaggagtttgagaccagcctggccaacatggtgaaaccccatctctactaaaaatacaaaaattagctgggtgtgttggtgcacgtctgtaatcccagttactcaggatgctgaggcaggagaatcgcttgaacctgggaggcagatgttgcagtgagccgagatcacgccactgccctccagcctgggcaacagtgtgagattctgcctcaaaaataaaaggacgttggccaggcctggtgtctcactcctgtaatcccagcactttgggaggccaaggcagaagttcgagaccagtctggccaacatggtgaaaccccgtctgtactaaaaatacaaaaattaaccaggcgtggtagcgggcacctgtaatcccagctactcgggaggctgagacaggagaattgcttgaacccaggaggcggaggttgcagtgagccgagatagcaccacagcactccagcctgagcaacaaagagcaaaactccatctcaaaaaaaaaaaaaaaaaggatgctcatcatgtatatataatacatatttgtgtttcttcttttgtgaatccccagttcatgttttttaaattggataatgtttataggtttcagtgctctttgtatactagggatattaatccttttttaaatatgcagcaaacattttctcctttttttcttttctttgtattgcagggcattttggaccattatagaagttagtatagatttttaaaatgtaatcaaacctatccctttttaatgatttctgacttttgtgtcatcttttggaatgcttctctgctccaaagaacataattcctcttgctgccaccaatggatactcagattatgagttcaggggggcatccactgtggagcagagaagggatccacatccaaggaagcatggttagagcacagcagagacagcaagagtgtggggtcagacagacccagcttccagttccagccctggcctcactagctaagctgtgtgctttcatacaagaggtttactttctctgagtgtgcttcctcacctgtgaaagagctttcccctggccgccataactctcaggcaagtttagatgttgaaactagaaggaacatgggggaccatttttaactgaaagtccttgtgaaactgctgggaaatagccccactgcagtcaagtaacttgcccaaatgacagatccgggcagccaggcaccctgcctcccagcccagccccgctccagctagtgtgacttttcagacacacggcccttctagagggcagaactgggctcagctcctcaggcctcccaggctgctggaggatagggaggagtgggtggaagagtttgtctccttccatctctctccccaccagaaccaagttaagcaccccccaacccacccgcgggagctgaattcaaggaccattaactccctgttgttcctacctcctcctctcaccctagcccttccccccagcacatggatccaaaaatgccctaagtgatgggcagtcctagttcccctgcaacatctgctggctaatcctggcctattgagggcaaggctgcctgtctgtttggataagggcactggagttagcagcttccaatcttgccaggcccagtggagtagctgagagtgctgagctttggaatcaggcttgcttcggtgctcacagcccagcctctcatccactggctgtgtggccttgggcaggtaaactggccaaacccctgcctggaaaagctgcctgctgatctctgcaccctagcagtgttgggtgggttaagtgagagggagcctgagaagctgatggtgagcatccagctttgctcccagccaagaggaggcatgaattccctccccagggctcaccacacccctacagatgagtttgtgcaaactgagagttacggggggggtaccccatcacccccagttccctaccactcatgtaacccagtatatgcattttctgttccctcatcaatcctctagtgcaggccaggggtaacagatgggtcgaggacattggttctgatgcaggacatctctgagggaagcctgcagattcccatccagacatgggaataaaaaagggatagcaggaggttagcagccctggcccaccatcccccttctggccttacccttggccccaagcctccctggccctgggcccagcctgcccagcgggcacatgcctgcaagcctcaccaggaggcgccagcctggcagttggcctcatgcccagaactgaaacacaatagttctcgccaaacttcctgcaagctttattcccagaagggaaggctgtccccgaggggaggtgcaggggagatagaggaggagccggtgtgactcctggccaggtctgcagatgcctagttgggctctggggctgccagggagccaatgagagcccctggacaatggtcttactcctgggccctccctttcatggccctagggagctcatgagaggccctgtgccctcacagcaaggtgaatccatctaggaacatgaatcacccctcccagcctcactgcaggaacttcaggcacagtaaccactggaaaggctgaatcacaaactattccagacattcccattggccaggtgggaaaatcaaggctcagggaggtggtacagagaggtagggccagagctgagctgaaacctaggtcttttttttgttgttgttgttggagtctcactctatcacccaggctggagtaccatcttggctcactgcaacctccgcctcctaggttcaagcaattcttctgcctcagcctcccgaatagctgggattacagcctcatgccaccgcacctggctgatttttgtatttttagtagagatggggtttcaccatgttggcccggctggtctcgatctcccagcctccagtgatttgcccgcctcggcctcccaaagtgctgggattacaggcgtgagccaccacacccggccaagttgaaacctaggtctttttgccctgaggctgccagccttactcctgtgccactaaaccaggagagcaaggctgctggggagtgggggggtcatggtggcctgcatgagggtggatatgggaggaagctgcctacccaggagggcagggaacagcactctggctgctcctcctccttcacctccaggcaggggcatcttcccctcccctcattctcccctgacaggagcatgggggagagaaggaggggcaaccctcatcaacacctctgtagatggtgacaggccctgctgggtcctggaagagggtgggggtggcctcctcagtcagaggaaggagaggggggcctctctgcaggactggcacttctgatctggggggcatgtattctcacctcctaattagccatcttgctaggcaaggaccacagcctgcaccaggcaagccaagggaagtaggggagcaaggcacagggatgacagttctggagtgacacccagggtggagcagaggaaacagctagggcagaggcggggaggcaggagggagcttggtaggtgtgagaaacagccaggaggccagtgtggctggagcggagtgacccacagggcccgtgggacaagatgaggtcagttttctgggccagctcctggagggccccacgggccattgcaaggctctgagagaagcagcaagctacttcagggttctgagcagaggagagagagggtctgggtccaatctgtaaaggctcactctggcgattggatggggtggacggagagtcggagaggaaacagaactccatcagaggcgagtcgggacatacaggtgtctgggacctgagtgctgacctgaggatgctgagaagggtcagagtccagatatagtttgaaggtggagctgacaggatctgctgaagaactggataagggatgtagaggaagagagggaagaatcaggaaggactccaagatgtggggcttgaacaactagaacaatggcatcgccattaactcattaacgagttggggcagacagcaggaggaggggtttgaaggggagtccagagttcgttagctttgagaggccagtagacccccaaggggagctgttgagggggtgtgtggctccgattggtgggcaccccacgctaccgtgagaaatggatgaaataacgttcctaaaactcctcggggcagagcagagcctcaggcactgtgcccttttctttctgtctgcctgaggcttccaggagccaaggctcaaggtaggagcagagcagcttccagataggtcggtccaagtcctcatctccccactggggaaactgactctcagaacatggctggctttggggcccagcatggtgagaggcagagctggtttaaacctacctctcctgacactcagggctcctcaggagccggccattctgagccaaggacccagcctgccgaggctgccaccaaaaccagagcccgtccagggcccaggtccttgctcctgtctgggcctcaatttcctctctatgtaataggacattgttctcaaccccacccaaccagggcctgccctggaatgcagggtctgacaggctgagctttccagagatgaggaacagcctgccagtggcccctcagggccctgcctccaccctgaggaggtccattgctcctctcccagagccaggagtgcccctctatggcccctcatatcagctggagggacaaagggtaggcaagacctcctaccacgggaggcctatcaagggttaatctgtgtcagattaactggaagtggtgagtcagccagccggccagtggaggaccagggccagggaggacaaggacacccctgagccacagcagcctcatggccacacccctccccaccccaccgcgtttatatgcccagctctgccgtcttctctgagtccccactgcctccccagtcaaactgagccacctctgggccttggaaagctctgccccttcccgcttgctgccttcgctccagtgttctgctcctggcctgtcctccctgactccactcctgcaccttctcccaaccctttaaggcctcctcctccctgctgtcttccctgaccgcctcagccggccagggctttgtcttctctcagcagctctcgttaagatggtcctttgggccatgaatccacaagttactaagctgctgagtccctgcttggggcaactggtgtaggaagccccctgcatgggcaggcacctcttcctccctagtccgcaagtttcctgggtagaagacaggtggggcatctgggacagacacatgcattcacctccacgtaatgcactgaatgcccccatgaacgtggagaagctttgtcagctgtaaagtgctgtgcacaggagggacctgaggtgatgggtgagctgaggtgaggttacaagatagactgaagaaggtggcccattgttaggactgcaaaagcaggtgggatttaggaattacagacgaggacacctgcgaaagctaaggcttagaagtgggaccagacttgaaaggtgaggtggcctgtctcatcctgcaggaagggtaggatccaggactagaggagaggcactgagagagacgtgggatggggacagaagtagggagaaaatggggccaaggcgactgccttgcagagtgggcggaagggtgacagagggaggcaggcacttgacggaagctgtgagtggctagtgctagagggtggcagtgaagggaggtgccgcagcagaggaggccactcagggccaggtgcagtaactcatgcctataatcccagcactctgggaggccgaggcaggcagatcacctgaggtcaggagtttgagaccatggggaaatcccgtctctactaaaaatacaaaaattagttggatgtggtggcacatgcctgtaatcccagctactgtggaggctgaggcaggagaattgcttgaacctgggaggtagaggctgcagtgagccaagatggcaccactgcactccagcctgggcaacagagcaagactctgtctcaaaaaaaaaaaaaaacactcagccctggctctccccacagaacactgaagacccagaggagcccctgatcgcctcccagagcacggaacctgagatcggtcacctgtctccctctaagaaggagaccatcatggtcaccctccatggggctaccaacctgcctgcctgcaaggatggctccgagccgtggccctatgtggtggtgtaagtagctgcgtgagagtgggggcaggggatgggttgggctgtgagcagaaaccaggggacagctatttggaatactagcacccaaaggcccaggactgggactgtcatacccagaggggaggagctgctgtgggcactacctggcatctccgctgctgcatgggaagctgctcaccagggctggggaagacagggtgccaacggatccagagagtcacccctccccaccccacaccagtggggcagggattggtcacagctcagctccagtggggcaggttccttgtatgcaaaagtctgggctgggctcatgggcatgatggtcagattggggaaggggaagatttgggacctgcctctcctgacttctgggtgccccaccccaccatacccagccctggggtagggtcctcataaccaccctcccctcctcccctccttctccagtcacttctattatggggactcccctagttctgggcctttaatgcaccccacacaccccctccagccagctgctgtcagggtacacacttccccagcctggcaccaaggcctgccacgccacgtctatgcccacctcacgggtctcacttcttccagaaaggcgccaaggggcaacacaatctccatccagccaaccttcgctggggacactgaatatttgctcaatctttattataaagcaccctccaaggagcatgtcacccctagaccttctatagacagacggcgggagccttggtggcctcccaccaagccaccctatacttcccctcccccaccaatactggcaccattcagttcctgccaagagtctgttgcccacatttccttttggggagtgcctgccccagcccactcaccaatgcctgctgaaatcctgccttcaaagcctcctcctccaggcagccaccagagttgagctctccctcttctggagctccacagcagtggtgaccctggtctgaagcactttatatcaacatggtttatgcactcctctggggctccctgaggacggatctcctcctccatttccctcaacaatgcatccaacataggcctgagcccaaacttaggagccaaggagtgactgaggccaacacctggttactatgataagtccctgcccccccagggcccccactgtgaaaggggggtagaagctgtgccgagagcaacaggtgaaacacttgccttaaaagccccatttgtgccagcccagctcctcggccatccctcccccaactccatttccgtggtgagggaagcacaggtggtgggagcaggcttggcagggaggctggtttctagcggggagctcgccttctccgctcagctatttccataaaccaattatcgccgatcatctcgggagattgaggccctgactgtcaccaatccggcctgggcggcggggcggggagctgggtggctgtgtggctcctaggcaggcaccgcgacccgcgccatcacccggttgccatgggaacgcgcggcaggagcctaggcgacacgagcctgggtgggggttcggagagccgggcacaccccgagtcctcctgcaccctccctgtggctgcggcacgtggggcgggagggtggggacagagaacgcggggaggggggaggggaaagcacttcgctgcacccttctccagctgggagcagcgcccgggccaggctgcagcctgcgtcccagggctccagacaggcgaagctgccaccagctcgaggtggtgctaatgagatgcaaatgatgggagaaggaagggcttctgagaatgtgaaggccgagctgtcaggacctgaagggggctttcagtgctcacccccagccccaggcagaaaccccagagggaggatccagaccctcagaggccatagaacctggaaagaatttatatccctgcacatctgattacaaataaacaagtaacaaagcacacaataggcataagaaagttcatgaaagttttcgttttgttcatgatgaatatttcaatgctttttaaaaatatgtatttgtgaagacttcaatgtaagacctgcaactgtaacacccctagaagaaaacacaggggaaaggctcctttacattggtcttggcaattaatcttcggatatgacaccggaagtacaggcaacagaatcaaaaataagtgagactgcatcaaactgaaaagcttctgcgcagcaaagggaataatccacaaaacaaaaaggcagcctatggtatgggagaaaatatttgcaaaacatgtatcggataaggagttaatatccaaaatatatgagtaactcatacaactcaatagcaaaaagacaagtaacccaatttaaaaaatgagaaaaagacccgaatagacatttttccaacaaagaaatacaaatggccaacaggcacatgaaaaggtgcacatcgctaatcatcagggaagtgcaaatcaaagccacaaggagatagcacctcacacctgttaggatggctgttctcaaaaacacaagagataagtgttggtgcgggtgtggagaaaagagaacgcttgtacactgttggtgggaatacgcagtaaaatggtgcagccattatggagcacagcacggaggttcctcaagaaattgaaaataaaactaccatatgatcccgcaatctcactactgggtatatatccaaaggaaacaaaatcagtattttgaaaagatatcgggccgggcgcagtggctcacgcctgtaatcccagcactttgcggggccgaggtgggcggatcacagggtcaggagttcaagaccaccctggccaatatggtgaaaccccatctctactaaaaatacaaaaattagccgagcgtggtagcaggcacctgtaatcctagctactaggaaggctgaggcaggagaatttcttgaacctgggaggcagaggttgcagtgagccaagattgcgccactgcactccagcctgggcaacagagcgagactcccatctcaaaaaaaaaaagtaaaagaaaaagaaaagaaaagatatctgggcctggtgcagtggctcatgcctgtaatcccagaactttggaggctgaggcaggtggatcatctgaggtcaagagtacccctatattcattgcagaattattcacaatagccaagatataggatcaacctaagtgtttgttgatgaatgaatggataaagaaaaaatgtcatatatatatatatacacacacacacacacacacacacacgtcatatacatatatttgtatatacttgtgtcatatatacacacacaattatatattgtatacatatatatccacatatagacaacatatacacaatgtaatattattcagccataaaagggaggacattctgccatttgcgataatgcagatgagcctggaggacgttatgctagatgaaataagctagacacagaaagacaaatactgcataatcccacttaatggaatctaagataaactcatagatgcagagagtagaatggtggctgtcaggggctggggatgagggaaatgaggaaatgttggccaaaggatacaaactctcagttttgggatgagtaattctggggatttaatatgcagcaggtgactctagttaatgatactatattgtggctgggcacggtggctcatgcctgtaatcccagcattttgggaggccaagacaggtggatcacctgaggtcaggagtttgagaccagcctggccaacatagtgaaaccccatctctattaaaaatacaaaaactagcttggcgtggtggtgggcacatgtaatcccagctacttgggaggctgaggcaggagaatcacttgaatctgggaggtggaggttgcgctgagccgagactgtgccagtgcactccagcctgggcgacagagtgagactccgtctaaaaaaaaaaagatattatattatgtatttgaaatgtgctaagagtagattttaagtgttttcaccacatacacgaaaggtaactgtgaggtgatagatgtgttaactaacttgatcatgatgatcactgcggaaagtatatgtgtatcaaatcatcactgtgtacattttaaatacatctaaattttattttttatttgtcaattatgcctcaataaaacagcgaaaatatgtatatatattatatatattatatataagtttacattctttccaagcattttttctcatctttttgctgcccctgttttttggtaccctgagcttagtctcctggcttggtttcctgccctctgccatcccatcttctctcacctgaggttggggatggatatcctgggaatccctgtctcagcctggattctgtccttctctctgggtttgttgcatccctagcaggcaggaccacagttgcagggatcggggcaggggaagtagtgaagcacagacctgagagtgccccagaactgttcgttcattcatccccttagtggggagctgaagagggttcaggcccaaagatggtgcttctcttgtttggggcatggccatttcaccccttaaggaggcaccaggcttgagcccatatagtaataggcacatcctccagccaaaactattccagaccagcaggcacttggctcatcttgggggtcagcctgtcttcatctaagccactggttggcttccaatctgaccccacttctccaccaatatagcttctctgtagtcaccagtgaccaccatctctgaccctgcatccaacgggcatctcatcttttgcgatctctcaggtaaaggaaataatgtatacagtggtccattgccaagacaaagtgccttaaatcagcttagatcagcaaactacagaagaaaccggatatatactaggcccctgcttggatagccaacgcctgcttgtcggcagccccccaccctccctgcttagtcgccctcaccagaacaagaagtttagtctaaaatgaaagtttattagtctgcaaaatagctcattttgtctgtttttatcagcccgcccagctgcttaggtcataagccaaatacttgaggccgggtgcagcggctcacacctgtaatcccagcactttgggaggccgaggcggatggatcatgaggtcaggagatcgagatcatcctagctaacacagtgaaaccccgtctctactaaaaatacaaaaaaaattagccgggtgtggtggcgggtgcctgtagtcccagctactcgggaggctgaggcaggagaatggcgtaaatccaggaggtggagcttgcagtgagctgagatcaagcaactgcactccagcctgggtgacagagcgaggctccgtctaaaaaaaataataaaaaaataaaaacaacttgaatagcccctgagctaactaggattgcagtgcattgtgggctgcaaaaaatgcaataagacaacccaaaaacaaacaaacaaacaaacttaaagctaacaatcaataggtgacatctgggaaaactgtgaccccgcagtattcaccctatgaggaaccgggggagagacccgtgcactaggggtaaattgcttattgaaactgtgctgggtgtgcctgcctatcagacacccaatcttgcaagacccgtgttaaaagtctcaatttcgctgttccctgggtctctgagtccattctttgggtttggacgggtgaatttgtttattacacagaggcagcagcccctccagacaactcagtctctttgaagccctttctccccctccaagttaccccactctcccaccttcccctatggccacatctcttgatctcgtctacctgaccttaaatgttagcctgtctcaggtttctgccctatgtggctcttctttctctagcctgtactctttttccatgtgatcccaccccatcctggtgtcaggaatcacattcttccctcatccaatccatcaccaagtcatgtccatgtctcccggtctctcggattgagctgcttctctccaccagctccaccaccgacttaggccaccgcactatttctccaactgctcttggttcctctactcttgctccctgaagatcccttcaaaggcaggttaccattgggtactgtggtgccatagtaccaaaggaactcagtggcttcccattgttcccaaagtaaagaggattccaggctcagcacggttgggtctttgccggcccctccagctccccagcaacaggacctccacctccctctctttgctccagccacactggacatctctccgttctctgagcaaaccctgttccctcccaccctaggcattctcagaaacattctgagaaacattcccagaaacattctcccttccccttttcccatctcagctgtcctcactgatctcccagatgaggccaaatcctccctcattacatgttttcatgcgactctgtaccaggatatgtgcttatgcactttatgtgattatgtgcgtactctttgccagtgcctccccatcccgcctccactgtgccccactagttccgtggacaaccaccaggtctgctttgctcaccattttattcctatcatgaaacacagtatctggaacataggaagctgtcactaaataatcgtcgaatgaatctggccctgtttctagcttgctgtatgactgtgggaaagttactttgtctttcaatgcctgaaaacctcacctgggaacctgtctcaaagggctatagagatggtggtgctagacagtgtgagatgctgcgggtctaaagctctacagggggaagggggagtcctgagcaggctcacagtgggcactgagacctatcataagaaagccacaggacagtggaaagaagccaggctgggtacaggaagacctagcatctggcccactgcccctgactccctgtatgaactcaggccagtccttgccttctctgagcctcagtcttcccatggccaggatgtaagctttggcctgcatgctgctgcaggcctgcctggctggcttgtgttctggcctgggaaacactctcagttctttagagaaaacaagaaccccagctctgccacccgagacagattctgtgcccaggtctactgggccagtctccaggcccagggtgtcccatgactggtctaggcctggctcagtgccctggggcttgaacagtacccagcacctgtcacccagcctgacacagagagacctgccagtcagagcacagcagggaccaggaagacagtggcactgacaggcacggggtgccccagtggacaggatgagatatggaaaaggggctagccaggagatggcctgtggggttctgacccttggccaaaggctgcatgtcagggctgccagcattggcagctgcttcttcggctgcctgctgcccagagctaatgagtggggacagagccaggactcgaaggggaaggcgctgcttcctctgtgcatgtggggcaggcttgggatggcacaggggaggtggcacagatcagggccagctagagtcatactcagaggatccttggttttcttagataagcctgagagccctgaccctggccctacactgagcttgaccttgattgtagactgagctcagccctgaccctggtcacagactgaggctggccttggtcacaggatgagctctgactctggtgactaattgaagaagatgttaaaagtaggacaattgtttgaaatcctggcaagaggggggataaagaaggttacagttatcaaatactcaccatacccctgagaaataagctaggagtgtattgtgtgtttcatacagtttaatcgccacccagtcctataattgaggtataatattatcattaaacctcattttacagatgaggttcctgaggctcaaagcatttccatgacttgcccaaggtcacagaactagttagtacccaaaggaggatgcaggatccaggatttcaaaatctaaaagctccctccacctcattctttgccttgatatttcatgccgtggttaccccttttggaaggggggttgttgagacaggatgctaacccagacttccagagaagatgcagtgactagtgtggagacccatcctgggatctggagttctccttcctccctgtctggctgggggccttcagtcaaggacccctgaaggcagggatctgggcagagtgggtggaggctcacaatgactcacaggtgacccatgggcttgtctcagcagccagagggttgggctcagcaaaaataacaataacacagtgacagtgatcatgggatagtcccaggaataaggcagccctcacttgctgatgatgttccactcgaagctcactgcgagctcggctatttacaccctctggttctaacggtgcagtcctggaagcaggctgcgttattcccatgtgatagtggaggaggccaaggcccaggggagaatgtggatgtgtctgaggtcacatggctggccagtgggagtggagcagatgaagatgactattcccatctggccgctggctcctacagaagccaaggctccttctcttccagcaggatccccatgggaaaaaagacaagggtggggagcaggcctggggtgaggcctgggaaccagggtcttcatctaccctgcagggcccccacaccatggtttgattttccacccacacctgccccccatgacatcagttcctggagactcagaacctcagaatttttgttcagtgagaacttccctttgtcccagggttataaacacagctggtgtcagtggttgaaggatggttggcctgagaaccatccccagccagaccgaagccataaggattctttccagatgttctcccatctctgccacctggggcccctaaggtgttctcatgcctgaaacccccattcagactcaagaagcatgagttctcccccacaggcttcttctggaatcctgcataacagcctcagagggcattcatgggggagatttggggccatgaggcaggccagagggggccttcctggtgtcctcattgcatcctgcatgggctgtctcctctgcttactcctgagcatgggcagagcggctgacagcctcctcctccctccctggtcatcatgagcagccaggaggcttggtgatccctccagactttatgtagcttccctctccctagcctggcccccgtgggtcccagggtcacatgccacagggtctagcttgtagtggagtgagggaggccattgagcaggggctggggctctgggcaccgattaggctcctcctacccctgtgtattccctgattctgtcatccttccatgcacacacttaagtttccagcagaaggagctgccctggaatcccgttgatctcctcgttccccccctccttctctgaggctccccctatccatccagaaacctgtgagatactgaacaccattatcagggagaagctgagctcagagatgcttaggggatgtgccacacagtcagcagcagtggagccgggagccagaattcaaagtcaatgtcttcagggccaatctacttatgcaaatcctgtagttcctggcatgtgatgcaatagagagaggaagcaactgtggcaaaccagagagcacctggctcattcagaggagtagcccctgcccgtcctactgatctctacatggaagaatgagggcatgggttgtcaaccctcttcatttttgtttatgtttaattattaggtttttttaatgtgtagagatggggtttcactgtgttgcccaggctggttcaaactcccggcctcaagtgatcctcccaccttggcctcacaaagtgctgacattacaggtgtgagccaccctggccagcctctctcaattttatttattttatttttttattttttgagatggagtctcactctgttgcctgggctggagtgcagtggtgtgatctcagctcactgcaacctctgcctcccaggttcaagagactctcctgcctcaacctcttgagtagctgggattacaggcgcgcgccaccactcccagctaatttttgtatttttagtagagatggggtttcaccatgtttgtcaggctggtctcgaactcctgacttcatgatctgcccgcctcagcctcccaaagtgctgggattacaggcgtgagccactgcgcccggacgcctctctcaatttttaaagagaaaccagaaatccaaatgtttgtgtaaaatcagccaagttttactttcaggccaaacacctctggtcagtgaggatctctgggcccctcattgttcctctcctgaaccctcaacccaactcggacaccaccggtgcctccagctttgctgactggtccccctctgccaggggagtgacctcccaatggctgtgcatcctccacacatgtataagtaggcattctcctttcttgaagccccttctttcctcgcctccaggacaactccctctcctgattttctaccctgtctctggccactccactgtgggatactctttgtcccagtaccctgcgaatgtcaatgctcctggctcagtccttggcctctcctctgcatctctaccctccttcttttttttttttttttttttgagacggagtttcactcttgtcacccaggctggtgtgcaatgatgtgatctcggctcactgcaacctccacctctggggttcaagcaattctcctgcctcagcctcctgagtagctgggattacaggcgtgtgccaacacacccggctaattattgtatttttagtagagacggtgttttgccatgttggccaagctggtctcgaactcctgattgcaggtgatccacctgcctcggcctcccaaaatgctggaattacaggtgtgagccaccacgcctggcctctatactttttaagagatcccccctcacctaggcatccccctttccccccatcctgaaagccccagaatccctggatccagccctctcctgagctccagttccatagacccacctgccaatatacgtctccactcagactcagccttcctcattgatctcctcatcctccctccttctcgaaacctgtgagatactgagcgctgttatcagggaggagctgagctcagagatgcttaggggatgtgccacacagtcagcagcggtgagccaggagccaggactcaagcccacgactggtgagcctgaacacaaagctgtctctctggtcttcagcaagcctggcctgggaatgctcaggaggccctggggttttatccctgggagggcaggctgtggcctaccccttccctgttcccatacaaaggtggggacagaggagcaactggccctgagtgaggagaggagctagtgggcatggccccctccctctcctgtcgacttcccagcggtgtgctcctgcggtgccctgtggcgttggaggagtggggcctagggactagccggggactgtggcagggactctcaggatggtcagtgtggctaacaaaaccagacctcgatccctccacagcaccctggaatgggacagagagaccaggggccaggctggaccgaggcgctcagtgccccctgggcctggagggagcccagttcccccactttccccccacagctgggttctgcttccccactttggggacacgctcttgggacaggacttgggatctgaaccctcctcccagccaagagctatttccaggacagttctgaggagctgccactggctcagcagcctgggccagtgagttggcctggcagagcttgaaaggaggggctgccactgtcccacctgattttccagtggtctgtcccttcttctttctttcagcaaacacctgctgggccccactttgcccaggcagtgggaactgagctccagcagcgacaagacaggtccctgcccttgaggggtgaacagtctagtagtggtggtgagggtggggaggcgccaggaatcataatgctgtccccactcactcatcctttgcccacagtctcccaggaaggcggccatccaggctccagtcgccagcactagggtatcggagcccctcaggaggctgggctctgtgtctgagccagggagtggccccagacctcaaaacgtggactgaacaccacacgagttaagcagggaatgagaatcagaatgacaggaatcagaagagtccggtgatttctgtgaggtcaggaagttcgactttatgtctggcccacgttcctcctgccctaaggctgcgtacgggagaaagggggtactcgaaagagtggctgttcagagtgaccgaaccattgagaggattccacgtcctggcaagtcctgctgggttgctcatccaggcccacaccttccaaggggactgtcattgcctccccataggactgtgatggtgactgacaggtccacccattgcggcccaagaaggtggctcccagggcccctcaccagctatgccacaggacaggacacggcatgacactccaaaggctgacagatggtgcagacagcggcccttcctgaccctgcatcgcctccagcctcaaaaagagcaaaaaagtatctctggaaaacaaggaaatccccttcccagaagagggtagaaggtgcaacaatgcccagaacaccggcacttaagcctgactttgggccatcacaaagctctgtgggctgtggctttctccttgtccgccatgggtggaaaggaggggtacccacacttttggatgaagtgtgagtagtggtggggtggaggagcagcatccttgtttgacaggaagatctttgcctttgctagagtgcttctcagagtttctcggaaggtgccctttctttttcccagagcagcccccatgccctgcaggcaagggcaggggaagagctgggccctcagggactgggagctgctggcctccagttggtgccctccttactccagagtcagttattctgtaaactgaggcccacctgcagtgttgtagcaccatcaggaattagtgatgcttcattagagtccaattaataaatgaaacccaggatgagagtccctcgcgttgctgagaataacagccctgctcatgccttaagtggcagcctcctggggctcaaaacccacaaggaccagctgccctgccgtcagcatggggctgggggaggcggcagcacagactgggggccttgtcaaggctgttgtctggtgaagcgggggcgagaagagaagggagcttcagcactgactccctgcctcagatctcagctcctcctttgaggagtccctgggcacaaccccctgcccagcaatcccaggggagcttggctaaggccagaggtgtgagggctggggctcttccctcctgcctgcctggcttcagaagacactgattgtggccacggcaaaaaggggccttgagagggactcgggggagaaccacagcctccctctcctgactcccccaacccatgctccgaagtcagcacctgcatcagccaaacagcccccctcaagcctcaccttctctcctctaagtggaaagatcctccaatctatctgttcaagccctgccttctccaggtttagggtcagaaacacaggaacccagactttggccaccccattcagatgactgtctctgcagaagccaactccacacctcctgttgcataagactgggctcctggattgggaagaggtcactgggtttttcagagcttccaggagtggaggcaggcctagcctatggcctgggagtctggcagcctcttggacttctggaggatgggggaggcaggcctccctggctcagaagttggcatggaggaagcaggttgaggagaattgccctaccttctcaggaaagattgagacccaaccattacaccttgacagctggcctgcaggactgccagttccctcacctccctctcagtttcccaggtgagccagcaatgggttgtgatgggccaggtcaaaggtgcccaatacctcctattccaccatccatccacttaaaggtctgctccttatccactattcccagtgcctgcctgacttccccagtgccaggggcttctgggaacatcactctagtctctcaggatttacaagcctgcccagccaagaccccagcagccacagcagatctgagtcagggccctcccctttcctttgctctcttggtggctgtcctgggattggcactcaaaacaaaccaggccgcctgtgccccagcttctaaagctctgcccaggaggcggccaggtcttgactattgttcatgatttgaggctttgagggagccagaggccaacaggacaggcagggcaggtgggggaggtgggctcaggtgtgaatagaagaccccagaggcagcctgaggactgggtaacaagagtgggtacagtatggtactcacacctctctgggcagcctttgtgcacgtgcatgtgtgcatgtatgtgtgtgtgcatgcatttgtgcgcatgtgtgtgcatgtgtgtgtatgtatgtgtggatgtgtgtgtgtgtctcctggagtgagggggaaagcggctcatgagcactcttgctttctgtccatcaaatcccatgcttttccgatgctcatttcttccactcacagctgcagcccccgggaaccagatgacatattttcccttagtcatgaccttgcagaaggaaagcaaagtccttgttccctcccactcacagctgtgcttgagcctggcccccttacaccctgctggggtgggggccccaggaatgcctagctggggactggagtttgtcaaagacacacacacccttccagcagcctggagggtaggccaggttgagggaggtttatgttttcctgcagcttggtctcagggctgctgcactctaaacccaactccagtcctatcctggcatggctgcccatgctgtggctggattaaatctggccccgagacagcaggcaccacccactagctcctcctggccctggatgcctggagccaacgggtccaagtcaacagggcaggtctttggggggacagggaggggggtctctccttgcagacagcctgtggagaggcctagggaagcaggtcttggtgaggtcccctgggttctaagactgcattgggagccccgagagagcctggggacctggaactcagccacgtgcccatctgcggggtgcagaatggggctgggagcagggagtgagctcatcccctgctcctattctgtgaagaatcagaggcccttcttgctctccagattctagaatagcatcaagacccggaggagtcagctgtgccaggaaaagccattaccccgagagcctccctccacctgctaaaagcctcccccttcccctggggcctccccctcccacccagttgctttatctgcactcacctagccctgatgaccttcatattagatggggcagggaggtggggaaaatagttgcttaactctttctctgctggaggaaagtcagcacctgctcccttgccttgccccgtcacctttacccacctctttgcacctgggaattcctcctgccaccctcccaggagggttgggaggatacgaggacagtagaagacaggctggcatggggttcaatctgaatcctgtcactatgttgcctgtgacttcacaccttcatttgtgtcttctctgtgcacacagagccacatgaagatccctgggaatcccccaggaatgtgtccatgcaggtgcagttttgtgtccagctctggggttgacatctgggtgcagaaggactgacttcttcctgacacacccttggcgcttctgcttttctgctgtttctgtgcaggtccctgaggagggaggctgtgaggccttattgtgcactaactatatatctataagtagcagatcgggtggctgggtagcacagggaggctgctgagagcctgaggtctctgactttgctggggcagctgtcaggagcgggagcctaggcacagagcgtcatgggaggtacttagattgcaccccttggtcaagcatggtcacagagccggagggaaaaagggacccgagggtggagggagcaagctgagcgccacgttcctgccaggcttctgccttccctctctagcctggcagcctcccacacaccactttgcgggtgtgaggagtccattctgcagagcctgcaggggtgtgtctggatggacgctcatctgagaaggactccggctctctgggagatgccccttctcaccccagcttgtactcagtgctccttccccttcatgctgccctcaggcaggtcctcttgcaaaaacacccaagctgttttgtatcacaaatgagggaataacatgaactggggctttctggatgccaggagctgaacatgctttctttccagtccttataacactctctcagggcggtactattgaaaaaggaggaacttagtaggtgcagaggggagatgatctcgccaggataaacgcgggctccaaacccagctctgaatcattcccaagcctgtgctctttccaggattccacaccttggcccgagcagccagacattcccaattgtagacccagaactgggggcatgatggggaaaaatcacgccacggcaaaggggctggtcacaggagggtcaataaggctaagctctctggtgctatggggtaataacaggaatcatatttatattttaataatttaaggtactaagaattattaacactttcttggtacttagcaatgtgccaggcactacacatattcattcgtttccttcccacaaccgccctgcaggctgggcaccgttagcatctctgttttatagatgaagaaaataaggcaccacaggttctgtaccttgcctaacatcacacagctggcacggggtagagctgggatttggaacccaaaatgcccagctgcagggtccttcttacaatcactgtgtcatactgcctcagtcaaagcacagcaggagtcctcagttgacccctggaacttggagatggaactcctgcaagcatggtcacccacagaagaagggctcctgcaagcatggttacccacaggagcagggctgtgatgagtgggagcaaggagccaggtcacagcgtcacttaagtctaaagggcagagggaacagtgagggccgggggactccagagggcttcttggaggagaggaacaagctgggctgggaagaaccatgttggtattgctaatgcacagagaaggtggggtctgagccaactggcctgccccacactccctttggggtccttgagggtgaaacaagggctggtggggatgacgtctttgttcccatcctggggtaccattagtgcgtcttgcctccctccgcaaggtgtgtggtgtggctccccctgctacaggatctctgggatgattcctcagcccatgactgctgcagttaatggagcagcgctggggatggccctggcctagtaacctcttctacagaagaagtattcactctctccctgagccgtttgacggctctggatctccgatatctgtggggtgcactgggatgcagagggcccaagcttacctctcaccttatacagcctggtcctgaacaatctgagtgcttgagggctggaaagccctttccaccaccccctgcccccaggcctggacccagctccaggtttccagctccaggggcccagcccaaggccctgcacacagcaggcatctcagaaggcagcaggatgtgcgtgcttcattgcaagcatttagaactgggattgccgggtggagcctggaaatctgggccagaagtttagggaaataaggtgaagaagagaggacagccaggcggggcatcgcacagccactctgcccagaggattcctcccaccgaaacagaacctagagaagagggaggccatgcacacgggctcctgctggagagccctccctggcaagggctaggaagtcaggcgggcaaagcatctaccctctacccccatccctacccctgccctgagcctctctaagtgagaggcttgtgactaagtgaaggcctcagtagtggccagcgagacagtgtggtcacctgggctggcaggagagctgggggagaggcctgggatgacacaagtgtctatgcatgggacagagctctccatattctgtccacctttcactcagatttatggacagtggagcctgggatggggacaagcagcagacagaacccctccctttgactcaccctgcccctgctctccccaggaaaagcacatctgaggaaaagaacaatcagagctccaaggcagtcacatctgtgacctcagagcccaccagagcccctatctggggggacacggtgaatgtggagatccaagctgaggatgcagggcaagaaggtaagcaggggctgggcagggccggcatgtgcaggcagggtgtgaacacagccaaggacttagagcaagaagcaggctccctctcactgcagctggtagccacctgaacacctccttgggctcagttaaaagcacttagaaaaaatcataatactgtcacgcctcatctccccatcctgctcgaaaaatgagttgttccacataaatgaattttccagacaatgcaagcttatcttttttatgactgttgttattattttcatggctgttattagcgctgtctcctactgaaacaggacattacagcttcctggcacgtccccacacatcactcattggagtcaccacctcccaggaggagcaatgctgctcccattgcttaagagaacatcgaggttcagggaatttaactggcttaagcttaagaccaaggaccaaggactcagcattgcatgttcttactgcagctccagggttcccgctgcttccatttgattttttaaaaaatatttgaaatgtccctagaatggatccctattcctgcctagtcctccccaggtgtcagcctgagccacgaggtgcccatgtacacacatgcatgtgcacacttatatttactttcacactgtgggtctgttggatttccattctcctgggggagctcaggctggacacaagggaatactgattggctgatgcccgggtaggggggcatcgcatctggcactgccagcacagactggaggtgcctggcgatgtctctgatcttatctagtcaggacctcagacttgcttcttgcaggtggtctctccctgagaggacaggctttgcctctcccccttgaaatcttgccaggacctagacagatctccttgttctcctcacacagagcagaaagccagctgaagactatgggagaggagaaaggaaacaggaaggggagcctccgtaaaaggggaaggagctagttctaggtcaagccagataatttttcttttctgcctgtaaagggataggtggagctgttgggatgctttaagaagatgcaaaagaggaggaaaaattgacctaggatttcatgcagaggcacatgcgtgcctgtgtgtgcatgtctttgtgaatgcctgcatgctggttcatgcgcatgtgtgaatgtggtgtgtgctgtgtctgtacttgtaggcatgcatgtctgtgtgtcttatgtgtgtgtgcgcgtgggtgtgtctagctgcaacagtgtggttatatgtgtgtctggatgaatctggatggtggtgtatgccttgcagtgcacaagtatgtatagatcgtgtgtgtggctctgtgtgtatgcatgcatgtatttatgtggctggtgggaagttagaggttatgatgagtggacctgagctgggatcctgccctgggctctacatacttggggtaacagaggaaaaaatgtaataaggtcagtgaccccagggcccatctgtgcagcagagagaggggcaggactaactgcaggagggacaagagagtggggaggcctcatgggcaggcagggaatattggcaggcatctcattgcagattgaagtagctggatgcttgttggaaccggttgctgtggtgatgtctgcggtgggggtgggggagatggaggccaggccaagaggcgggggaagggtgggaggtagctcaaggatgtgttaatgaaaagcaaaggggagtttcagaccctgtgtcagggccaaagcaggcgggtggcagaaatagcttgttggccacacaaagggaacggtgggaggccggaagggcacaatgcccagagaggaagctgatgaagtgtgtttgtagcatggagacaggagcagggaggagtggctgtccattacccccaattccagctcatctgctggctgcccacacagagctccaggaatagcgggtggggaaaatgtacggcactcacctctcgttcaaccttggcaaatcccaactggatctggggactcttggtccatggcgagttggcataaggggcttcagcctgcacagctcctcgtggtgctttggctgggagcactggaatctcccagttgaatttcctcaggtctgcctacatcagggtttgtgtttggagagctgcagatgcttaaagagaaggaaaatagtgacaaccacgaggagcatttgcacagaatgttacagcttgaaaacacactcttctccctacaacaacccaaggggagagacaaggctttttattaaagtgttgacattttgaagagcagaaacatgaagttcagagaggttaaattacttgctaacagtcacagagcaagttagtattctggtactagaacccaggtctgctgacttcatatcccttacctcaatctcccttcttcaagccaacctcaacaccttcagtgccctctcccccttctttcctttgagcatggatcccatatgacaagctcttgagataccttggcaagtgttcagggtcgctgtggggaagacagagaaagaagaatacttaataaagccctcagcttccttctccaccccaacatccaaatgacccatccagttccaaatgacccatccagttccaaatgacccagcggctgagcccgctgaacctgctgagccctcaagggccagctgctgtccctggtgctgaaaccccttgtctcaagagaagcagagggcaagggtctccccaagtgtttccctcaggcacacccctccgccccatcctccctttcctgttctctgttttgtatcctttcttacctcatctctctcattctttctccatccctcctctatccttctcctccttttctccctccccatctcttcttcctcctgaaatcatagacttccagaatataaagatgcctcaagtgtcaccaaattcaacccttcctatcatctactttctagatgtgttatgttgatcaagttatataaccctctgagctccattgttcatattttaagaacagagatgatgatacctacccggggggttgtggtgagaatttgttggaatcatggctgagacatgcctggcacatagtagatactcactaaataatcatgacagtcccgctcactaaacaggactgtcatgattatttataggacattggtgttcttcttaaagtttttaccggccgggtgcggtggcccatgcctgtaatcccagcactttgggagtctgaggcgggtggatcacttgaagtcagaagtttgaggccagcctggccaacatggcaaaaccttgtctctactaaaaatacaaaacttggctgggtgtggtggcgggcacctgtaatcccagctacttgggaggctgaggcaggagactctcttgaacctggaaggcagaggttgtagtgagctgagatcatgccaccacactccagcctgggtgacaaagtgagacgctgtctcaaaagaaaaagtttataccaatattcatgccattttatgagaaaatatagtctctttggagggtgtttactaagtggtgcattattcttagtatttagactagttttcccttacttgtagtagacttttattgatagctgtattaaaggatttccttgagcagatcactttttcttactgaaattcagtttccccacctgcaacatgtgtgagataatctctccccatcctgcctcaagagctggcataagtgtttgtgaccaagggaaagagtcttattcctggaaagaggtgctatgcctgcttgcctgtgtatctcagtgtgtgcacatgtgtgtctgttgccacaggggactggactcagttctgtgtgtgtctatctctgacctgggagtttctagaccatgggagaaaattgcatgttggggtcctaacagctgccggcatggagctttgccctgtgcaggggctcagactgtgcttgtgggtttgtgtgcacaggggtgatccacacatgtgtgtgcatgttgattcctcagtgtggcccctgctccctactctcaacaatgtctctcacctctcactgtctctccttactgggagagaaagggatccatttaaaaataaacctgggctcattttttctctttccagatgtgatcctcaaggtggtggacaacagaaagaaacaggagttgttgtcctacaaaatccccatcaagtacctgcgtgtcttccacccctaccactttgagctggtgaaggtgagtcagaggcctggggaagtgccgggagagcaggtgggaaccaccttgaatgtccccagctattccctcggagcagccctgagcatcccacacccacccacagcatgacaagtctaggaccatgtggggctcaggaaacatggctcctggtacatacacaggaatggtgtctacaagaatttggaattctccaaattcatctctgtaaaaacagctgattattataggacaactgccacattaaatgaatataccaattaaagatagattttgattacaaaaatgttaaaagagcggatctaaaaatcaaagaaacacaatatttaccgagtacccgctgcttgcacgccctgtgctagacatttcacaccccctctctaatcctcaaggtaaattacattttgcagacatgggactgggacctggggagaaaaatctcctcctcctgggtcacagagcaagtgagcggcagagttgagggtgagcccaagtcatgctgtctcccaagccagttccttctgagctgcctccacatgctgccttggccagaaggcccaggagagttggggggtacatggaataaagcattccctggaatgcacccctggagtgagcaactgggtccaagccatggactgaggggcctgaggctcctcactccaaggttgggcctcccaggccagacccctgcctgtcctccctcctagtgctgaagggtaaggggtagaattcactctctcattgctcaaggacttatgaagcacctactatgtgccaggtagtgagccagagatgaacagaagcatcacattcccctccccactgtgcattccagaccctgaaagtggttgagagtaaagaacaatgtgaagccagactgtcgggggtcctagaccaagtttgttgcctcctagctggatacccatggaagccacttggtccccaggcctccatcctcactggcaaagctggcacagtcgttttgaggatctcaagcaatgataggcaaggttcctggcatacagtaggtgctcagtttggtcagttaccctcccccatccctcctccgggccagcactgaactttcttctaagcatttcttcaatcatggcaccagggggctttaccttctcttaggccccatgaggaaccccaatcccagggcttcaggatgggccatgcagggaagtaaaagagagatgtgctactcaccctgggagactcagcacttgagctgtaattctgggggcatcacccaggccccctggctgtctgttcacttacaacccaggccttgttatcacatctttactggaaagcagacaggcagtggtccttgtgagggtgatgaaatattcaaatggaaaagggaagatttattatattgatctccttggaagggctcacagggaccatgagctttaattatcagctcggagccccagcggagcaatgccaagtgattgtctgcagagggctggatttatggccaggatctgccccttagacactctccttcctctgtgtcttctgccccaaccctgtctccagcccactgagtctgggaaagccgatgaagccactgccaagacccagttgtacgcaacagtcgttcggaagagcagcttcataccccgctacatcggctgcaaccacatggctctggaggtaccagggctggggccctctggggtggtggtgggggtgggaaagggccaagctttgagcaggccccacgccttgcccttagccccctctggctgacctgagggtgtggagcagagatgtcaagaatggaaaaagcaaccaggcctttccaaaatagcaaaaggagttgtgaagacaagccctttggcagggatgacaaggatgaagatgctcaagcctcttctccttccctctctgtcttggaggtggcggggaggggctcagccacactgctgctcctggtgtaccgtctctgtgctgcagtggggaccagagcctgtctccccgaatcttatgctaggggcaggggagaagccccgtgctccccctgagcccacagcccagcagtttcctgctctattcttcccctcctgggatagtgccttggcccccaagcaaaagtttagggcctccttgagctttccttcagcactgtgtctaaagaggtttgactggtctggcgattaggtatttagtttattcattcatttattcatccagcaactgtttacagagcctcttccattagccaggacagggctgagcccaccttgggcctggccactgccccttgacccatcaccatccaccccctaggccaattagcagctttgggaggaactcttgatgctcaaagcagacatgatgcagggacctggcccctctcccattccccccaactttcaaactgcccatgggtgacagattcaaattcagctatggcctgagtatgatcagggtgggagccacaggacccaagctctgagcttccacctacccaaacatggctgatctgttcctatccttcccacccccctacttcccaccagcaccgtgggcctggcagggaaggaagcattcttttgccttctttcacagccagggacactgagacccaaggggagtatggtatgggagccaaaactcctaacccacatttctactcccctacagccacccctctgatgccagcatatcagacctacaggcgccctctgctccccgccaccttctatcacgccctttcctgaggacagccagcaattcacacacacacagaacaaggaagaggggcaacagcctggccttgctgtccccaggccgcaccccacagggaggaggccacatccccaagacacaggcagaactttagggctgctgtggagctgccccaccccacccagccctctgacttgcctggtagagcggtagagtaggggccttctctggctcacagcaccctgcccactctcctgccccagcacagatgccctctccatccgtgcgacaggtatggccacagagcagctgcctgctcctgatggtgagcgcatggcaggagcaggaacttctgctacttcccaggctgtcatgagcaggtgtacttgggcagctgtctcattcacacctgatcagagtccacacagaacaggtgcaaattagctgccaccaccccctttttagtcttacacctgctggggagcctgtgagcaatagggcctgccagcctccagtgaaatccctcagccccagaccccagacccatccaaagtgtgaaatgtaccatcagagattcaatcctttgaatgtgatgaagggattcagtctccagagccctcagtgagagctgcgaggccctaaggactattgtacgtgcccatcagctcacacctgtgtggggttagaggtgggaaaaccagctgagatgggtattgaaagaggagcctgaaaggagggtgcggagggagaaaagggagaatgatccagaacaagcctcactcctgggccctcgccagccacaatgggttggtgggagctgcagggagtctgagtagagggatcagcatgtgcaaagaccctgtggcagaaataagaggggtaagtggcaggagtaaaagagtctggagcaagaagacaggggctgggggcctgtcgggagacacggcagaggggcttgtggggtgtcgggcagggaataacgtgacccagttcatttttaacaagagcacttttgccatcatgtgtcaaattgcctgggaaagaggatggattagggaaaggaacagaagtggagaggctagtgaggaggcagaggaatcgaaggagcaagaggaatgagagccgagtgggaggtgggtgagggctgagggagagtgggagccattggtggatacagggtgagggtcagggtccgggagatcagggcctcttaggctggcagcagaggcgcatggggacagactccctgtctcccctgtctgccttccagtgtcccccaggcccagactgagcagggggtcagtgagggttggagcaaggtgacgctgtccactcctgctttgtaacctcctgctgggaccccgctcggctctctgaaagctgcgccaatagaagcctggagtagaggagagggcagtcaggactgggaggcagggaagcctttagggggtgacagaggactgaggagggaacaaccaagggcggtcaggggagtgacaaccgggatctgatgaagaaagaggagcccagagatgcggatgctatgatcctgttccaaaccagtacttcctggggaaaccagcaaggcaggagagcaggcaccagggtgagcagtggagcaggcaccagggtgatgggcacgagggaggcaaggggagcctggctgtggccgctgatctcaggaagttcagcatggtcggagaaaccagacctgggcttcctgtcttcagtttataaagtgctctctcacaaacgatctaatcagagacccctcacagccctgggaggagcctcatttgactgacagaaaccaaggagctggaacacctagccctacccctagcccaacccctccccaggagccagtggaggggccgaggttagaacacaacctcccttcccaggacccaactctcatcgtaccctttctccccaaagaaactagtgtaagagatccattggtaaatcccaggacagaaagcgggagcagttgcctcagctcggcagagaaggcttcctgagggagggcagcctggtgcaaagcaagaaccgagtaaggcagggaacagggagaagcaggtgtcaagtgtggaggcagccatgagctcacggatggggaaaaagagggtaggcagtctggctggctgtctctggaaggtcccaaggccacatggtgttcacctgcctcctctcctctcctctccagatctttctccggggagtcaacgagcccctggccaacaaccccaaccccatagtggtgattgcccgggtcgttcccaactacaaggaatttaagtgagtggggcccaggtggacctgggtgaggagggcagagcagagggcagaggagggggtgaggctgtcattgctgccatgggctgattccaggacctccggcaacccctctacccctaaggcccttcaagcctctccattgggtctgaggtcccagtaagcttcctgcagcagaccatgcctttctttccccagggagagcccaggcccctggaaaggggcagctcagtcctctcctgagagcaagctggagggcaggtggtggggatgagtgccgataccaggcctaacagctagagagtgtggggaggacaacaagaggggtcctcattccctgctcagggaacctcagcccctccaacctgcctccctgcctcacacccaccacctccccactccccctcccactctagctcagggccacaggctccagccagtggttggccccaaaggccatcttggaacttcacagcctttagccctgccgggcggagtctcctccctcctcatcctggaggtctccctggtcccagccacaactcatcccctcctcccctagacctccttttgagtctgttggagtcacagtcctcaagaggagattcatactttgccacacagtgggaaattcccctatgaacgtgtgctctctgccacagcaccgactcctgggagtcagggtctgtcttggtcacttccaactggccctgatggcccaagatgactcccctacttctctgtatctcctgttgagtttttatgacttatgaagcccccttgcttgttggaggaaggaagatgattgatgcacgcccagcccagtggtccccacttgtcgtgaggtccaggcccgaactcggcgggatccctgcaactcccttctcttgcatcaacccagagtctaagcggggggccctgggctgccaggctcaggtgcagagcccagagcactgaccctgtctccctgcctccccagggtcagccaggctaacagggacctggcctctgtggggctgcccatcaccccactgtccttccctatcccgtccatgatgaactttgacgtgcctcgcgtcagccagaacggatgccctcaggtatgtctcctccccagtggttccagcttcctgtaactaccccacacattcactgttcactcactcagtgagtcagtcagcagttcccttgactatcgagtaagagttgactgaatcccacggcatacccagtgctgtgctcgcctgtgcggcagagaaactgccctccaggaactcttggtctggtgaagatgggagtcacgtgggtgaaaaagttgaacatcaacacaagataatgtataatctaataacaaactgggagggcctgtcagggctatcacatcagaggagaagatacaaaaggacaaatatatgattccacttatatgggatacctagaataggaaaattcagagtcagaatgtagaacagtggctacaggggctggggaaagggaagaatggggagttacaggtcataagtacctagtttccgtttcaagtgatgaaaagtcctggaaatagatagtggtgatggttacacaacaatacgaacaaatgaatgcatttaacattaccgaactgtacattaaaaatggctacaatggtgaatgttgtgttacgtatattttaacccagtaaaaaaattttttttgagacagagcctcgctcttgtctcccaggctggagtgcagtggcgcagtcttggctcactgcaacctctgcctcccgggttcaagcaattctcctgcctcagcctctcgagtagctgggcttataggcacatgccaccatgcctggctaatttttatccttttagtagagacagggtttcaccatgtcggccaggctggtctcgaactcctgacctcaggtgatccacccgctttggcctcccaaaaggctgggattacaggcatgagtcactgcgcccagcgaaaaattttttttaatcagaggagagggatgtaaagcctggattagggaaggcagtcttgaatttttttttttttttttgagacagagtcttgctcttgttgcccaggctggagtgcagtggcaccatcttggctcactagcaacctccgcctcccaggttcaagcaattctcctgcctcagcctcccaggtagctgggattactggcacccgccaccatgcccggctaatttttgtattttcagtagagatggagtttcaccatgttggccaggctggtctcaaactcctgaccttgtgacctgtccacctcggcctcccaaagtgctggaattacaggcatgagccactgcactcagccggcagtcttgaatttttaacagaggaagggttggtacaggttggacacagcaatagcacaagtgtgaggtggagacaggcaggctatgacccatgtcagggcagacaggagggctgtgtgtttgagtatgaggttgggggcgggtgcacgcacagaacatggctgggttcaggggaatagccagattggtctcttctcatgatctgcgcttcactgccagcttgccctacacgatggtcccaacattcctaggggccttgggggacagagggatttttggaggtccctcctattgtctgcccaccagtgcttatgtctggcatagcaaaaatagaacaagacacccctttggagcccaggcttcatttaaaggcaaagacatttgaagaaggctcagacatggggtagagtgatggtggtggggaggagtgggacaaagggggaccctggggacagaggcttcaaacccaaaccaatcctttgcctgatttccctagagttacctcacacatggccctgcatttgcccagaaaattaagaaccaatcagcaggctgtcccaaggggcaagaggcactgcctgctttaatgagtgtgccccctcccacccccaggctttctctggctgcctttgctgcctaactagtctgggtaggagaggtgccactcactacagagacttgttcccagtgccttttgcatgtgtgggacccggtccagcaatggcaggacacctgttgaacatcacccaaccccatggcagctgggccaggttgggaatttgctggcagctggcacagaggtgcccaggtgcagcagtgagagaacaggagcaggctgctgtggtaaggaggggtggggattgcccgggcagagccatacctggaggggcaccagtcagcagcgtgagctcagtcttcacacagacccctgccctgttccctttgagcgtcagtcccctcatctctacacttgagggggtgggattggacttggtaattttagggcctgccctctctgacatcttggggggctgtgatttctcaccaactgtcactgtgcaaaagcactgtttgacctgggtttgaccccagctctgtaacttactggctgcatgacctttggtaagctgctcctttctccagactcattgattccaatctgttaggagaactcaaaggataatctttgcaaagtgtccaggcccagggtccaaggtaaatgggttccactcttaacagagctgtacctcccctagtgccagtgtcccctctgaggccagcctcaccactgcccttttcacatctggctccaagtaacagaaaccccaacttggatcggcttaaatactaaggatatttattgtcacacaccacatcaactcacgacatagaatgctgccagaattggtggatgctcaggctcagaagcatcctcgaggtctcaggatctttccaacaccccgaattaccatcttcagctggctaacggctcatgggggcacttcatccaaatagaatgaaagaccagcagataagaggcagcctctctttttttttttgcgaccaagtctctgtcccccaggctggagtgcagtggcgcaatcctggctcacactgcaacctctgcctcctgggttcaagcaattctcctgcctcagcctcccgagtatctgggattacaggcgagcgccaccatgcccagctaattttgtatatttagtagagatagggttcaaccatgttaaccaggctgatcttgaactcccgacctctggcgatacgcccaccttggcctcccaaagtgctggaattacaggcctgaggcaccgcacccagcagcaccctctcttcttgtaggtggttttaaagagcaactggaaaccaaccttacccagccatccctcagcagacctccttcctgtctgattagccaggattgggttacatgcacttccctgagccaatcactaaggaggggtgtggctctgccttgctggtataaatgtggaaggttatggaggcggagccacccgaacccaagggccatctgctggtgatgaggcaaggaggggcatggtggtgggctaggtggccctcagtggagcctggtgatgatggcaaaggctgaactggtgagttaaggggtagatggcctgtcggacttcacctggtccagcctgctggaaccaacatagggtgggccgtgtaagttactcctaccccggcaccttggaaggggcccattgcccaacaggctgctcctgttgttctggtctcctacagagctggagtggagctccgggaagccatgtgtgcccaccaccatcccctcctctctcagccccacagctggcctgtccccaagctctcctggggccccttccatccccacagaccctgccctagtgctagcctcccctcaggcccctgccatccattctctgaggagcagccagggcatcccctgcctagcccttcccctgggccccctgttactatcacgacaaggcaaatcccactctcagccaggtccacaggccctgtgccctccagcctcctggcttatggctccagctcatacaggcattctgcagccccactggacagcttgctgttctccacacccacactgccccttcccacctccagcctccacctctgctgcactcgcagtctggaatggccttcctcttccttacctactgcccttgtccttcaggtcctccctgaggaatggggtcagaagtcatggctttctcctcgcacaccccagctcccacaaccacagcttgcttaggactctacatgtttgtgtgtgtgtgtctgtctgtctgtctgtctgtctgtcccctatcctcctggatgatggtgggctacagggtcgggggcagagtctggctctacagcaccccacaggcatctggaatggagaagccccccagagtcaacatttgctgagttcagtgaagttgaacttacatcttaatagcaaaacatccattgtctcctttaaccttacaacaggctttcaaagtgaggagtttgaggcatatccccatgggatgatgggaaaagtaggtcccaaagaggagaagggacttgaaggccacacagcaaggttgaggcagacccagacccagagccaaggggtcctagatccctagagaccccagcccagcatctgctcccagcagctactcctccagatggcggccactatgcctgggcagagcaggcagaggtggatgtgggtgggcccaggggaaataaggcggtgggcgtggaggggccatggaatgaaggctctgtccccaggggaagcaggtctgcctccatggctgggggttaatggcttttctgaagatcacagctgagggttaatgacattccataattccactaccgctgtggcccttccattagcatctgcaggcgatgcctgcctctccccgcccccatcctgcacacacatcagccacagtaccctcaccagggctctggcgtcagactgcaggtcttctaactttgagttcccaccactcctgcctgcacatgcacaagacaggctgaccctccctccccagtcctaggtctgaagtgatctttcctaagtgacttgccctgggaaactactcagggaaagggctgttccttattgggccggcagccactcaccacctctggcttcataggctccatttagacacatgaataggtcccagaaagggcagctagcgtctactaaataaccctcttccagggtaggagcaaggtatggacggcaggggactgagtcacaggtgccccaatgcctggcagacagtcccagccatgtggaccctcctgcacccaggagaatggggtgactctgggagggacatggtttggggatcaatcttgaaagatcactcccaagccccacagaagtcagaaccaacttctctcaccggacctgttggccaagctcccataagaagtgggatgttcccatcattgcagtctctgttcaggtgtccagggcaccctagccctgcagtgactgcaacccatctccccaggggcaggggcagacacagctgagccttgggctgggcctggacaaaccaggcccattagtgtgaccgtcatcagcaccctgccactgtggggaagtggacctacactgatatttcatgatcctgcatcaataactcctggagccgcagtgcatttgtgctgaccttttcgagcaatgactgattcctgtgggggagcaggaggtgggagcggctgctactgttgctgacagcccctggctggggaacagaggcaaggcagccacttggtgggtctgtagcaacgacccgcagccccgccctgtgctgggaccctgcagggctgcctgctgggagttatgggccgatggccatctcccatctcccaccttctggccttggcagatgctgggcctccccctggagtctctcctcatttcaggcgtcctctgcacagggtgtgctcagtgccactccacatttttgattgtgctgttttcccatcctgaagacctttatccctctcttcacccagccagaccttccttcagagcctttctctggttctgcttcctttaaggaggcttttctgaccacccatgggaatatttcatatagctctcttattgggcagtgctacagttaatactgtcttgtttcattgtttaaatcatacccatgtgtgtgccctaactgctgacctagggtgccatcaagtcccccgagtgcccactggcccacactgcgggcacacggagcctctgtagtctgcagagatgtcttggcctctgcaaggggctggggaaactgtgtgggaaagagaggggctggtgacacagacagaggtcatgtctaacttggcatctgtgacaccaccagccatgggtgtgaacacagatacaacactttaggaaaacagtttaccaataatgaatgaggtgtcctaaaatacacatgtcctataacccagcaattccattttaggtagttgtactaaggaagtaatttgcgacatgaagatatgtagcagagaacgttcaatgcagtgttattacagggaaaaatgggaaggaagaaatcagggcacttggacatgaacttcatatcctgaagttactcaagtcatgggtaatgagctttctgtgactttggatctgcttaggttttactggcaaatgaaaaatgcaggatgctagaatggtgattatacacaaaatatacacagaaaaaaactaggaagaagcacagttttatgaattattgtgtttatcataggaacacaggagctgtttttcttcttcctatttttctgcattttcctaaatgtatttattaggtgtgtgctgcatttatttgtttatttatttatttatttattttatttatttagagacggagtttcgctctgtcacccaggctggagtacagtggcgcaatctcatctcagggcaacctctgcccccccgggttcaagcagttctcctgcctcagcctcctgggtagctgggattacaggagtcccccaccacacctagctaatttttgtatttttagtagagacagggttttgccatgttggccaggctggtcttgaactcctgacctcaagtgatccacttgccttggcctcccgaagtgctggaattacaggcgtgagccactgtgcccagccagcttgcttttatagttgggagaaacatttgtgacaaatctagatacacaaaaccaaatatctgtgtatgccttgatttgggagaagctgtggcccccaccacctgctcctaccctctccctccagctgtccaagcctgggggacccccagagcagcccctgtggaatcagtccttcctcttccaaggccgagatggagctaccagcttctcagaagacacagccctggtgctggagtactactcctcaacttcaagtacgtgacccctggtgcctcgccagggcagccatgcctcaggagatctgtattatgaaagggtgttcagaccatcccacctctgcctcccacagggatggatggttcccaggtgtccaggcggcttcctaatgcaggcagaggagagctggctgcgttccttgtccacaggccaggacacgtgggcctgtcccatactaggtcttggccccaagctttgttttattgcacccatcagtgatgggggagggctggagccctcggaactcacagagaggggtgagggagatgggcttcagagaccagctgatccacagttttctgcactgtgggattgaagcccccaaagggtagagatgaggctgatgtatataaattcccagacacacagagtatgtttagagttggctttgagttcacaaagccctgaagatgagaagaggatgtatgtgcagggaaaggccaggaggcaggaaagcaggcagcgggagacaggaggactggatgtcaggtattaaaggatggggccgaggtgggggctttggcaggagccctagttgatccttcccccacagtgaaaggcagccagccgtggaccctcaaccagcccctgggcatctctgtgttgccgctaaagagccgtttgtaccagaagatgctgacagggaaaggcttggacgggcttcacgtggagcggctccccatcatggtgagccccctgccctgaactgggcccctagcgtgcccacctggccccaccctgcctcaccctgccccacctcaccacacctccataggagaatttggcttctccagaagcttctgtcaaggcacccaccagggaagtcacccagtctagaagtgaggagctccctggaaccccagaagccagtcttgcctctgggactatgacgaaccaagccagagaaattgcccctgagcaacttgggagacaagtacagggtgaccctgtgagacagtgcaagagttcaggctttcagccagccagaccctgatttgaaccacagttcaaatcctcactgtggaaattcaggcacattactgaaccacaagagtcctcgtctgtaacacaggagaagcatgccaagtacacaatctctgtgtataacaagagagttcagagctcaggctctagagccagactgtctgggtccaaattctggttccaccacataccagctaacatgaccatgggaaaactactgaaagtgtcaatgcctcagtttccttgcctataaaatgggtacatggcaatagcacttttttcatagggttgctgtgagatttcatgagaaaacccatggaaagcacttagagtaagttctcaacaagaatgaataatatcgttaccatcattctctattcctatgccaccatttcccctaaaatacttctggccatcctgacataatagacctcaatgaatgagaatctctctgtcagatgagcctggtagtgccagacaggtctctagaggggtttagaaggggtggtgtggaggcagtttgcgagggcaaaagcaggaggccagctcccacctccctcccaccctcctgggtgcagcccgcaggtgacaccttccagagaaatctagaacagtaggtggggcagaggcggaagctgccctggccagcatggtctgagtgctcccttttcctccccaggacaccagcctgaaaactatcaatgatgaggcccccacagtggctctctccttccagctgctttcctctgaggtaaggctgtgggccaggggagggtcagggccagcaggcacatgtcagtgagatccaacttccttcacaattgctggctttgttcagggacttctgggaggatgggactactactttggatagaaacgtctaagggtgatttgagactccagacaaacgtagagagagctgggattaggaagaggagagttgtgagcagagggccacccagaccttggagtcagcctctgaccaagcccaagccaagtctggctcactgggatcgaggttctgcaagggtgagctaggatatcagttttctattgctttataaccaaattagcagcttaaaacaatgcccatttattagctgacacttctatatgtaggtcccatgacacagggtggctggaatcaagatgttggcagggtcacattcctttctggggattatggggaggaatctgcttccaaattcattcaggtggctgccacaatccagttccctgcagtgccggactcacatcccggtctccttgcaggctgtcagccggggcagctctcagctcctgaaggacgcccacatgccccctcacaatggccccgttcatcttaagccagcaggcatgtccagtccctgtcacacctcaaaactctgacttcctcttctgtcagcagccacagaaaacttttagaggtgcttttagagggattttagaggggctggtgtgataaggtcaggccattctaatcatcttcctatcttaaagtcaacggtgccatgtaacaaacataatcccaggagtgatcagtcatcatattcacgggttccaagaatgagggtgtaaaatcttggaggcccgtttttggaattctgtctaccacagctgggttggtccaaatgtgaagacacccagggctaagccctgcctgctggatgagcctcgatccctctcgctagctacacctggtctcagcccagcttagaccctgctcatttggctgcagtgcacatgccaggcacccgctggactttccctctttcctctcagtggtgctgggatgtgagtagtttaggaccatgaacccagaaagtgtttgcagggactaatgtccgcgccaacccactcctgccttcttcccacgcaggaaaaatatccaccagctctggggtagcacttggctctgtgacctcactcatgaagaacacagggaatcctatggtgtggggtatgaggagtatatctgggttggtaccagcctgaaagtgcctttacaaggcctctggagagggcctgagaccccattagcactccctgctataggtgttcaggattgccctctcaagggtagaagcaacaaaccccaagaaagaggcaccagaatcttggagaaaaaggtcacaaacttcccagtttggagcccaaccctccggggcctcttcccaaggtatagagtctgcctgtggccactggccactgccagcccctccccacctccctctgtctcctgccccttccactgggcatgtgtatcctgggactaaaaggagcgtcaggtgcccctggtcaggggactgactagtgggcccaggcaggcaacaggcaggtgggcagaacagtttccccattgcccaggggctgggcacaaaggtctccagtaatgaattattcaccggagctgtgctaagtgcagaattaatccctttccttccagctggcggcctcactaaattatccctccaagtcatgcgggaaaatgctgccgaattcatttagctgctgagtgttttgatctgggccttgtgattttagcgtctccttcccccaaccccctccccctggaggcgggtaaaaaaccttttagtaatggatttctgagaagaaaggaaaagaaaggggatcaggattgggtgtgtaccaagaaaatagtactagcagaaattcagattctgcagccaagaattcacacacacacacacacacacacaccccctctacatatacactctcaatcacgtgtgaatatctacacacagtcacagacacacagatgtgtgcgcacataccttggcaagaaggatgcacactcttaacacatatgtacacgctctcacatacatgcaaactgacacacagatgttttcacacctgcagtggcacacacggaagctaaatctctttgtagtggaactatttcttggtaaactatctgagaattggccaataactgactccctttgattctagaatcttgaagaccaatttaggagcctaagtataaagtgctaatgtggttaaattcaccatgaagtccttgcagctgcagcacccattcatttattcttttattccatgtatatttgatgaggagtcactgcatgtcaggtagcatgcaaggcaagaagtagaattttggctgccattgtggattgaaatggggagaaggaggggttggcagccatggacctcattttgatttgagctcacaccttcattgggcttggacatggctctctagtgtctgagaccttttggcatccttctccctaagggatggcaggaaagtgttgagaattcatgaacaggtcagatggcattgcagctaaatctaaaggggcccatccccttctccatccctcatcaccaccttcactgcaataccatcattgttctctatgcaactgcaaacatttctgaagcacccacatgagcaattgctgttctggattttaggaatattacactgaagaagaagaagaaaaaaaaacaatcaggccctgtctttctaaagcttgcattcttagcagggagtatggaacagacaataaaaaaataattcatgtcagctaatgataaagggtctgaggaaactcaaacaaggtgacatgatacggagtccttgaaggggctatttggactcctcatggtagctgagtacggtgatgagctaagctgctataacaaagagatcaggttcctgcccccttattgttgcgcctaaggtgttgcctgcaacttcatcatggaaggtacctggtattcatctctgcatcctagactttgggaaggcagcagcagggctggggccatcaactcttccaccctttaaatcaaatattgcataatgggtccagaagccaccacctgacacctggaggtcttagagtcctgtggacactccagctgccgaggcttgtgatattgggcctctcaggcccctcgttcacatggtcaacaactccatcctaggggtagctctttgcatgtggtcagacatggtcagtgctgtcacagagcggaaatgcttcaggagaaatgaatgcgcgtgccgtatttgggcccagccccagtctgaggacataggctctttccatgagcctccatgtccaggagttttgggcacaggctgtcctggataattggacattttggtgaacacagcttccccacacccgccactaccacgtcacccattctcagagctttcagaagcagcatggtgaaatttgcaaataggcagagacagcagtggcctctctcaacagcccacactggacagcaatctccctggcagcacgtggtcatcccagtctctcctcctgtgctgccatgacagacagctcactacctccagaagcaggccttcctatggctgagtgatagaaatggccaccccacatgatctcaacctgcctcctggggacctccctctgccccaagctcctggctttgcccccgaggctgcagggcgacctcagcaagcctcctacatagatcacatagtcagccaacacttttgagggcagactagataacaaagcctgcagactcagtgaatggcaagaggtggtggtctctggtttggaatattgcacttgaaggtggttggttggtgatgggttcgtttttcaccctctggtaggacttctctagtcatttgctgcttaaagtgatctgcattaagatggcttgtgtgtgtaggtgagtacgtatatgaacacacacagatcacacaaaaactagaaaaacatgtacactcatatacaaaaacacatacacagaaaacttccctttattgcacattcagtggggactggcctttgaggtccattaggctctaaaaatccatgagtctggctgggtgcggtggctcacgcctgtaatcccaagactttaggagtctgaggcgggcggatcatgaggtcaggaattcaagaccagcctggccaacatggtgaaaccctgtctctactaaaaatgcaaaaattagttgggtgtggtggtgggtgcctgtaatcccagctacttgggaggctgaggcaggagaataacttgaacctgggaggtagaggttgcagtgagccaagatcatgccactgcactccagcctggacaacagagcaagactgtgtctcaaaaacaaaaacaaacaaacaaaaaaactccatgagcctatggctactccacatacacacacacacagaaacctttggtctcctccattcctcctctgatctcagcctcttctctttgaagagtgtgatgtggtctctggggagtctacacttccccaggcaaagcagcttggctctcttaatgaactggtttcgagatcccacagcatcctgggtgccctccagcttgcagccagcctctttgaagtgaggcccacactgcccaggtttcctgggctgaccttgtggattggagcctggcatgcacacagtaggtgctcactgcatcagttcctgcctctctgcctggaaatgcacctccccatgaggtgggacaagttcatgccgtcatctgggtatacagcaacatttctcctcttgcatttaagatttgggatccatcaccttgcccagatagggcaccaggcagaagtagggcctctcagatgggtggccacaccctcctcagcccacagcccacagacatgctgggatgacgtgaaaccccctggcttcctgggagtatagagagggtgcatttgaggagaggtggcagtggcacctgctgccaccactgaggggaggggcaggtgccatggtcccatctgaccttccccctccctcttcccctcatagggagagaggggggcaagtctttgatgctactctggtggcttcttttcagactagttacaaagatctctctggagaccagcccagagtgaggacaagtggccacttagcaaatatagaggaaagggcaggggacaggcagcatcatgctggcttttgaagaatttttatggattttttgtaagccacacctgacacccctgagatggtccttagagaaactgcaacacaaacctccctccatttcttccccaagcacagcggcctgaatgggccagtgcccagggcagcacagcagtctcctccactggttctgccctctgaaggctctgttcccacccccaagactccatctgtgaaaacactaccataaggatggatccagagagagagaccctttccctgccactatctcacaccatccctcactgccctcctttccacacccaaagcctctgccctcctatcctctcattgcctcaggtcatttggcaggaggcagaggagacagatccaccccttacccacaggtgccctttccctcacctgctcaggttctaggtccagtgtagagctcttcccatcccatccaaagaaaacttagagctgggcgtggtggctctggagagattaaatctgtatacctgtaatcccagcactttgggaggccgaggtgggcagatcacctgaggtcaggagtttgagaccagcctggccaacatggagaaaccccgtctttactaaaaatacaaaaattagctgggcttggtggcaggagcctgtaatcccagctactgggaggcggaggttgcagtgagccgagatcacaccactgcactccagcctgggcgacagagcaagactgtctctaaaaacagaaaacaaacaaatcaaaggaagcttaggatggggcaggagagacatgagagtctgtgctttcacaaggccaacctggcccccaggtcacagactctgtgtcggagcagggctggccatcccacctctcctcctgcgctgccatgacggaggctcctacctgctttccacaatgcctgaatccccctatagtgttccctgccttggggacaatattggcctcccttggtgatcatgcaactcccatgctgcccacttcagagagaaggaactgaacagtccctccagaacacacacagagtttgacagactctacttggtcatttcccgacagagagttcattaccacccaggatgccctctccatcctctactagctcccttctaaacttccttctgtctctcttcaatttcctccccctggccctgccttttcctcccagaggccaactccagagaagtcagggcctgtcagccctactgacatttgcaaactatttatggcatctccagcctgaacccactctcattcctcttcctctttgtagcacttggtttctgattcttgtcctgctgattgtctcctcttgacaacattcctgttaaagtatcccccaaaactgtggggcccaatcagcattagaggtagagtaggaacatcactccctctctctgaatacattctcccctttggtgcagctgaagcctagctttggttctattttagtatttatcaaagcagtgagggtctgtttagagccagagtccaactctggcacatcagtaagcagcatgtctgcatcttgcctccctgctgttctatactgaacttagacagggtttctctcccctgtggtatttcaccttttttatctcagcccatcttctaagcttgagatcattctggaccctgattttatcatgcaacacactcacagccccatctgtacccccaaccccaagctccaggtcatctgtggaggtggccaagacacttgaagtgctgcaatgtccaccttgtaagcctgtagacctgggcttgaatctggatcttccatttgatcttagccatcctgagtttcactgttctcatccataaaaggggattgtaatccctaccagccaggaacatagtgaagattgaatgaggaagcatgtgcaggtaacctagcacagtgtcctgcagatgctcggtaaagggatctcttagtgtctttcacccaggtttctgacaaacatgctgaactcatcagggatgaggacagggctcctgggggaggggagttggtggagccctgcgaacccatcactcggtgcccgcccctcatgacagctgctccaccagcttcgcatccataaggacatcaggaggccttgtcaggtgctgaagataaacatcgccagcaccacatttggtctcgctgcaattttctgagaatgaaatgggggaagagacagacaaccatctctccagaagccagacttgctgaagtcctcaatgtaccctgccctgagttgggggctgtggagcctaggagctcccaggccagaatgggaagggctggatggagaggcatactgcttccaattgctagtcattcagaagacctgctttagctcatctcaaatgtctcaccaggctgggcctagtggctcatgcccataatcccaacactttgggaggccaaggtggacagatcacttgagctcaggagttcgagaccagcccgggcaacatggcaaaaccccatctccactaaaaatgcaaaaattagccaggcatcgtgttgtgcacctgtagtcctagctacttgggggcgttgaggcaggaggattgcttgaacctgggaggttgaggctgcaatgagctgagatggtgccacttgggggtgctggggcaggaggattgcttgaacttgggagattgagtctacagtgagctgagatggtgccactacaccccagcctgggcaacagagtgagaacctttgtctatttatttttttaaatgcctcaccaaccacagaacctagtgttgccttgagaatgtgagcctacaactcccagctgcagatggtgtgtattaagtcagaatgcagagatgactgagaaaactggacattgaacactcccttcccttgctctgctctccctgtgagcccagtgcataattggtagattgaagaagggggagggaaggaatagagagagacatggcagaagcttctagacaaaacttctcagaaaatgggagttggtcttgggatttccccccttctgaaaacccaaccaccttagtatagacctcccttcagtgctttcagccaagatgtatctctggcccagccaaggtcattcattcattaaccatttgttaggtttcttttcctttttttttttttgagatggagtcctgacctgttgcccaggctggagcacaatagcatgatctcggctcacttcaacctccgcctcctgggttcaaacgattctcctgccttagtctccccagtagctgggattacaggtgcccgccaccatgcccagctaactgttgtatttttagtagagatggggtttcaccatgttggccaggctggtctcaaactcctgacctcacgatccacctgccttggcttcccaaagccatttattagatttctaacctgtgccaagcagtaaagcaccccaacagatcactatcacccatcttactaagggtcctggttgagattggtgcattgaatatacagaggtcagggcaagcatcacagaaaggcatggtttgagctctgttccaaatagtgggttggaaattggcaaagcaagggtgcttcaggcaaagggacccccatgtgcaaaggcatggaggcatgacagtgtctggagcacatgacatatgagaactgtaatgggcagtgagactagaaagctagaagaagtctagattgtagaggacctgggtgctagggtgcagggtgagggctttatcataaagtggtaggaaactaagaaaggtcttggagcagcagtaggatgtgatttcatctgtgttggaaaggtctgtctgcatgagaataggggaaacccaagggaaaaaaataaattcagaaagccaggtttcagggtaacaagagtgagcccacagtcaaaccactgagccacaggcaggactttcatactaaaatccccaacagaatttttaaaaattcttatcagtggcacccctcctctggcctcaaaatgtgctttgggattaaccctctaacaccacttctggcaaatgaatcatggccccaccaaggattaacactggggcccttcttggctgggagacagacccggagcttcaaaccccactgcagctgcaagagcacgcaggatgccataaatgaggctcgctgtatgcaggggaggcagcaagccctcttggaggggcctgttgtctgagcttcgcctacagctgaagagataagaacctacaactgcagccacaggaaatgacaaagcagtgactgatcggggaactgctgcacagggctcattatggcgcttgccagtgggcgagacacccttatcagggagaaaattgcatcaggcctcctgaattactagcgattggaagcagatttcttgggactcactttgttagatacctaatgagcgggatacaggcgggcagagcccaaagccagcggggcgagggacaaatgtctttgttaaacagaatttgtcagtttccgcttcaggccccctggggagggttcagggccagctaattgaattaagagcatgtgcgctccagcaagaaggctcagggcggggcgagaggcaggcaggccggaaggcgggcactttcagcaccaaggacagcagctgcagcctggctagtcagtaattgtggggcaggctggaactgctgcattttgcatgattggggatctaggggatggaatgggtaggaggaaggcagaggatgttgtggggaggagggagacaggtgacctaagaagcctcaagcctgtgatgccattggcctggtctgtctcaacagacccaactctgctaacaacagtgagtgctgggaggagtgaggaagggatgtcttctccccaaccatggcactcacatgtggtgtgggcagctgcaacaacacagggagcagtgagctgaatgctgggtctgagctagtgcgtggccatgcatctctttgagctttcaaagtcaatctccaattatagtcttaatgaaccaggatgtgctgcagccacgaagccatggggacaggggccacttgtcagccccaagctgccccagcaggcagagcaaggcttgtcaaatacagaagcaaataagtaggcttgtggggtgggccagcagcccccaccttacctggaggaaaggagagcgaggcaaggctgggcttgattaggaggagttagtcttgggaggagttagtctccaaggctcttcccatcctccaccctgactcaccatctcctatgggttggctctttctatggtctcgagcagcctggccctctctatggtctcaggcaagctcccttccttgagaagcaaggggctgagggcataatttccttccccaaatgtgagctgattgaagctgtggagtctggagaggcaatgctgaccctaaagaaggagaactattagggagaatttagacatgatggatctcttggtgcccgtcacctcacatgacaaaagcaactccctctgatgtgccctgcgggatctgtgctgtttggaggtctaaagatttcactataaaattcacctctccaccttgcctccaaatcccaggccaggatggatcctggcaaagttgaatgggacaggggaatgggaatgtgggcagagacctgcaggctggggaggtacaggcatggagcagccatgggagcagatcctggccagggccagccccagggtagggcaggacagaatcattgagtctggcaggcactacaggaagggtggctggagcaggaatgggcaggatagacttaaagtccataggtactctgccttgcctgccctccttccccgagcccacccccacctcaccccataagagactgatggggtaaaggcactggtctggactgaggggttgttcccacctttattttagctttgtgatgaaattaaatggattatacatggtaaatttcagaatccacatacaagtacctggtgagtgcccagctctgaccaggggctcagtaaatgtcagctctgggttattgcattgacccatctggtgctggggccacactgagtggatgtcagggagacaggctatgggggagggaactcctttgcaattgtccctgctttcagtactgatgggggcacctctggagacctctcccttgatttcattacttctacttcctctcctaactggattagatggcagtctatgaaatccagggcatagagattggctttctgcctggaaatgagcagaaatgtcattataggtcctgaatcagcatctcaccacagccccaggggccacctggtcaatgggaaggtggtctttgccctgtatttatgctttccttcattctctcctgcattcatccatccattcatccacccactcattcatccatccatccaatatgcattttgtagctcttcctctgcagtcaatctagtgttcagctgttccgagaaagagacagatgtggtactttttcctatctaaaacacatggccagaaaaccctaaaccatctgactcagatgctaccctgggtgtcttcacgtcagtggggagcctccaagtgaagcctgccctctgtgagccatagctactgagaggaccaggtgggagagagagccaggcctgatgcccacagacaaaacaggcccaggagtcttggtcatgaagtgcagtaggtggcctgccaaagtcagcctcggggtcccccagtgtcccactcttcccattccaagagtcttattatagctgctttctctttggcgttgtctattttgcacccatttgatggggagttgggggacatagagcccagacttagccaaatgcctctgtgtacttatgtgactgtcccttactctatagacatggccagaaacatcttcacattaatgaatttctgcacagcaaattttatttgaaaggggcataaaagaataattacttaaagaatttcagtggtaaagtgaagggtccttgtctcaattcattgaattagtatgcatggactttcctatagaagaaccactttaaaagaggcccacctgcattcattccctctctggttgttcagggtcaaacacctgggcacctctaactctgagcgcatctgtactggttggcagtgtgcccattgctctatttatttctagcacaagactccagacagtggaataatttgtctgctatgcagccaagagaggattccaacagctggtgcagggtggaactggctcacttttgaggtccctgaaaaccctaggactgcatgattctttgaacaatgagtatgttttagagataaccatgaatttccaacagggctttaaagtaacccttccccaaagggagcacagacatgtccctaagcccaaggaacttaaaattttatttaaaaaaaaaaaacaaaaaaaaagcagccaggcacagtggctcacgcctgtaatcccagcactttgggaggccaaggtgggcagatcacaaggtcaagagttcgagaccagcctggccaatatggtgaaaccccatctctactaaaaatacacaaaattagccaggtgtggtggcggatgcctgtagtcccagctactcaggaggctaaggcaggagaattacttgaactcaggaggtggaggttgcagtgagccgatatcatggcactgcactccagcccgggcaagagagcaagactctgtctcaaaaaaaaaaaaaagaaaaaaaaatagcaggcaagtctggaattagcaacatgaaagcacagacagccaactgctagaccagaagaacccagaaaacctacaagtcagtgtgagctgagacatcaagtcatccttgggcggtgggggtgctggtatttgagtggcatcagactttagacatatgacagtgataatcctgccaagggagaaggaggagaacgggaaaagaacatggagggagacgaaggctcatcagaatatacagagaggagagactgtctgcttaatgggtggtaagattgaaggatgatagaggagatgaaatggaaaataggtctacatagcaaagggtgtcaaaagagtgtaggattttagaagctgttgttactgcaccaagtgtgggtgccagagatggcataattcatttattcttccaccaaaaatgtattgagtgcctacaatgagccagagactagggatagacaaggttccttgctgacatgggactcacatcctagcatgggcatttgcagaaggaaggcagttaagaagtaaatgcatttttaaattttctggtagagtaggtgctatgaacacagtaaaatgggataaatgaatagagagtatattggaagtgggattactttagatagagtgggcctctatctcaaagtgtagggaccctctgagcagatcacatctgggctgagacttgaatgataagaaggagacagctgcgtaaggatccctgaggacctccaggaagagaacagcaaatgcaaaggccctgaggcaggagcgagcttggcttgttggaggaacagcaagggccatgtatttgggacccggtgagcaaggggcagatggtaggaggtgtgcacgggccagccatgcagggcctcctgagccatgaggaggagaggcttggggtgtagatggtgtgcttatggtagatgggcacagagaaggggcctgtcctgaagtttctctgcaccttctcttctcagagaccagaaaacttcttgacaccaaacaacagcaaggctcttcctaccttggaccccaagatcctggataagaagctgagaaccatccaagagtcctggtccaaggacacagtgagctccacaatggacttgagcacgtccactccacgagaagcagaggaggaacctctggtgcctgagatgtcccatgacacagtgagtgtctctccccaggtgggaagggccggggcagtgatgaggccatgggaaggggacttgactgccatctgcaggactgcttcatgcctcaggtggccagtagacctccctccccttaggcacactctgcatgtgagttaccccaaagtcaaactgctgggcgctgtggcttcttcgtttgcagggtctcttcaccttttgagtggaactcccgtgtaatttctttcaaaacaaacccatgcaacacttgtaagccagggttccatttatgtgtgtaggcatcaactcagaacttcctgaggtgcatggccactgggtagtgggaaacacctttaagagattcattttagcttataacaggagaaactggggctcaaaaaaagaggacaccagctgggcacggtggctcacacctgtaatctcagcactttgggaggccaaggcgggcgggtcacccgaggtcgggagttcgagaccagcctgacctacatggaaaaaccccgtctctactaaaaaaatacaaaattagccagacgtggtggtgcatggctgtaattccagctactcgggaggctgaggcgggagaatcacttgaacctgggaggtggaggttgcggtgagccaagattgtgccattgcactccagcctgggcaacaagagtgaaactccatctcaaaaaataataataataataataaaagaggacaccaattctggtgacatagtctgtgtccttgatcatgggagctgctgtgttttcctgttgctggttgagcagatgctcaggaagggctggtggaggtggccaaagtgacatcctaatttgctgaggagtcagtgctgggtttcagccctcgatgcagagagctaaagaatgggctaccaaagagacagtccagggaggtgctacccagtaaccatggctgaattattgggtagcttcctcccttcttccacagcgggtcccatggggaacgctgctctggaagatcttgagaaaaggccccagacaaggccaccagtccacagggaagtccaagccatcctcctcccaggacctgacctcctccaccaacagcctcctcatcttcccctggcacttctgcacctttctggaacatgtcccatcagacgaataggaaggctggctgtctgctgggcatgcccagggttcttccacatgagcacccctgcccaccctggagcagggccatcctgctcaggcaccacagcacttatgggccatctttacaattttctcccgtcacctctggcccttggggaaagagcccttgggattaacatccagctcagtcataaactgcattgaaaataaagaaaccctgtctttggagatttggggcagcatgaataaaccacttgctcctgccctctccacatcctggcctcgtggttcccccttcttgtgcctctaagcagaggtagtaaaggaaagagaggccaggtgcatggcctgcatctgtaatctcactacttgggcaggccgaggtgggaggatcgcttgagcccagaagtttgagaccagccctggcaacataatgagatcctatctctacaaaaaattcaaaaaattagctggacttgttggtgcacgtctgtagtctcagctactcaggaacctgaggcaggaggatcacttgagcctgggaggtcaaggttgcagtgagctatgatcgtgctactgtactccagcttgggtgacagagcaacaccctgtctcaagagaaaaacaaaataaaagaaaaaacaggccaggaaagaaagaagagggaaggtgccatcatggggaaaggcacatgggaagggaagagaaagaaggcatccctccctggtctcagccctgtggagggctcagagcaacctctcctgctcagctgccccggaggggccaaccagccaaccctctgccctccccaagctaagcctccaccttcccccaaggatgcagacctcagcccctgactcacaccacctctagaagcaggaaccacaagcacctcctggctggacaagcctctcacatcagccatctgggcactgacatagcacaaccaaggagggggaagtacccagccctgctcctagtactgggcatggcaggcagtccttcgtttggagtctgctgggtaaagcatccaaggtctgaactgaggtcattaggtctgagagtctttgagagaaaccagatacagatgtcttaataccatggatttgtctgtgggaagtgagacacaaattgctggggtgggttgggttggagtctgcactgtacttataaaacttgatgatgatgatgatggtggtggtgatgatggtgatgatgatggtggaggaggagcagagaggaaaaaatagagtggaggaagaaatggcctttaaatatagaatggatctgagaggtaggcaatataaacaatgttttcaacatctgaaagaatattagaataacatgggtagagggccagtcttgattttctcttaagaattaaaccaaaagagatgggaccagattgcagcttgagaagtcaaggttagccattaggaggaagtgttttttggttttttgtttgtttgtttgttttcgagatggagtttcgctcttgttatccaggctggagtgcaatggtgcgatctcagctcaccacaacatccgcctcccgggttcaagagattctcctgcctcagtctctcaagtagctgggattacaggcattcgacaccctggctaattctgccttttttttttttttttttttttgagactgagtctcactctgtcaccagcctggagtgcagtggtaccatctcagctcattgcaacctccgcctcccgggttcaagcgattctccttcctcagcctcttgagtagctgggattacaggcgggcgccaccacgcccggctaatttttgtatttttagtagagacgggctttcactatgttggccaggatagtcccaagctcttaaccttgtgatctgcccgccttggcctcccaaagtgctgagattacagacctgagccaccacacccagccaggaggaggtgtttttgagcaacagtaaccattgtgagcgacagaggagtaggcagagaaagaagcagcctgagcatgctaggccgggattctgggaggctctgagtgataccccatacccacagactgcagaggtgttgtgagctgggtctgatggagaactcactcaagcatgcccaccctgggcatcaccctcagcactcccatcagtggctcattcacccggagagagtgttcctggtccctctaccctccctcttgctggacacctggtgaggccttaaggactggctgctagccctggtttgctatcgggttagggccactcagccaccaccatccagtccttgaactaaagaacacactgacttactcgcctctgggctccagagccctgcccaggcctggtccaagacagatgttggtaaatgctttttgggcaatggaatagagaacccctggctggacagcaagagaatcagaaagaaccttagaaagtatctagactgatcctctcattttacaaagggtggcaatgaggtggcccagggatgggcaggaatgggcctgcccaaagcttcctgacatggcaatctcatgccaccttgcatccagccaaggaaatactggacactacagaggcctgtatgctcagtcaacctggcaccatcgggtcccccagagactcatagagtatccagggcagtgggtatgcccctctcccttacccatcccactctgttccaggcacgccatccctccttgttcctgactcttgactacgtccttgtttatcctctcacctctggttcggtctcccaactcatcatttctctctctcactccctctctcactcaccttctcgctctcactctctcgctctcctcagatttaccaggctggctatttctacttctgacactttgccctagttggggcctagagacccagcccccagccccagctcctacccactggccagtgcccagaaggatcatggcaggacccagacacacatgttcacgtggccagtagatcccagttacaggcagtagaacgtgggtgagtagcaacagtgtacggctccatgacaagcacaggtagcctagctgtgtagcaatgggtcactcttccatagcaaccaaacaaaattacatagcaatggatgaactcaagcgaccatgaggcacagtgacaagcaatcgaacgtggccgcggagcagtggagtgtcgttgcataacaatagacccagccgtagaagcatgtcacacagccctgcaccgcaggagggtgcaatcacgggaatgagtacggagcacagtgtggaagacgtgggcagacatacagagtagtagcactgggacacaactgagtagcaatggcacggtcacagtgtgtgtggctcctggacatgcggccagggagcggtggccggcagcaggtcccagggctggagcagcaggcgccagcgacatggcagtggttgagttgtagtcaaatgaagaaccgcctccctcacgctgggccgttgtctccggctgagcctcttggcctcccctgatttcaggagtgtgtttgtctatatccagtctcatcatgcattccccggagcccaaaaaacaattttatctctgattcccttcagatccgacttcagcttaataggaaattgaacattttctggagagaaaagcgctctgggaatagatgagagtggagaagaggaggtctatgcctctctgtgcaatgctgcctgctgcccctggccctgcctgtcccatccccatggctcactaagcccactgtggctccctgtccctggatgtgcccttgatctacctcattcccagactgcaacccaaccatttcttctcaccttggaacacttcgttttgatgcaggcctttcaagttccatttggtcaacatggtacaaaactctggtcctgggtgggcccatcaaggtcaaggtcccatgggtatggtcttgggtcaagtgtagggcctcaggcagaggtagaggaagccttatctcccgtctgagtagctcaggaagccattgggaagaggtgagcctttaagtgagtgtgaagagtgaggtgttaaggttcatcctgaacatggcaactccccaaatagtcaacagcctgcaagcatctgccctccactctctgggcaccctgagcccatctcacacggagccaggccatgcctcctgacgccaggaggggagcaggtaaggcgagggggctctatgccacctctagatggaccgacttcctccacaaagggcttctgaaacacctgccatgtgcctggactccccattcctccagcctgtcagaaaaccagaactctccaccctgccatgtgcccagccctgtgtccagctggggcagggacatggggacaaagaggccaaggacctcagctctgagaattccccagtggacaggagcaagccatacccggggagacgattagtggcacagagtaggcacacagtaaatatttggtgggggatgaacaggcaaaggaggggcatggttgggacaatgtagctttttaactgccacacttacccagcactcctggacacacctagtgagcccttagtgaatgagagagagctggggaggtggtggatagggggagaggcaggcaaggaagtcttcctggaggaggcagactatgctttggataaagaaaggcagatgtgctcatttactatggaagaattgtgtattcagtgttgtttccagcacagaaattcaagcacagggttgcttccctcctcttcctgtctctctccctgtctctcctgctctctctcgctctctctctttttctccctcccccctctctctctccacctctctctccttctctctctctctgcctcctctgtttccctccctccttctgccttgctcagaggagatttgtggcagaccagagggccctcataccaggagatgaataattgacaagggttgttaaaagattcagtggagtttttccaacctccttacactggaataactcatttctttcattctgtttttgaaagcctttccccctccctccacctgtctcctccacatccccgccccctctgagcataccgcttttgtttctcttcctttcttgagtctgctggaccctagaatgattcggccttaatccctcggtttctctaaatccccttccccagctgtccccaccccacttgccgtgctccggaggtgtaggttgacttcagcagagacagccccagatcatgagtgcagagaggaaggaggaccagggaagctgtggcctctcccaagtcccagtgtgccagaggtgggctcggtcctcagaaaggcaagcctcccagcacagggacccctttcctcgcaggcaggcggaggggtgctctggggacgctgggtgaccatgtgccttggtttctccatcttagcatgctgcttaccctaccctacctgcctctcaggatcagatgggagaggtgaggccccccagaaagggcggctggccgtgtagcagagacaccctgagcctagtcctttctgtccggctggcatggccctggggtgaccacccatccctgtctgtccaggactgacgggtttccagactatgaggtgttcagtgcttaaaccaagacagtcctaggcaaacctggatgggggccaccctacatggcacagaaacctcccctgtcccaggtctgccccactggaggttgccacactctctaccctgtcagcctccctcatccacagggcatactccccctgcccagtctggcccagctccgtgctgtccatgcactcatagtgctcccactgctcctgcaagtgaccttgaccttccttcccttctctgggccccagttcctgcctctgacagcacaggcggttggagcagatgttcctgagtgccctgaggctcctgcactgtggctgcagccttggtcctgcccccagacccacacccaggatggggtctgcagcctggtgaggccgacagcagagcagtcagacccggcctccactcctcagcaccacctggtggcaggtgattaactctgagcaggagtcttttgaggctgccagcagcagtcaccagggaagggacttggagcacccctgcacactacccactttggtggcaacaagcagcaggaacgtcagcctagggtggtgacattgcaaagccccgggagcctgggattggcccccaggagcaggaataagcagcccccccagggccactagttcaggcaccaagcccagcctgggagcagggtcacccagggtctgggagtacgagagggcccaggccccaggtcctttggaaccaagagaggctgaggaactacaagagaaacagggagtgagacagagacagagagcagagccaaccagggcccacccaacggcctccaaacagatgcccttgactcagtgtccccttcaggccatcccacaccagccacaagacacgttcccaaaacactggccaccccagccttcctgctgtgtcccctcagtctccgtagcccctgactctactgcccagcgtgattgccccatttgctgggtttgtgctctctcccagtcacctctccaagcatccctgttctgtgcagcacacactcacgagctcccgcccaggcccagctccccgaaggcaggaaggcttctcagggccccagccctcctcagctcctcccctgcactcctgcaggccccgagctgggagcaccgcctgctgacaggggctggagggggtcctacaattaaatacttaagacaaggcaaccgacctaagccatggctgagaacactcgccagctcttttccctttcctgtccctcccccaactctgacctttttctctccaattcctaaacacaatcacacacagtgcttaccaagcattttagcgaggaagggagggagggagaggagaagggtagaaaggaagaaataaggatcacatcccacatgtgtctgttacttccctctgcagacccctcctctcacctgcatagctcttgcaggtttgtgttccatctccaccactccgaagctgtgtgaccttggataaatcactccacctctctgctcctgtctcctcattgttaagtagagggaacactgtcaccctgtccacctcttgagactatggggaggattaacaagagaatgaggggcaatgtgttggaaactgtaaagggctgtccactttgcaggagacttaatagtcactgtgttcctggggccctgcgatcaaggcggagaataaaaaggaagcaaaaatcccccaggcctctccctctgaccctttctccggcagggctgttcccagacccctgacccacttctcctccctccttcccccatccctccgagtctcagcgggccattctcctcctccatccatcacctgagactaaagagattaataaacgagactcataactcagctgctgggatgcagcagatatttacggctccgtttcaatttgcagagagattaagtgtttgtcgatttattgtctcttggtgtgtgcaagcggctgagcaaggccccctgcaggccagtcccctcccccactccacacgccctgcacatgtgtgtgggtgcctcgcctcccacccccagcccccagccctggagctggcggggagcctggtgctgctctgccaggcaaagctatgagccagtccggtgggcctgtcttcctgaccgacttggccaggtacctaagctgatttagagggcccactcacactcctccagccttgtccctccccacctggctaggtaaatgtgccccagatcccaagctccacgcttctagaacactctgtcggtacccaagacccccgaatgggcctgaacctgcttctgcttcttcttcttctttttttttttttagacagagtcttgctctgtcacccaggagggagtagtgcaatggcgtgatctcaactcactgcaacctccgcctcccaggttcaagtgattcttctgtttcagcctcccaagtagctgggattacagacacctgccaccatgcccagctaacttttgtatttttagtagagacaaggtttcaccatgttggtgaggctggtctcaaactcctgacctcaagtgatccacccgcctcgccctcccaaagtgctgggattacaggcgtgagccaccacgcctggcctaaacctgcttctgaggactatgcaagcttaaatctacacttctaagggttgaatacttttgcaagggtgcaccctgagacccaagaagcaacggctgtttgcagagggcacatgctggaagcctccatttctgttcttgtactgggcactacagatattaggggtgggcctggagaggggaggcttccatagagaaagccccccagcctaactggggagaagtctgcaaaggccaagggaagtgagacagcatgaaaaggagcatcacccaggggctaagggggaagtactcaaaccccaaggatgagcagtgcttcaggagccaagaaggggccacatgagcacagggagcaaaagtgtctggtgcccccaacctcctcagacccccagctgtctctcctttccctgttgactttgtattctggcacaggcacctactcattcattcatttctggtacatgcacctactcattcattcatgcattcattcatttgttcgaccagggttttgagcatctactctgtgccaagtctggttatctcgccccacagattcctccactcatttgtgcagccccagcaggtatgagttccatttccacctcccaagagctgtgtggccttgaaaaaatcactcaacctctctgatcctgtctcttcattgttaagtagaggaaatactctccccgcctcttgaggcttttcagaggactaacaggagagtggatggcaatgcactggaaactgtaaagggccgtccactttggcactttgcaggaggcttattaatagtcgttgtgttcatgggatccctcgagactgagggggatgacggaaggcagcacaactcacccaggcctctccctctgaccccctctccagaagttcacctccaagatatgtgacagtcacataaagataattccgtacaagggtccctgtgctcaagaagtcccaattgagcagggagacacatcaagaatggctggaggaggatgtggtcaggactggggctcagggtcctcaggagattgtgggagcacagagggggtctacctaatcctaacccccatcaactcccaccccaggcagtgcacactttctacagaatgccagggtagtctgcagatgtcactgtgataagcaagagagaaaagccaaccaagcatcagtggcggttagcatgaaaccataacagatctttgatttgttggtggaagggaaatgaaattcctcttgttcctgcaagaggaatctgttgatctgttgagtgggaattactagttagtgtgtgtgtgcctgtctctctccaggcctggcctggggtctcaccaaaaggcactgtggggccccagggctagtcccttccctgtctggacctcagtttctctatctgtattaatggagcgaatgcctccctccagtgagggatgagaaagtcttagcggtgtggaggaaagaatggatgggataggtggactagaggactggtcaagtcagggcctgccctaagtacccagaagatcaggctcagaggagatgagaacgaggtcactccgggcagaggccacccagagagagagaaaatttactgccgagagagggttgggcaggaggagcatcaggagacatggagtcagttctgacttgaggagtcagcctgactgacccctcccctcctgggcctccgtctcccctcctgtggagtgaggagcctggtcttgacaatttcctctttcatcccagcaaacaaggcaggcagaggtgggacagcctcctggcgctgctccttagtgagatggccggtgctgccaggtcttgctgtccatccttaattaaatggtgggtgggcgaggcaggagtggagcactctcggtaactaaagccaagatgatgaggccataaattgctgagggcttgaatcatcgattggtgagggtgaggtggactatagaaccaggagcgactgggagaaagagttgctaacctgggaaatggggcttgtcccttctgtgctctgcaagcaccagcccaaccttagtactcattttaataacactaagtgttcccatcaagattcactgagctcgtactctgtacccagaacttcggtcacaatctcatgtaatcctcactccagactgaaaaggaacatacaattatcatccccactttgtgggagaggaacctgctgatagcacaataaccctcccagggccaccagacaagaccgagggggagtcttggtccaacacaggttgggggtctccagcctagcacttgagccttggccgagcctggtgacttggaagtcaggagcctggtgagcttaactcaccatcttcccagcctatctgggaggaagagctgcctcagtttcctagtaaacaccaagacaagctctgtggcctcaggccaccccctgccgagttccacctggaacatttgagagtataagcaaggcctacataccatatgtccaaaccccagtaatcaaaatataaatcaagcagaagctagcaaactcctaaatatgttccattcctctacctcaataaatacaccttatgaacaacctcaaagaattctcagcttccacactggcccctggcagtatggcgagagccactcccaggcccccacccctcaaccccacccatccccttttcttctcacacagctcaatttcagtcccacacctatgagactctgtgggctctctcgagtgcataagggtatactgccaccttcaggaggacaggccctggaagcaggggagtgccaggatcccagttacccagggtgaggtctaaagcgggcacgggctctaggtgggcacgtcccccttgggaccactgactcctcaccccatgggaagggttgtaccccgaagagggccaaagcaggacctttcaacccacggggcccagggctggagcccctcttgtccagggctaaaggcagaactgtccctcccccaaccctcaccactagcttggtgactctatcagggtgcactcctgagttcagattaaatgtttttcagtacaatccaatttcttcctgacacacggactagaaaagcccagtccatgtgtgcagacagacagacacacacacacacacacacacacacacatttggtgctaaatatccaatcaagtccgcagataatagagaccagccagttcactcccagtttaatcagataaaatgctcattcatcggctcctgccagagctgccgtcccctccttagggcggagtcgagggggcggggagggcctgtgggggaaggggctgagacccgagtggcttgagcatgtgggctgcgcctttaaatcttcaaggaggggggacagcgttgcccacgggggactaattatccttcagcctttagccagctcttactcaaacagacaaaagggggctcagcatctctggtggcactaagcctctgcagcagaatttttttcactctcagatatgcaaatccacctccacagggtggaccctggggttgggctgcagaggggctcggggatttggaagggccaggaagagcaatgacagctggaccctctcagaggactagtttgggactggaggcatctcactcttcctcctcaggctgggtagggagccattcagtagggagctgccacgctggtagggagggtcctgtggaggccaagatgaagacctcaccctcctgccttctcctgtatgtgggtgggggggctcctgtggagggccagtgggctcactcagagagctggctcaggatctgggagctgaccgtccagatggggccctcctgcctacctcagccttcctcctcctaagacacagccaccaggtgacctgtcccaagcccaaatctagacatgctaccccccgccctgaacccatgcattgttcccttgcctgcaacaggagcccctcagcctgatgggccctggggcttctgaagcccctgcctcaagcctttacctgaacccagaatattctacccatgctcaatggcagtggtgcctcctcccagctccaggcctgtgttcccggctcactccaccttgtacccctcgcccacctccacaccaggtgcctggcgtgcagtgggtgctcagtaagtgtgtgctcactgaatgcacagaatgcccttcctgagcagcttggtggaccaggggtggtctggatcacagaggtgtttacctcctactcggctcccagccagcacctacaggaacctcagtctctttagctgggaaagggggacagtgctagcccttatccccaggctggctgtgaaaacctcacagtgcctggagcggcttctgtgagccatgaagagcttctggcgcctttttttcctacagtggggagtgaagagtacagtgtaggagagtgcagagggtctgggaacaagcttccatctctctcggtccctccaagacccacatcttacaccactattggccactccttcagggaatctatttatccactacaaatggatctgtgccccacccgttccagaccccccaagtcctccaccagccatctcaacagaacagcctggactttaagtatgaggggaacttaaaaactctgggagaagctagcgcagtggctcacacctgtaatcccagcactttgggaggctgaggcaggaggatcacttgagaccaggagcttgagaccagcctaggtaacatagcgagatgccgtctccacaaaatttttttaaaaaattaaccaagcatggtgacacgtgcctgtaatactagctacttgggagactgaggtgggagaattgcttgagcctaagaggttgaggctgcgggcagtgagccatgtgcccgccactgcactccagcccggatgacagagtgagaacctgactcaaacaaaataaaaacaaaaacaactctgggaagatggttaggaggcaggactggagatgtgcttggtgcagaaggtctggctaatcagaatttgaattctgaggccgggcacaatggctcatgcctgtaatcccagcactttggaaggccgaggcgggcagatcacgaggtcaagagattgagaccatcctgaacaacatggtgaaaccccgtttctactaaaaatacaaaaatcagctgagcgtgatggtgcatgcctgtaatcccagctacttgagaggctgaagcaggaaaatagcttgaacccaggagacagaggttgcagtgagccgagatcaagccactgcactctagcctgggcgacagaggagactccatctcaaaaaaaaaaaaaaaaaagaaatttgaattttgagaccgactctgaggggcctgaggtggtcagggggcatcctgagagagccagcagggagggtacccgccagcagcgagagtgctgcccccaggaagccccctcccttcattgccacctgcatctgtgaggtctgggccctggatttccattacctgagcagtgggcaaggctgagcaggctgtagagaaggttcccatgggggactctcagggatggggagagtgaggtgtgagaggaactgaggccaaaagaggctgggtgacaggcaggggaggtggggggctctgaaaggaccaactgccttgaggctcaagcctcaagaggcaaagctgaacacagggattactggggttttgatggctgaagcactttgtgaagctctggggtggcctggagcctggcagcagtgaggtggttttccgcaacacagggctggggaggaggcttgtggcctaggctggaggcaggaccgtgatctgcctggacagggcgcacggggcctgtagcacaggcctggaggcaggacgggtggtctcaccccacctctgctctcctgtgacactgagctcccatcaccctggtcccttcccctacccatggtccctcccaaggctaaagatggtctaggcctccttggatcccccaagagccccaaatgtccagacagggctccttcccccagggagagatgtggcaggtgcccccagcatctctcccctccacaccccctaccccagtgtgttctctcctggcctgggtgaggacaacaaatgggacacagtgggcacatgcttcgcaaaaataatgagagggaagaatgtgaaaatgagagcctaggattcaggcctggagagcacagtcatctaaacagacgaggctctaatagcaggatctcaacccctccagctgaaaacgaccaggaacacacatgcagtttaacaaagttggagttattctgggtttattgactcgttgtagtaagggggatgcaaccatgggagttgcggggcatcccagaaagagtgtgtgggaaaggacttcacagattcaagctggtgttaggggatttgggaaagggtttgaggaaacaggctttgctctgggttagatgacagcgggaggctggcttagaatcagcattctaagagtcggtatcataggagttctcatcgagaaggcaggaatgatggtcactaataaagaagcagcagtcactcatattagccaggaaagggagtttggtcatttttgtggtttggacaatgactatgttttatctgtgttcacacactttacagagtggtcagagagtggtgttgtgaatgacaccagggtccagctgtggccgccagctcctggccaccaggggccgcttttctttcttggtagcttcagacagtgaccgagaagagatgaaagggacagatgttactcacacagcacatgccaggcactgtgctcaacactagacagaccttgctcacgtaatcttcaccacagccctctcctcattgtacagatgaggaaactgaggttcagagagggaaggtgcccatcagagtccagaaggactggcaaaactagaatgtaaacccagcttatgttccccttgttccaaagtccctttcacccccttgcccttgcctagaggctgagcctctgctcgttcctcggagccacgtggtcctgaatagtgtcccttggacacccccgctaggcacatcttcctgaaggggttcagcctgtccatggcaggccagccgcagtgtcagcagccgccccagcccaggagggtcccccgtgcctagaggtgtgaagggtaatgaggccccgtaattaaggtttctgaagacatggctgggagatttatagacaggctttgtcaataattgtgctaccggctgcagatccagcgagacatcggtaagtgctcgttacagcttctccctgctccctgccctgcccccgcaccacccctcctgagccatcagcctgcctgttcacagcgcctatgtacacaggcttcgctcaattaatttgcacttgttggcgccatctgttcttttcatgtgtccttatcaggagtgtgtgcgtcctgcctcctgctcagatgtgacagtgcaaccctcctcatacatataggggcttcctgggcaggctcacatctcccctctcagactgggctcctcagggtgggacactgtctcccccctcagtctaggacccctgaaggcaaggccaagtcttcatcttccttcacctccccctcaacacccacagcctctctctgctgagccaagcttggcctggaccctagcaaaaccttctgagtctgaccccaccaggcagggcctcagccctccagaggaagcccccagaccccaaaccaaacaatgccctggaaggctggctgcctctgggtgctgggaggtagggtgtttgttctgatccccactctggctcccatagcctgagctttggcaggttcttgttacgagaacagtgacatctttgagtcacaggggtgggaaggggctaagaagccacttggaagtctctgtttcccttgagcagcattggttaagggtggtacaggggccaaggcttggacagctcctagagtggggtgggtcatggcctggtggctccaggatgccagggcaggtggcccacccagataactgagaaaaggcagcacctcaaggatgctttcccttggctctctccccatcccgaggttttgggcagccaacatcccagcctactcttctctgggtcattctgtcttccagaaggcctctcagtcccttccaaccccagcacagatttctttctttctttctttctttttttttttttttttttttgagacagagtctcactctgtcatccaggctggagtacagtggcgcgatctcagctcactgcaacctccgcctccccgggttcaagcgattctcctgcctcagcctcccaagtgtctgggattactggtgctggccgcgatgctccgctaatttttatgtttttggtagagacggggtttcgccatattggccaggatggtctcgaacacctgacctcaggtgattagcccagcacagatttctaaccccggagggctatgaatgctgagctggccctgccacagaagtgctaggcaacttcttaccctgtctgggctctgggtcctgcatagcacattggatttgtttagaatgcaaccagaccttattctgggagggtcacaagcatgcttggtgccagcatccaggcccagcccagtccactttgcctgcctataacaggcttgacagctgggccttggacttacatccaaggtcccatgactgaaccctgcagccgctccagtctcatctcctaccagcccctccttgccgcgtgtcctgtctgcactcccacggtgttccaggctgctgctcacctccacacctgtgctcctgctgttccctgtgctaggactgtgtctcctccttatgcctgtatcacctgacaaactcctactcatccttcaaaacccatctcccgctctgacataccctccaatacacccttgcctgcaccccagggtgaggagggggctggctggggggctcccccgctactgcatttgccatactgatttactatgccacactgcctgctctcacatcgactagaatacaagctacttggggacagagaccccaagccttggccacatctgtgtctccagtgcccaccacagggcctggccaagtgggcctgccaaagagtatatcctgaactgggaggacctcagtccttggcctgggtgggggaaaggcagtgctcacccctcccctagagatggaaggagacacactcttgccaccctggctgcccacttatagggtcatggcgacctcaaggcagacagtggattcagttagggcaaaatgcaaacacacatttcaggggtggggggcacagagcagggggctttaaccaagctctctgcccaccctccccctgccagccccctagtctggacccatcccagggcccctctgtgaacatcactggcatcatgacgagccctttcctgcagacagctccaagctgtggtggagcacctggggtggggatttgggggttaggaggggtacagttccatttgtatttcaggcccagcagcattcctgccaggagagagttttagaaatggaaatggagggctgtgttccctcagcacatgtcccgcctccgggagctggcatctctgctctcacatggcccatgtgcaggggcacagaaccccaggtgccaacgagccccctcctaggctgcagcagaagcccacagccaggcagggcccagagaagtctgacagcctgccaaaagcaacagcaaaaaccacctcagcccaggagcctcccatcccccacccccgtgtgtctgatgcggtggttttattgcgggcagtgagggcattcatgacagcctcagaatgtatgagccagacctggagccagcaggggtaaggggagcagagcaactgtgcgactccaggagatgggatgtgggctcagtggaggccgttgcaggggaccagggaggcatctggaccttctggctaggccagcttcaagctcgagttgcggggaggcctctcctaccagcagctaagcatggctatcaacatcctgcgtgccccaccctgagttcagctgagcctctggccctgcaatagggagatcccagccctgatgagtgatgaagcatgagccctgcccttgcggactccaaggccaaggccagttgaggacaggagagccagccccagggtccggagtggtggtgaagactctggaaccagctcacccactccaagaacttccctagcctcctcatacctcactctcctcctctgtggaatggacatggagaaggctacttcatcaggtgactggtggtgaagttaggccgatctatttaaggtagttagaacagtgcccagcctatggtgagctcttgttacctgcctggtgcaggctctagaaattcagaaaggaagccaagaagagtaggaaagtcttttgttaggaggtgggctttgcagaatggatctgcagagatgggggaaggcgactctgtcctgtaggtgggggaactgcgtgagcaaaggcacagaggccggatgcactgaacctgtttgttcccccagaggttctgaggccacaggaagtggctggcgtgggagtggctggtccaaggggagctgcactattaagtgtggagggggagggggacaggagcaggaccacagggaccttgaccgccaagctgggggaaggaagtgtgaataaagccccaatgccaccaggcatctctgtactgccctcctctccctccccactccagccaggcacctgccctgtttcctgggaccccctgaaggaggacatcccttagctccacaaagagccctgccctagtcttcacatagtaattgtcttgtgtgtctcacccagtgataaggggtgggcaaggggcaggggtgggggctcttgagcacccgttttatagatgaaatgcctgagaccaggcgggagcccctggggcctccctggcttcatggggcaggctcaagtccctcaagggcgcggcttccctccctctcagcagcccacacttgttctatgtccggtgatgggtccctgagggtccgctggggcgcccctccagcctcccgccagagcagggctggaagactgccatgtctggggccaggctgagctcagtgcatgcctctgcgtagtgcattattgatggggcttctaattgtgcgtttcccaaagtctacaggcttttgatgaaaaattcatggcacgcccgaggatgggagcagactcaatcgattggcgcacagcaggcaggggaggacagggccccttgcagggaggggtggtgaagcctggtctgggaggcttcttgccccaggatcttggggatagcagggggcacacacccatttccctggtggggaggctgaggggcaggagcaggaagatttaaggcccacatctcagtgccagccagtgactggtgccatccagggaggatggccgactccaccacgggcctccctttcatttccctggaggggtgctagaccctccagagcccctcatgagagttgcacagaggagggagtaatatttctggagccactcttatatgccagacgctgctcggacgtgtacactcgcagcctcatttaatccccaacagcgttatgagatgggcacagtgatgcactccattttacagaggagaaaacaggcttagagaggttaagtgacctgtccaaagtcacacagctgcttagtaacagagcccactatctttccacttcaccaggcccactcaaataagaactaataggagtatggggattgtcttgtgccactcccctacttgtccctattgttcagaggaagtgtccccattaagaaaaagtggagtgggccaggtgcagtggctcatgcctgtaatcccagcattttgggaggctgaggcaggtggatcacgaggtcaggagatcgagagcatcctggctaacacggtgaaacccagtctctactaaaaaaatacaagaaattagccaggcatggtggcaggcacctgtagtcccagctactcgggaggctgaggcaggagaatggcatgaacccgggaggcggagcttgcagtgagcccagatcgcgccactgtactccagcctgggagacagagcaagagacagagccagactccatttcaaaaaaaggaaaaaagaaaaagagtaagtgaaacatgaggcctgcaaatgagaaaaggaagcgccctccacaacaccggcagaagccagaggccccccaaccctgtgcagagtgctgagctgggcacccagcagcaggggtggagattttgaaacgggtagaggtgactgtcttggcttgtccagtcagggattattattgtgccaccattgaggccccaaagaacactgtaagtcatctattcattcattaaacaagtaaacaaatatttatgaagtcccagtgctggtcagcatcttgctaggtccaggtggagggccctatcatgaaagcctttgggaccaagcttgtctgggacagacaggctgaacccagttcagctggggaaaggcaggcaggcccctccatgccccaggagggggtctccgcaacccaggctgaagccagttatatcagacattctgccttcatgaccagggccgtttctaggtggcgggctggcttgtttgggtttgtttttttttttttttttttttttgcttcccagtgagtttctttcaaaaacatccacccatgtctccgctgaactaaagagaaaggaatttgtccagagcatcaggaaagcagccagaggaagtccccagggaccaggcgtggggccctaagccacactgcagctgcagggaggagagtgagcccagcttgtgctgctgcggggtggggaggactcctgaggggacaagggggaatcagggagcagagagactaagggggagggggaggaggagactcagggacagagggtgaggctcagtgggagagaaaggggagacagggtatgggggtaaccaggaggcagagaaagtggagaagagcggagggagttgagggggaggcaggaaccaaggtgtagccaagggcaggtgagggaggagggactctgagcctgggccaggggagtcagaaggccggagccctgaagggccccacagccctccccggccctgctgtctccatacaattctgtggccaaggagtgaaccttgcatgatttcagccaccccacccagacaccccccaccctggaacaaaggggaagtggccccatgggcctgcctgcttccagctcagggctgggcttggtcaccaggcaggcacttgttgtagcaacagtccctggggacccatcctggggaacaggactgctagcagtaaagatgggggagccagggcccccatcccctccagcccccaaggctgccccaggcctcattgacagcttctctgtaagtcgccccctcgcccactggttctgggaagatgggttggctcgcctagcagcaggtgtgttggggtgtgttgcccagcaaccagtagaggtgttcccagagcctcttaagtgggaggcagggtggagaggaccagggctttggcccttagatgcccgtggtcacaggaatcttttgcaaggcccctggctccagcctaggccacctgagcccacacagtaatccagagagggaggacagaagggcttctgggaaaatcccttgaagtgatcattgcctcctgctagtctgggccctacctctggtgtcttggaggtccagccttggatcctagaaagtggctgagcctgggctagcctgggaaggcttgctggtagtgcatgtgtggtgccgagctgtgaggaggagtgggtgtggcagatggggcatccagtggaagcagcagctcagactgggggctggggccgccccagtaagtgctaacccttctggtttgggccccagttgccaaagcatttcttcttcccctttggcaagaatcccagaggacaaccccaacaagggtcattccccacagggtgcagatgagcaggcacggagtgggcaagggcctcgcttcgggtcgttcgacagctgtgggcagaggctggatcagaacccaaggttctgggttccagccagggctcttcccccacccaatgtggggcattcctgaggcagcaaagctctaaccagggaggattctggcaggaggtgaccagtggggaagggttctttgaggaagagtgaacagggcctgtgagaccaggactggggcctgcccctcaccacctgctgaatgcccagccctgtactcacctgggctgagagcaagggctggccccaatctgctgtcagcagaggctggactctggcccaatacccaaggagtcatgactgatggcctgtcttgggatagcccgggggtcttcctggaggaggagggcccagaatggagccttgagggtcaggcagcgttcagaaaagcctaggaggggaagtaggaatgggaagccagcatcttccaggaagccccgcccccaccccagcccagccggtctccattgtcccagccaggcccaattagcacctggctcctgcaggggccaattagacaggggctgaggtcagctgccggccaaggccctgccacccctccaagcttcaccaagccaagcacaaaagctttctaggcatcatctctgctgcagcaggaagggaaagaaagaacagaagaaagggaaaattcactccttttgtttctttgccataaccttgggctgaacaaagaagcaactgcctcccctccctgggagggcagcttctgtggagcaggaagtctgttttaaacagcaatttgcacagatttgttgtggttgggaggcccagatgacattcgaggggaaccaggagcagagacctggggtgagcagggccctggttctagaaactcctgtgactccccactgcgctctgttcagaagcagagcttccgggcctggctggtgcaaacaggtgggcctgctccagctctctagccagacagacctgtgtactttgctgcctccaaagagcccagcccacatgggcctccacaccttccctcagtgttccccacctctgaagtcccacccaatccagtcaaatctcacctgcacctcaaaggcccagctccacccctcccctgcaggatcccctccccaaccctacccctggccttgacttgcactcctagggtgtgagccatgtcccacacaaggcctgcctcccaccgggaactctctgagtgcagggtctccccacccccaacagagctgagcttaggggtacaaacagcagctgccaggccctgctggggagcaggtggaagggagatatatgccagagtccaaaatggggtttgggaagctggggccaccctggggtggtgacaggtggagaaggggacccaccagtgccattgcctcctccaggctcccacccccagggcaatgccacatcgcacagaccaccctgccctcacctccctaaccctgccctctgtgtctcaggagcgcagcctctcccactgggctatgcccttgccgcttcgatatcccacccagccaatgaggctctcagtcctccctcgcctgccctctggtggtgatgaggttccagagtgaatggagggaaagaaagaagcttgtcctcatggccagtgggttctattgtccttcagtggctgggaagggagcttggctgggtgggcagtggcaaagaactgagaggccagggtcccagtggcattggcccgtgtgtttctgggagtaaggggacttcttagccatggtgagccccaacccctgggaaaacactagtccctttcagcaaattttcaggcacaacctccatcctccccgacttgtccctgagacggcccctcagaactgggcttttgctccctggtctctggaactggaggaggccagcatcaatttgccagctgaattttccattgtattttaaagaaatgtggttaattcgctttattttattttatcttattttatttatttatttatttttgagatggagtcttgctctgttgcccaggctggagttcagaggcacgatctcagctcagtgcaacctccgccccacccccgcctgccccccagttcaagcgattctcccacctcatcctcccaagtagctgggattacaggcatccaccaccatgcctggctaatttttgtatttttagtagagatggggtttcaccatgttggccaggctggtctcaaactgctgacctcaggtgatccacctcccttagcctcccaaagtgctgagattacaggcatgagccactgtgcccggtgtactttttgtatttttagtagagagggggtttcactgtgttggctaggctggtcttgaactcctgaccgtgagtgatccgcccccctcggctcccaaagtgctgggattacaggcgtgaaccaccgcaccgggccaagaaatgtggttaattccctttaaaagtattgggaaatttagattagccaagagagacctctctgacattcaaaggacacctacaggagttctgtttggcaaatctggcaggagcagggtctgggtcaaaggatttgcctgagtaagtcagggaggcagggaggcccttccctgccatcaaggtctttaggagctgaagggggagcatgtgcgtggcccttggcagatgaggagtgccaggctggtgtaggcgagaaacagcttctgggcagaggtagggaaggctttgaagataggggcccagaaggctgggcccatgggtggagtggccagggctaaattctgaaagggggtctagctgtgctgaaagaggtggaaattcaaagttggaaatttaccatgagggccagtgggagtcattggaggggtctggaggccagagaggatgttccagttacctattgcaataacaaactaccccaaaatgttatcatttaaaacgataattttttcttttattatcacatctcatagctttgtgggtcaggaactcagccacggcacagcaggtctaagtcctcagctgggacgacctacgggcaggggcgggagcagccagggctgggtgggcctcgctctctcccatacacttagtttgggcttcctcacagtctcagggcagcaaggaattagcagctagcagggaagaattggggttactgcaagatgggtctcatcccaagcccctgtcctcaccactcagccccaacatcttccctggagctaacccaggatagaggccccaggttcaagattcactgagtgacttcaggcaaatctctgcacctctctggtcccaatatcagaacttgtgagatgggggttccagggctagaggtcttggaaggctggctggaccacctggaggaaggacatgtgctcctggaactggggagagagacagctccgcacacaccttccccacaatatgagctgtgggccactcaggttggcctcatcccaccacaggctgaagctgagtgtctgtgggaggcggctgccctctgctgactgcaaaggcaaaccacatgcagatggcctgggcctgccagcgatggatcctggggatccggggaaccctgagattgggtggccgcccaaggaaggggacagaggagagggtgtgtgcctggtccagcaaacccaccctctgcacccacttcaacactagccagactgccacccacactacctcagacccagcaacctgtctcaggcctccttctctgggagagtgaagcccctccccgctcctacccctgctccagcccatacctcccctatgcatccctccctcttaccttctaagtctccaggaaatcctctctctccaccactatgcctctccttgaccctgttttcctagctacctttgacccttctcaacctcactgtcccctcagaccttacccacagcacccagcattcagagcactggccaaggtcacttcctccaggccacaccaagaggctccctctgcagatccggaaactgctaagccttctctcctttttccaaaattcttttaaattgtgaaatgtaacccatttcacaatttaagaaaaattgcattgaacatatagaacataattattataaattattatatagcaaatgtccatgaaaccaccacccaggtcaggaaacagcatcaccagcatcctcacgcccctcatgcccctcccagccacacccctcctctcctggatgtaatcactctgccagctttctgtccttgctttgcttctttatttttttattttttaattattttttttatttttgggacacagtcttgctctatcacccaggctgaagtgcagtggcataatctcagctcactgcaacctccgcctcccgggttcaagtgattctcaggcctcggcctgccaagtagctgggattacaggcacccgccaccacgcccggctattttttgggcttttgtgtagaaatggggtttcaccatgttagtcaggctggtctcaagcttctgacctggagtgacctgcctgcctcagcctcccaaagtgctgggattaaagggttaagctgccggttggttcacgcctgtaatcccagcactttgggaggccaaggtgggcggatcatgaggtcaggagttcgagactagcctgaccaacatggtgaaaccccgtctctactaaaaatacaaaaaaaattagcccggcatagtggcaggcgcctgtaatcccagctactcaggaggctgaggcaggagaattgcctgaacccgggaggcggttacagtgagccaagatcacaccactgcactccagcctaggcaatagaaagagactccatctcaaaaaaaaaaaaaaaaaaaaaaagtgtgagccactgtgcctgacctgctttgcttctttatactgtcgctacctgagcatgcctctcgaatcactctggcctaaattttctatttttaccttcatggagagggcaccgtgacatacacattgctttgcacacggctcttttgctcaccttgatgtatgtgaggttcacccacatcatggtttcttattgctctgaagtatcccgctgtatgggtctccacctgcccctatctctgccccataattcctcactcacttgccagttctttaatgtttttatgaaggtgagttttgctttgtgtcccattcagaccatctctagcggcgggttcatctccatcatccaagccgcaagactcaagcggaaggtggttgtcctccttttgaagccctcttgccagcctgctctcgccgcttttcctcctacctctctggcaattgcgctagtcctgagagctcctctcctaccaccccttgtccttgaaccccctcctcactccacagttgccagacgctgaaaatctgctcccttcccaaggctccaatggaaccagggctgtcctgccacctgtcccccaccaggattcactccaggcttgatcaccatcagccactgctggcctcctgcacctgaggccctgcaggtacctcacccctaacacgctcctcccccaacccagctccccctccttcccactccagacctgcgcctcctccacccaaagaccccagctcctcctctcctcatcccccacctcctccttctcccctcttcctccttcccactccaggcatgcacctctaccaaaaggccccagacttctcccactcctccccctcctcccccacctcctcctcctccacactacaggcatgcacctcctccacccaaagaccctagccccctgccaacctcctgctctgccatccccaaccctcctcttcgttgttcacttcactctgtcatgctgagtcctccttggtctgcctccacccagcaagggtccctggctccctgctctgggcctccattcatttctctgtccatcttggtggcctgaggcatcttgccacaaaccccctccagcttaggcccttcactggcctgcaggatggaatccaagctcctgagattggccacacccctacttactccccaaccagcactctgccctccaggaagtcaccgactttgttcctgatcatacactctctctcctccctgcctttgccacagtgtctcctctgcccaagagccctctcccctaccccgggtaacacctgctcaccctcctagagtgagctcaggctatcaccacctccaggaaggcttcctagacctggggctaggaaaagagactcctgtaagctctcctctgtcacagatgtcactgccatctccttggtgtagatgggagaccatcacaagcagggacggtctgggctggtctgggctccatggccccagtgtggacatggccttcagcaactgctgatgactgtgctgcttccaatgtagcctttacactgagtctctgtgaccttgggaacactacttccaatctcagcttccccattttacaatgagtttataaggaccctaagtagccacaggtgtcattggatgcagtgcctcagattctgccagaagcacttcttatttttttgcggggggtgggtaagggttaagcattaccctctttaggcctcctgcacccaaggccctgcaggtaccttacccccaacacaccctccctaacccagctcctccttctccccactcccagcataaaaacaaagacaatcgccattcctcctccttcgtgggaactggtcctcagtttctatacaatgaaagtagtcacatcatcatatcttctgtgcccactgcccagggttataataagaaccattaaaagtgcgacggcaggcagaatggctcatgcctataatcccagcactttgggaggtcaaggtaggaggatctcttgaggctaggagttcaagaccagcctgggcaacatagcaaggccccatctttacaaaaaatttaaaaattagccaggcatggtggcacacacctgtagtcccagctacttgggaggctgagtcaggaggaccacttgagcccagaagttcgaggttgcagtgagctatgatcatgccactgcactctagcctgggtgacagagtaagtctccatcttggaaaacaagaaagcactcagaaggtggtggaggaaaaagagatgctgttgccaggcaccctgtgtgccagagcctgggctggcactgttcatgccccctctctctccacagcaaccccccttggggtggggtgattttcccattccacggatgaggacgctaaggctcagagaacagcctcccttccagagccaaagcgaaggtgtcggtgcagcaaaggccaccagcgctcagtggcagtggggcaattcaaacccaaggacacctgacatttctcacctgggcaggatctgatagctgggtcttggatggggaaagcgcagtgtcaatgggtgaggagaatgcagtgggcactagccttaggcacaatggctttggagtcagtccttctagaggaggctaagcctagggacaagacagggaagtggctggtgcctgaccctcccccagcagactggaaagtggggagggggctggaggggagggattggagcaggggagtcagcaggaccacaacaggaatctgggccatggtgtccttcctgttctcaaggctgggctgtgacgcagagcatggccctgggggttggggaggcccagctccaggctgtagggagtggtcagggctgctcatctgcaggcagtgtcctcccagaccagctgtgctgctcaaggtcactgctgtgcgggtgggggaagccgaggagggaaagcaggtccttcagtttcccacagatgtagagggaagagagcatacagactgaggggtaagccagggccgagatccctctccatgccctgggggagccctctctctcagagagcagccaggcttggtgggggagggggataggcacctgtggaggcctataggactagtctccgaggagtggagtccagcagggaccgtctgactgagacagggacgcggcctcaccagaagccatgctctccctccatctccttcctcgctctgggccccagctttctttgtctgtcaaagcgaggtgttaataacagagctctgggccaggtgcggtggctcattcctctaatctcagcactttgggaggctgaggcgggcagattacctgaggtcaggagttcgagactagcctgaccaacatggtgaaactccatctctactaaaaagacaaaaattagctgggcgtggtggtgcacgcctgtagtcccagctacttgggaggctgaggccagagaatggcttgaacctgggaggcagagtttgcagagagccaagattgtgccactgcactccagcctgggtgatggagtgagactccgtcacaaaacaaaaataaaaataacagagctctgctcatgccccaaaacagctgagttggagaacaggagggtcttagaaaaaatgaccctctgaatgagaagagggggtgatcagacccatggggtgggctgaggaactggcagccccctcccccaggactcactccatgagcatgctcacaacccggttatggacaggatcgtattaatttgccacatgcactttcctttcacaatagagcgtggccatctctgtgtgtcagtataataaaatctgggtcatcctttgtgaccacagcctgtggtgcagagactgagcatgccctcatataagaccacaagctgtgctgcagtgagcatccctgcatgcattttcctggatgtgtgtgtgcgtgtttcgctggaagccaagaaaacccatttggatgctgctgtaattgtccagggcagatatgctaagagcttgaaccaggctgggcaaagaaagaaggggccaaatttcctttgccaaaatatcgtgtgcttcctttggtcagtcccccatcagtaatgggctgccataaactgaagatttagagcacagcaaaggaagggcctgggagctctgggggcagcaaggaggaagaggaaggggtctgacctgttgattaaagcagtgattagaatagaaatgggtgtggaggagagcagcagcctccaaattatacctgcctgggcaggggcttcacgcaccaactcttgagcctcacagcaacaccaggcatctccgtgtgaggactctgaggctcagaaaggtgaaggggcctggctgaactcacactgcatgtgagtggccaagctggcctgctgatctgggcctgactgcaaagccctgtgtgtgtgtggtctctagacagagtctctccattaacaatgctgtccgaggacaccagatgggcagatctggaggagccaagacctggaactcaacaggggcaagtgctggagagatgaacctggcactggtgcaattagagggagcccaaccagaaggctagacagtggcaggtgacaagtggtgtctggtgggcccctgctgccaggagacccctgctctcgaagccatggcctgccatgcagcaggtgggaggcagtggctgagaaggcaggccatatccgcagtcagcatgaggcccaggtggttgctgggggccgagctctgcttcctggaggtgtgagtccccacccgtatgtacacagcctcccacagcttcaggaagcccacagccacaggggctcagcaaacgcaggagcaaactcacttccccatgcccatttcctcccccatcccagctcccacctgctgttcctccatccagacctctctggcttcacatcgaggttgcagtgagctatgatggtgccactgcacgatccttttctattttgtgctgttcagatttaagaaactccctttgtgaaactttataaataacagtagggaatttctgcttataaaacaaatgcatataaatatagcctattaattttcatatatatatatatatacatgcacatgggcaggcatgattttttctctcgattggggattgcactgatcattcctttttgtagcctgcttttatcacttctcagcgtattgtgaagtgtccacatatggaggcctcatggcagaattgcacggctcttcagaacagaggctcaagtccctgcaggcctggatttcagaccctggctctatcactaatcagtcttgtaactgagcaagttactcacctctctgggccttggtttccgcattggtataacggagataatagtacctatccacgcaggtctgatgagaggactgagggagggcacataaaaagcttagaagaagacctggaacacagtgaatgctcaatgagcatcagacattaggattgctgttgttcctgacctcatggctgactccagcccccagccccacctcataccccacatcctgtagctggatcccagcctccactaagctctaacctgggtctcccagggtgaccttgggtcctctgactactgagctgtttggagggctgatgcccagtcaccttccaagtggcatccagtgggatttctgagaggttcttccctgggttctcagtgacgtgaggaatgagaggagttagaagatggggaaggaggagggaaaaggtgaagaaatagctatgatcgagccagaccctgcaaacctggccctggatcttctcaagtctccattgcccataggcctcctcccctgtgtccacacctggggtttccccctgagttggtatcacaggacgtgatgtggccccggggagagaacattagtgtggctgccctcacatggccaggatgggtgaggatcaagtcataaccacccttccagggagctgctaagacttagggccatggcttggggctcctggtgctcactggccttgtgggggacccactgactttcaagtgtagatgtggatgtgggaccagggttgctatggggcagtgggctcagctctgggctctgggatccacaggagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacgggtgaggatgtgcaggccaccaagggcacccgggcttctgcctgggcccaggctccaggttgtgcaatagggtggctgggagcttctcccagatgtgcatgctgctggactctggcaaataggagcccctcgcccacagacactcacacagtccctgcccagctgggtcctctcagggatgggaaacagagaatccagtcccgtcccaagccctcgggccaagggatatctgccttcctgctactgaccatgctgatttgagctgggagaggcttcctccctgagccagctccccaacccacctaacagtgtccatgaagcagaaactgctgctgagtgagctggatatgaagaaactgagggacagggtgcagcatttgcagaatgagctgattcgagtgagctggggcttgtgggggcagaggggagggagctatggtgggggagcatcggggtgagaagagtctgggaggagaagggagaacaggcacagagggaatggaagcacggaagaaagggggaccagcctggtggaggattcagcagaggggccgaggtggaccctcagggccaaggtggactcccaggcacccattctctccccttctctcctcccccatctcacagaagaatgatcgagagaaggagctgctccttctgtatcaggcccagcagccacaggccgctctgctgaagcagtaccagggcaagctgcagaagatgaaggcgctggaggagactgtgcggcaccaagagaaggcaggtggcagaggggctgcccccgaggccaactgatgatggcagagtagggagcccctgggccagcccagcctctgctctgctctccaggtgatcgagaagatggagcgggtgctggaggacaggctgcaggacaggagcaagccccctcctctgaacaggcagcagggaaagccctacacgggtgggtccacaccctgatgtgatcagctccccagcttctgctccacccctggaggccctgccttcctggagcctctcagcttcaggagaacctgcgaagaggtcccctgcactcagttatgtctgtgggcctgggagacccaggattgccctgctcccctcctcattcaggcgccccatccagagatcccctgagctccctccttccctggaagcccctcagaacacaattgggatgcagtgtgagccaggctagaaagagggtggacctccagaggagggccctgcagactagcacagcagagagggccttcccctgaagaagggccacctggggcaacacttcccagctcctagccccaggatccgtcgaattatttccccataccgccaaagattctgcctctgcaaagcaaacaaacaaaaatactttgattaaatcaatgatctggggccaggcgcaatggttcatgcctgtaatcccagcactttgggaggccgaggagggcagatcacttgaggtcaggagttcaagaccagcctggccaacatggtgaaaccccatctctactaaaaatacaaaaattagctgggcatggtggcgggcacctataatcccagctacttgggaggctgaggcaggagaatcacttgagcccaggaggcagaggttgctgtgagccaagattgtgccactgtactccggcctgggtgacagagggagactccgcctcaaaataaataaataaataaatgatttggaggttttcttccccatcgatattaaccaaaagccacctaaaactgccaatcagcctctgataagcagaaaggaccaggtaacaccatatcaggccagcccaaagcaagggatttccctgagcctgcctgtgcaacctcacccagggcccctgtgtgcccagccctgtgcttagccttcaccgctgagggtctcaggggcaggagggtgtttctaggagcctttagaatgcaatgaaagctgggctggcctttcaggaagcctgaggtcatccaggagtctggatgagactgagaaggcaacctagggaggggaaacagccagatcaaaggcccagggagtgagaagaattccaggatcagagaagggaggaagagagagaggtgaggagctgaaatacactgaagacaaatgaggagttagagagaacgttgaggtcaggttctaaagagcctagaaggacagcctgtgtgcacctgatcccactggtggtagggagccattgaaggcttgggagtagaggggaggggtggcagattgaagcaaaatgctggagcagatcaggacagggacatgggaagcaggagagcccatctcaccaacatctgtggccgtgtctctaggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggtaagaggcccttgacctgggcctgcctatgccggtcactgggtgcccagaaatcacccatggtacaacccaagttgaagatcaagaccaggagctaagcttcccagggtctccagtctgcctgggggctcctggaatcagctctcaggccttggtctttttctcctgcggaatgtgtgtccccgaacacttcacctttaacctcatctagcatcccaggagaaagcaagccccttgttgacccttggtccctgaaccctgacccctttttcacctggctggcctccacctggaccctacacaggcctctcaaaactcccttctggagcattccctggtcttggtgcagccttggagagcccttttccatcccaggtggaccccggggagttgggagcaggaggagacttgacagagaggctacaagagacgcatggcccaggccactcagagtgcacagagaccctgcccgcacaggtgggtggcccagggcccagaaatgcccaggccctgctccacctctgaagatgcttcaggggccccttgctttacataaaccccaaagcagaacatttggaatcacagaatattgggcagggcaggggcacaggagagttttctctccatcccaggactcgccggaggtgagttctgttgaaagcacacctgactcatggacatccaggtaaagtgtgagggatgaggtcaactgcctcacaggttcttcacttcactcaaagactcccagtgcgttaattatagggggctccctaatgcattttacattaaaaaaaatgttgtgtcaaaacttcgtattctcaaaatctgtgtgggaaacagctgtgaaaaaagcacatgccagaccctgttctgaacttccagaagagggttcggcccaggtctgacgctctgcctcgggagctcagtctgaactcaggcctgactggtttcttcctcaataccttatggtttcccaagctcacactgccacagcctccagctggggccaaatgtgagtttgtgctttgcccacaggatctcctctctggtacttcagacaagttcaacctcctggccaagctggaacacgctcagagccggatcctgtccctggaaagccaggtgggtgagatgcaggagttgatgaggctggatcaggctcaccacacagcctataaccagggctcagtgtgtgagcagagtctaggctcaatctatgaccaggatcaaggcttagtgtgtggccagggtcggggttcagtgtgcaaccagggtcagggctcagtgtacaaccagggttagggttcagtgtgtaaccagggtcagggttcagtgtacaaccagggttagagttcagtgtgttaccagggttagggttcaatgtgcaaccagggtcagggttcagtgtacaaccagggttagggttcagtgtgtgaccagggtcagggttcagtgtacaatcagggtcagggctcagtgtacaaccagggttagggttcagtgtgtgaccagggtcagggttcagtgtacatccagggtcagggttcagtgtgtgaccagggttagggttcagtgtgtgaccagggtcagggttcagtgtacaaccagggtcagggttcagtgtgcgaccagggttagggttcagtatacaaccagggtcagggttcagtgtgcagccagggttaggattcagtgtgtgaccagagtcagcgttcagtgtgcaaccagggtcagggttccgtgtacaacgaggttagggttctgtgtatgaccagggttagggttctgtgtatgaccagggttagggttcagtgtatatccagggtcagggttcattgtgtgaccagggtcaggctctgtctatgaccagaatcagggatcagtgtggactcaggatcagagctcagtatgttgttgaaatgtccatctgtgtcttggtcaggctgcctgactgtttggccccctcaccctcaccccgccacccctgaggtctcgggaaggtgtcaagcccacatggcccagagctttgctttctgcctggacagcaggctcaggccctggttgtcctggccatcagggattagccctgctgcccatggtcctccaattgtccctctctgtgtctgcagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctgtgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcaaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcacgcaccccgctttgcacaccacagagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgtagctctgtgagcattttcctctttcctggagcagggcagcctgggggccctgcttcctcctcctagacctcactctgggcctgggcctgggtcttctgctgcagccttacagcctcccgcctgccccaggagccagcatctttggaaagccaagggccacagtggacccaggagggtggagagaagaggccttccaaagcaggggccagggagacgggccccttccagacccggagaagaagcaaggccaccagagaccagctctgttgggaaatacgagggaggcttgtccttttcatctgccccaaaacatctatcatgtctgatattccttctttcaagtttggtttgtctgtctcttggaaagggaaagacttggaggcttgaagccttcctgtggcagtcacgtatcattgtgaaatactccattaagccactaggctgagctggcaatgatgtgtccaaatgtagccggggcaggagagcagattgggccaggggaaaggaggcacctacagggagtcaggaggcccaggttctgggggcaaacaggctgtgtgacctcaagggacccaagcaacctctctggacttcagtttccccatctattccatgtagagcttgacctcattggctgtaagcctctttccagctataacatttctgagtcaaagctgactcaggaccagagaagaaaaaggacacaggaaggaaagacaaagacaacagggaagaggattttgtggtggggaaagcagaagggctccaagagtggatccagatcccacagcttcgggcaggagaggccaggccagctggaccactggcctcagctggactagctcccccacctgcctgcaggacttagacttggatagccgagggccaagaggaatcaggtcaggagttgggagaccccaagggattagggggcggaagtcgagaccagtgtcattcagtccaaatgacaaaccagcggctctgctgcagaatagtatccccacctcccacccttggacaagggggcgcaagcccccagagcaagaacacgaggcctggagcaagcccagaggaggcccgggaatggtaaaggaagcaggctggcctctcatccccagtcagccacctcacaccagcccttcagtagcaggggttctcacccacagttctcggcctttgccatgcccaggactctggctgggccttggcaggaagtcctcatgccccacagggaactcccacccagagttcacccaagcagagccctgtgcgagccttacccctgtggggcaggtccactcagaaaggcagtactggcccacacttcttggggccacccacagaactccccagttctcctttgtccttctgcctgatgcttctgtagctcctggcacagtagcagttgcctcccctcctctgccccactctgcctcaccccttgccccagggagcctggagttgattctgctggctcctgaactgccatgggtgagggggtcccagcagaggtggcttcaagtgtggctacctggggtctcctgagcatgcccagatcctgctttaacacaggaagcatctccacgggagtgatgaacacctaatgagtctgatggaacgcaagacaccacatggttcagctgtttattgtctccatggggtgggtgaagaggagtggcccagctgagctgaggaaggtgaccactgagaacccattcaacctgctgagcaggctgggcagaaaggagcaggacttgggacagacgactgaagatgcagagaccccatgggccccacccctgggccttcctcccatgtggctgcaggccatcctctctgatcactgctgggttgcttcctggttaaagggccagaaggtgaaggagatgggcttttcaggcatcagaatgaggttgaatgtggtgcccacatcgctgaggtgttggatttcaactctgaagttctccagcatctgagaaaggcagatggtaggtttaggggagggcaggggaggatctgtctccctagccaggccaattcacccataggcagtgcctgtggagtgtgatttgaggagttccaaggagttcaccaccagctcctggtgtaaccctgcacagtgcctgataatgcacccttagtgctgcatttccttgatttaggcctagaccttaacttgtctacaaacctcagtcctatcccatcccatcaccaccatggggaatggatggccaggggcatcagtgggtgatgagtggttgagcccgaaagagggggcagcagagaactgtgggagagagcgagagcaagtaactggaggtagatgcgccccagcactgacatccttgggctctggacagagataggaggaggaagattggtgccttcattagggccagggccagcccagggtgcctagatgtccccagcttgactcacattgatgaggaagatggtcatctctagctcagcgatccgccgtcccagacactgccgcacaccccagccaaagcccaagttccggaagtaggtgatgttcttgtctttgctcagccatcgggttgggtcaaaattttccgggtcgaagaagaaggtgggctctcggcccagagcatagatggccacttgcaccagtgtctggggcaaggtgatcagaggcctgagtaagccccacttccccacagccctgagcacaaaacccccttccctagtcccctgccctctcaccaccactcccactccccagcatggctgcccagctctccagggcaggacattctgcccactgtgcagccttgaacaaggccccgcccctctgtaatccttacccaccaaatggggatggctgaagacccaaggccaggatgattgtcccaccctttcctcagacccaggcaaatcatgaagtctccctcctaaccctgggttccaataacatcctagaggtcaccgcccaccatgcccaccacctctgcccttcattcagacttagactgctgccatcaagggccccaccagggccccagtgccaccctctgtctgcaattccagcctgccccagccctctctgactggcagagcctgcagcctgctggctgcacctaccttggcaggaatcatgtaatctcgaagaaccaagtcatttacaagatatctctgcagggtcacggagatggggtgaagtctgcgggaggagggcactcagaagctgatggccccaaaggctggacacagccgccggagccccacaccctgtgtggcatctcagccctagctgcagcagcctggggggacctgggggtagggccctggctctatttctttctcctccagacttttcacttcctgcttccaacctcctccaccagcccatcctcgtaaccctttccccgggcacttccctggccctgcccagggattggagttgggggcggcatgggtggttgtgggcttgccttagtgtctccttgatgctggctttgaggagggggaccagctgtagcatcgtggccatgtctccctgggcctggtgccgcgcagccaagacctctgcccgcagcatatcctgcaccttcaggttgcgtgccatctcatacaagtgccactgcagggtcatggacgtctggtggggagtagggtatacagaagaccaggagggcctgtcactccggggccccttgaggtccttgaccccatggtaaattttcatttccaagaacctctttctccccgaaccccatcccagtctccaagaccatcctctgcaagagcaaaacacattccattgtctaaaaggcaaatgtccaagaagcctttcttgccggccaggcaggaacattcagggcagcacttgtccctgccctcgtccctcatgtcaccaaaaacccacccatgtccacagtgagtagagtgtcagctacacagccaatgccttcttccaaagaattccagaggcccttagaggccaaatccttctgtaatgattgcactccagaatgactgccattccttttgaaatgccttgttaaacaaccacccctctttccagtagaacttcctaaaaccttaggcttcacctatagcaacatggcttcaagtaaggctcaaagaagctgaaaccagaccagccggatgtttcctatcagtgttgcaattagggtgtggtgtgtgttgaaattaatcagctaatctcaacgtaagccagaggctgtgaccactagcccttcgccagagatctgagtgaccctcatcaaaccccacagtcccagattcctcaatgatgacaaaccaggcccgtttgggactccagcctggagcagccctccctcctggggactaggacatgggttgttgacacattatcttaccaaggatcatatttttgtccaacagacttagacacccacctccctcctcctggcaggggcaacaatgacaagctgtgaggtaccatttattaagcatatattatatggcaggcagggtcctaagctgtttacatatgttacctcgtttaatactcacaaacaaacctctaaggtatgttaccatcatccccctttttcagatgcggaaactgaaacaacacacagctccttctcagcttaaaatccttgcctggctccccagagcctccagatgaaatacagaggctcaggcctgagccacagggcccctcaacacctgcctgctgctccccaataccccactccccacctctctccaacacacacctaatgttccagctacatggagtggcacacagcccctgaagcccagaagtcttccccacgctaggtcctcttcctggaattcccttccccgcctaagaaggaaggatgtgctccctctgcaagactctaatcaaatgtgtgtattcatctcagtactgccaaggcctgccatagagatgtacttgggatttaataaggtggttaactatgttactagctgtgtgacctcgaccaagttatttaacctctctgtgctctactttcctcatctgaaaaagggggatgatggtaacataccttagagggttgtttgtgagtattaaatgaggtaacatatgtaaacagcttaggaccctgcctgccatatagtatgtgcttaataaatgtgacctcacagtaatcgtttctttggtgccggtgagtgatttttgaagatctcttctacgtaatagacaatgaactatgtttaaggtatgctcaaaggctccatttgcagtctgtctcagggatggaaactccttcatcagagtgtaacacagatataatacctgggaatgaaagtgattcacccagggggcttgacatgtgcttctccctagtcctgaaatgctattccttctctctcctcctggcaacagcctgcaagacacgcacgttgaattttagctcctctgtggagccttctccgtgtccttcatggccacattagccactccccacctctcagctttgtcagtggcaggtgcttgcctctgtcactgcagtgtgctattcctccgttcacactgctgcctccctgttataggctgagctgtataccccctcccaaaattcatctgctgaagtcctaaccctcagaacctcaaatgtgactatatttggagatagaacctttaaagattttaaagtaaaatgaagtccttgaggaggatcctaatccagttctgattagtgtcctcatgaggagagacaattctgacacagacacagagggaagcccatgtgagacagagggagaagacggccatctacaagccaaggaaagaggcctttagaatgcaccaaccctgccaacaccttgaccttgaacttccagcctccggaactgtgagaaaatcaatgtttgttgtttaaatcgcccagtcaatgccattttgttacagcggccctagcaaaccagtacacccctcccctctgagccacgtgaggacatttgaggtctactgtattccttttgagatggagtctcacactaccacctgagctggagtgcagtggtgcgatctcggctcaccacaatctctgcctcacgggttcaagcgattctcctgcctcagcctcctgagtagctgggattgtaggtgcccaccaccaggcccagctaattttttgtatttttagtagagatggggtttcactatgttggccaggctggtctcgaacttctgacctcatgatccgcccacctctgcctcccaaagtgctgggattacaggcatgagccactgcgcccggccaggactgattattcttaatatccaaagaaagaagtttctagggtgccatgctgctatggaaagagcactggggatgcctctgggcgttgggggcaccgtagggtactgaggtctggaaaggggaggaggaaggacaacaaaaagaccatggacggcagagcccacagcaaatgcctcggcctcccaatgtttccgggctcctgcctgcttccctggatttgagtgagtgtgttctccaccaggagctgggggcattgtcctccatcagcagggctctgatagagcaagcctccagaggggacctcctcctgtggagactctacgtggaacctggacctcaccaccatgcccggccactcctctctcacaggcaaagaaaaatagctgatcatcctcaaatcatgccctgggtgacttgactttgaccccaccatcttaggagattagcgctttggaaatggaggcaaggaggaagacatatcctacatgagtaggaacgccttgaacaacagggtttcagacaacgaggggcctggtggggaaggggcacgtgggcacagggggcaacaaggtgccgcccctacagccacctcaccgtgtccacccctcctgccagcatctctgtgacgttggccttgatgtcctcgaaggacatcttgctgtctcccaggagtctgtagaggatgccacggtaatcgtggtgaacacttcctttctgtctcaattcccagtagaagttctgggtgtatatgtcagctgtggggaaggaggaaagaaaaaagagtgaggttccctgcaggcgggtgggaaggagggcagtctgtggtgaaaggtggcaccaagggcctggggattccggagccctgtgcttcttaggctgccgttttactgagcacgtactctgtactaagcccttcatatctgttttttcatcgaattcttggggtatgtgacatcatccccattttacagataacagaggtgcagagacatagtcacttgcccaaggtcacatggctgtaaggggcagaggtgggatttgactctgccataccctgacgagccttctccacccaaccttccccatctctcccacccaagtccctgtcatccagcacagccgtggctcagacactggtcctttgccctctggggagcatgagctcctttgaagaagatcacagatgtctttgctcctctttttccagaaaaatctaataatccccaacagccagccttccatccgccatttccaggggtcccagggccttcctgacacccacgcctgcccgccacagtgtgggtttcctacaggtcaagtcagcgcccattgacatagcgtgggacaaaggagccggctgaggcctggggctccgaggaggagagcacagccagagaagccctcacctttactgaaaatcacgtcccatgcagccacatggtccttccaggtcttggtcctgaacagacggaacaggtctgggggaaggttgagcatggggacgctggtgtggaacatctggtagatggcatcaatgaatcgctgggcctcggggttcactacttcctccagcatcccctggcgctccccaaaaatgacgttagtgatggctgcagggagaggaagaggctgaggagccatttctgacggggccatctgagagccacaactcccagggactcctccaccctcacctccctcagcacaaaggatctcttgcccctaccctcagcctccttcagtaaataaattgaggcctgagtcccaaagggctaagatgcaaggctgagaaagctgacctctggcaaccacacaggtcctgcagaggggcatgtggaggacctgaaaggtgggaagcagggtctccagcagagctgagagagggcctagcccaggatgcaactgctctgcccaggcttccaccaagagagattcctcatctgtaattggctgaattggctaaatacttcctgaaacaggtcagaaaggagactgagggtcataaatccctggataattaaccatccaggacctagtcttgctggacctaagaagttacaacagcctcaagttttccccacctaccaggtgagtaatttgaatactgatttcatacaaagctctgggcaccccaaatctcttgctgtgaccacacaatcttcatcaagccacagggcctttgtatgtgtggttccctctacctatactgcctgacttccttaccccatctagataactcctacagattcctcaatgcctacctcagattaaccactgaactctcctctaccctaccagactccaaaggtctatggcccaggaggtggagacttgcagaatgaaggtccaagccaagctctggctttggcggatggtggcaatagggacctgtactttggggacccttgctcctacagcacaaatgccagatgagagagaatgccagatgagagaaccccagagcaaggggtctcactctgttgcccagggtggtcttaaattgcctctgagtagcaggcagtggaggacatgatcagcggctcatcccagaagtcagtctcaatgcctctgcagggtctgtactgaacctcaaggtaagagagtgaacactgagtcctcccacccccatgcccactgccagccaggtgcaagcccccttacactcaaaggcaaagcggaacaggtcatcactgatgtcccccgagtaatttccggagcccgccttcttgatgcgcctgtgcaggacactgacgaagtcccgagacactgcatccaacaggggcaaaaagttcttggtggcctctggagccatcacctcctggttcagggccacccggtctttcttccaggctgccgacttcctgagaaaacatgggcccacaagccctcatggtcacagaccccaggcctggtgaacacagagggggctgactcagttttcccaggaagctgagtcacagctcacagcatccagcactcccaccagggcctctgccctcacctctccgagcaccctctgcctctcacctcctccctgctctgcctggctgggagaagagaaaggaaaaaagagagtgaaggggaacaaaactccaactcccctccactccctctgctgagggccaggaactgatattcttagaaccctttgtgtaactttcagtctctccagtctttgcctcagctgcaggcatgccttccatgccactcccacttcctcctggccgatgctcacctttgacactccagggcccctctatataacattttctgactcttgcacaaacaaaattgaccagcctctcctcctctgcacccccaacacgtcccattactcacttctgtcgggggacctcaggtgccccgaactgggttggtcataataaaccttaattcatgcacactcttgaaattcatcaatccatgcaaagtcctcttcgtgacttgggggtgtttttgttgataagaatattatcacaaacttaccacccaccatagaaactaggaacttgacagtaacttacacttgccctcctggtccttccacatcctttgttcccttctaaggagaccacccactagaatcccttgctctcatttgtgtctaattttatctgatctccatttattcccaaaaggtactattacaaaatatatactagtgtttaacttcttttaaaaagctgtcggtcagacacagtggctcacgcctgtaatcccagcattttgggagaccgaggcaggtggatcacctgaggtcaggagttcgagaccagcctggccaacatggtgaaaccccgtctctactgaaaatacaaaaattagctgggcatggtggcgggcatctataatcccagctacgccggagcttgaggcaatagaatcacttgaacccgggaggcggaggttggagtgagccaagatcgtgccattgcactccagcctgggtgacagagcaagactctgcctcaaaaaaaaaaaaaaaaaaaaagaaagaaagaaagaaaagctgtcatgctttgccagacttgcttttttcacttagttgcaccgttccaagtatcatctgtattgctgtgggagactgagtcccttcattttgactggtgtgtaccacaattcactcacttataatcctattgggcatttcagtagctttctggtttttaatatcatgaacggtaccactgcaaaccttctactacacatcccccaaagcagggatactctttggagtatatacctgaaatcaaactgctatgtcacaggtatgcaaatattccattttaggagaaaatgtccaaccattttccaaagtagtggctccagtttacactcccaccagtaacagatgagagccccagttgctctgtagccttacccacacttgatatggttacgttttaccttttcttttcttttttttttttttttttgagacaggatccagctctgtcacccagcctggagtgcagtggtgccatctctcgtcacagcaacctctgcttcctaggctcaagtagttctctggcctcagcctgccaagtagctgagaacacaggcatgtgccaccacatcggctaattttttattttttattttttgtagagatggggtctcactgtgttgcccagggtggtcttgaactcctgagctcaagcaatctgtccgccttggcctcccaaagtgctgggattacaggcatgagccaatgcgccctgaccctcattttacatttttgatggggtgggtatggtggctcatgcctataatcctagcactttggaaggctgaagcgggaagattgcttgagcccaggggtttgagaccagcctgggcaacatggcaaaatctcatctatactaaaaatgtaaaaattggctgggtgtggtgacacgcacctgtaatcccagctacttgggaggctgaggtgggaggatcacctgtgccggggggcagaggctgctgtgagccatgatcaaaccactgcactccagcctggatgacacaatgagatcccatctcaaaataaaaaaaaatttatgaacaatttcgtagaaaacagtatccactacacttaaatacactgatctgtccccatgtaggacaaatgtctcactgcccctttagcctgtatgggactcacggtggcaggtccctgctctatttgtcactgtatctccagttcctggcacaagtcctgattcatcaaggatgctcagtaaggtgggactcagtgagcaaaccagtcagtgagaactttgccagatctttaattattcattaggatcttcagcatggccatttccctgaaggctggcagagcaattcatcatcatcatcatcatcatcaccatcatttgttttagggaggcaggaaaatgacggggattcacctagaggccctgctaggaggcacagggcaagcctggcctcagcccctcacccccagcctctgccctctccacagctccccaccacctccctccagtccctgggagatggcccaggactcacttcaacaggactcctatgggtctctggtaatactggtgataggcgacccagggcgggatgaggaatcgttctgggttggggccctcggacttaaagagaagggccacatcttcagggtcgatgacataaaccgactccacgttgccgagcttctccctggaggggtgggggagaggggctgatggaaggatccgaggagagctatggatacaggctcagcacagctgcctcacagttccacaacttgctgactgtgggacctgagtcgaggcccttaacccctctgagtctcagtttcctcttctgtaaaatggagacaaatacagtacctgtctcgcagcgctgctgaaggacaagacaataggaagtatatggatgtgacctttgttaaacattctacaagtgagagctttatgatcactgttgctgctgtcccacagcacatccccagggccagcccaaagccacccccgagccttccatggaccagcaagtcctccactccttgcgcattcttcctgtgtccacacctacagcagccccagcttctcacctgtccacagagctcagaaccatggcacactttcatgtcactgctagagtgactcactatagcttgcaaggtaggccatattccaggccaaatccctgtcagactctacaactgaaattctgagagtggccaccctgaccctaagagtcagaggccacccaacaacacgctttgtctctattaaaataaaacttcagtaaaacatcaagccccaacatacaggcaggggagacaggcttgcaaatcactttgcagacaatctgtattaaatacaactgggtttttgttgttattgttgttttgagacagggtctctgttacccaggctggagtgcagtggtgtgatcacggctcactgcagccctgacctcccaggctcaagcgaccctctcacctcagcccggccaagtacctgggactacaggcaccaccatgcttaatttttgtgttttttgtagagatgaggttttgccatgttgcccaggctggtctcaaacttctgggctcaagagatcctcccacctcagcctcccaaagtgctgggatggcaggtttgagccaatgtgcctacccacatacaactgttacatatgactggtgttcttacatgaagagatgaggacacggatacacaaagaggaaggaccatgtcaacacacggggaaaagatagcatctaactccaaggagagaggcctcagaagaaagcaagcaactcagccaaaaccttgatctctgacttctagtttccagaactgccagaaaattaattctgttgtttaagcaaaaaataagaaataaaaatacaactactaaaaaacaacagaaaattccacttcttgctagcctctgccttttatcgaagaaaattaagatacacttttaggcaaaatagcataaaaacatggagatacaagccaagtgtgctcatgtgtgtgcatgttctctctctctctcctctcatagtgctgctttaaccactgagccagaaagcctgggcctaccttgatgagtttcaggccttcacttgttctgtggcctcccagaaaatcccctcagtgtttttccagctaccatgtgtctttgcactaactagctccatacccctaaccaagttcagccaagcccttgaactgctattatcatgatcaattccacttctgggaatctagcccaaggcaatgatctgacatcagcaacaatgcttgatggataaggatgtccattgcagcctcatgtctaacagcaaaaaagtcaagagtaggttgtatgttcactttaaagaacccgcgaaaaaaaaaatccatactgtgaactactatgctgccttttaaaattatattagaggccaggcacagtggctcacacctgtaatcccagtactttgggaggctgaggagggagagggaggatcacttgcgcccaggaattcaaggctacagtgagcctatgatggcaccactgcactccaccctgggagacagagcaagaccctgtttcaaaaaaagtaaatattaataagatagatcaagaaaaaggaagaagatataaataaacgaaacgagatctttccccagaaaagtctgaggaccactgaacatcactttctcttaaaatataaaataattttatattagagagagaaaaaaggaaagaattccttgatatattgttgtgagacaacataagcagcatatgtagtatattcacatacctcatgatacttaaatgttaaatcaattggaattgattgtatctgacttcaatttttcatttgtgtttctctgtattttctaaattgctctgtataaaacaagaacagcctttgtgttaggaaaaaaacccacaaaagttgtattttaaattcctcacatttattcagaagtttattgtttattagctataagttcaagtataatgacacacagagctggaagtcagacaattccagttcctgccctggctttgctctcatgagttgtgtgacattgacaagacccttcttctcactgggcctcagtttccccatctgtaaagtggggaaataataacaccaactacagggatatgttgcaagattcagatggaagtgactcagaaaacagaaagataattagggtctggaggcagggaacataaggccaattcacacttgagctgtgacaggaaatatcctctccatagggcgtatgctgtaaatgactttgtaactttacttcatcctctccatttacataaggcatatggaattaaccaatggaatgctctaaggggtatttaaactcccaaaaattctgttaacggggcccctgagctcctacactcaggcccctcccacaccgtggtgtgcattttcatgttcaatacatcccttcatcccttccgtgctttgtttgtgcgttttgtcaaattctttgttcaagacaccaagaacctggacaccctccaccggtaacatgtattttggccagccagccaggaggaagaggtaagcccaaagtttgggattcgtttttctccctttcctttctgctccatacaggagctctctctttctcttttctgttccaacttgggacccttgctgggccccacctaaacacggagacaactgcaggtttctggccgtggccagtgaaactaaggggtttccacgtggagaagcagcctgactgccaccgcccggttcgcttaagggacctgggtcttttttatgttttttttctctttttttgtctctttctatttcagtctttcagcggctgtttcctagtagctccttggaaattgaggctggggtcaccagtactgcctgaaggtctacgaatgaaagggaataattgcgctgccccaaagcgggagggactttttttaaaaatcttttttgcctatggttcctgatccctacatgcggtgctgctcggagcaaactcataaatgtttctgggggcttaaaccttactttcttatgctaaattcttcccttatagtgctcaactagctaaggacaaaaaaagcccacgcagcatccagttcacattacagttcatggctactcttataaagttcatagtatgctccagaggggaaagcctgcatgtgatgcccacctaaagccagagacgtctgggaccctaagattggaccccacaggaggatgctctgtgggtcctgcggaccccagccactccaaagaggatgctcttggcagaggttctgaggtctagccctccttagaattttctctccgcagttgcaatgctgtttggccccaacattgtttggaatctgaagtttactgttgaattggaaagtggaatagagttgcatgtatccaggcttttgtgctgcagctctaagcagggggcctggttaacatgtgacaccctgctttgaagtcgtgggaggtttggcctttaaaaatcaaactgccatggagactgctttagccaaaattttggttcacagccttcattggattatctgttggggcaaaaactggcaagcttgtattgctatctcatggctaaggttccaagctattgaatcttcgtttatgtgtgtgtatacatgtctagatgtgtttatttgtatgtacacattgttatatgttgtgtctaccaaattgccttataagtaaaagagcactcataaattaagtaaataagtctaagcaattttcaagttcacgtgacttaaagtataactttactaaacaagctagctttaaaattattggtggaataaaaatagaaatgccttcagtattatcagtatacattttgtttgaattttatgtttgtctttgctatctttttttttttttttttttttttgagacagagtctcactctgtcacccaggctagagtgcagtggtgtgatctcggctcactgcaacctccgccttctgggttcaaacaattctcctgcctcagcctcctaagaagctgggaccacaggcacacgccaccacgcccagctaatttttaaattttttaatagagacaaggtttcaccatattggccaggctggtcttgaactcttgaccttgtgatctgcctgcctcagcctcccaaagcactgggattacaggcatgagccaccactagatattcttaaatgtcagtgaattcaacctgggagctgcttggggcgagcctgcctccccttctattcaaagtctcactgagataaatgcatatctgattggttcctttggaaaggctaatcagaaactcaaaagaatgtaaacatctgtctcccacctgtgatctgaaagcctccaagcccactccttgccttgagttgtcccacctttcaggaccaaaccaatgttcattttacatatgttaattagtgtctcatgtctcccttgttaaaagtaaaaattgagtacagcaaatgggataaatgctttaggtaaactttttgtgtaaattaaaaccttaaagttatttttggcactcatttaatatctgggtcatttccaagtaagaaagggttgtgatatggggaaatatgtttctaaaattgtggaattgttcttatctataaatgcccatatctgatatttcaggatttcttgctttttagggtttcactaaaattttacattacaaaggataaggtttctagttaacacgtaattctgtatacaaaaagtgcctgaaagggttattactaaaaaaaggaaagaataattttgtctaattcagaagttatctaaaagttagttcaagttacagttttgaaaaggttatttatgaaacaatgtagtaaggaaccattaagtaggggagaaagatgaggtacagtttaaataataaaatattctttaaaacctgataaagaattggaaacatttggctaattaacatttttatagttaaagctcttagtcttgattaaagtaagaagtattgtaaaaatgcattggcagtttggcaactcttttttttaatatagttaagcatgaagctggatttagtgtggaaccaaattccacatacatgcttacattgcttcatactatgtttactgttttgcatggatagtgctggagtacttattggtcatacgcctaaagtgaatttgttaattgcacaggatgtatgataatattagtgaacttaaggatactgaattgtgtatcaggaataaaatattcattatgtgggtttttgggggccctatgtaacactgtagcctccagggtaaattgaataagaaaatttagggttggtttcctgcttatttgtttttgcttctagttttcatttgtttgccatttgttctcctctgactttgcttgtgtatgcatgtatataaaaaccatgatttttcttagttcctagtggaaggttttcatttagttctgtgttcctgtgcatttctagcaagtcatcattcattccatttttctggaattcccaagctacctttgttgggcctgcaggaattaatggagcatactagcttttttatccttaaactaactttttggattttaggcttcctgatactttaagtgtgttgagtatactctcacaaatagaattttagtcatatttctctcactctgcctagtttctccaaaatttgtaaactatttatgaatattcttaattcattgcaatgtgtttgtttgcatacagtcaagcagggtccctggggccactcagggagagaatgtcaggcctctgagcccaagctaagccgtcatatcccctgtgacctgcacgtatacatccagatggcctgaaataactgaagaatcacaaagaagtgaaaatggcctgttcctgccttaactgataacattaccttgtgaaattccttctcctggctcttctggctcaaaagctcccccactgagcaccttgtgacccccacccctgccagccaaaaaacaaccccctttgactgtaattttccattacctacccaaatcctataaaacagccccacccctatctccttttgctgactcttttcggattcagcctgcctgcacccaggtgattaaaaagctttattgctcacacaaagcctgtttggtggtctcttcacagggacacgcatgaaatttggtgccatgactcggatcaggggacctcccttgggagatcaatcccctgtcctcctgctctttgctcagtgagaaagatccacctatgacctcaggtcctcagaccaaccagcccaaggaacatcccaccaattttaaacccggtaagcagcctctttttactctcttctccaacctctctcactatctctcaacctctttctcctttcaatcttggcgccatctttcaatctctcccttcccttaatttcagttcctttccttttctggcagagacagaggagacgtgttttatccgtgaacccaaaactccagcgctggtcacagactcgggaagacagtcttcccttggtgtttaatcactgcggggatgcctgcttgattattcacccacatttcagaggtgtttgatcaccacggggacacctgccttgatccttcacccttagtggcaagcaccactaatttggggggcaagcacctcccttctctccgtgtctctaccctcccttttctctccactttcctggggggcaggcatcccccacaccttctctccatgtctctatcctctcttttctctgggcttacctccttcactatgggcaaacttccacccctccattcctccctcttctcccttagcctgtgttctcaagaatttaaaacctcttcaactcacacgtgacctaaaacctaaacatcttattttcttctgcaatgccacttaaccccaatacaaactcaacaatggttccaaatagccagaaaacggcactttcgatttctccatcctacaagatctagataattcttgtcataaaatgggcaaatggtctgaggtacctgacacccaggcattctttgttccctccctagtctatttccaatgcaattggtcccaaatcttcttttccctcccacctgtcccttcagtcccaaccccaagtgttgttgagtctttccaatcttccttttctaccgacccatctgacctctcccctcatccccagactgctcctcaggtcactccccagccaggctgaatcaggctccaattcttcctcagtttctgctcctccaccctataatccttctatcaccccctctccccaaacccagtccagcttacagtttcgttctgcaactagccctcccccatctgcccagtaatttcctcttaaaaaggtggctggagctaaaggcatagtcaaggttaatgctcctttttctttatccgaactctcccaaatcagttagtgtttaggctctttttcctcaaatataaaaacccagcccagttcatggctcatttggcagcaaccctgagacgctttacagccctagaccctgaagggtcagaaggctgtcttattctcaatatgcattttatcacccagtcagcccctgacattagaaaaaagcttcaaaaattagaatccggccctcaaacctcgcaatgggaattaatcaaccttgccttcaaggtgtacaataatagaaaggaggcagccagacagcaacacatttctgagttacaattacttgcctctgctgtgagacaaaacccagccgcatctccagcatacaagaacttcaaaacgcctgaactgcagcggccaggcattcctccaggaccacctgccccaggatcttgcttcaagtgctggaaatctggccactgggccaagtattgcctgcagcctgggattcctcctaagccatgtcccatctgtgcaggaccccactggaaactggactgtccaactcacccagcagccactcccagagcccctggaactctggcccaaggctatctgactgactccttcccagatcttctccgcttagcggctgaagactgatgctgcccaatcgcctcagaagcttcctggatcatcacagatgctttaggtaactcttacagtggagggtaagtccgtccccttcttaatcaatatggaggctaccaactccacattaccttcttttcaagggcctatttcctttgcctccacaactattgtgggtattgacagccaggcttctaaacctcttaaaacttcccaactctggtgccaacttggacaatattcttttatgcactcctttttagttatccccacctgcccagttcccttattaggtcaagacattttaactaaattatctgcttccctgactattcctgggctacagccacaccttattgccacccttttccccagtttaaagcctccttcacatcctccccttgtatctccccaccttaatccacacatatgggacatgtctactccctccttggtgactgatcatgcaccccttaccatcccattaaaacctaatcacccttaccctgttcaatgctaatatcctatcccacagcatgctttaaaaagattaaagcctgttatcacttgcctgttacagcatggccttttaaagcctataatctctccttataattcccccattttacctgttcaaaaaccagacaggtcttacaggttagtgcaggatctgtgccttatcaaccaaattgttttgcctatccaccccatggtgccaaactcatatatgctcctatcctccatacctccctccacaacccattattctgttctggatctcaaacatgctttctctactattcctttgcacccttcatcccagcctctcttcactttcacttggactgaccctgacacccatcaggctcagcaaattacctgggctgtactgctgcaagtcttcacggacaggccccattacttcagtgaaccccaatttcttcctcatccattacctatctcaacataattcttcatgaaaacacacatgctctccctgctgatcacgtccagctaatctcacaaaccctaaccccttctacaaagcaacaatgcctttccttcctaggcatggttagatactccacctttggatacctagttttaccatcctgactaaaccattatataaacttaaaaatgcaaacttagctgatcccatagatcctaaattctttcgccactcctctttctgttccttaaaaacagccctagaagctgctcccacactagctctctctaactcatccaaccctttttcattacacacagctgaagtgcagggctgtgcggtcagaattcttacacaagagccaggaccgcgcccggcagcctttctatccaaacaacttgaccttactgttttagcctagccctcatgtctgtgtacggcagctgtcgctgctttaatacttttagaggccctcaaaatcacaaactgtgctcaactcactctctccagttctcataacttccaaaatctattttcttcctcacacctgatgcatatactttctgccccgctccactacctctcagcaagctgaactcattgccttaactggagccctaacccttgcaaatgaattacacgtcaatatttatactgactctaaagatgccttccatatcctgcaccaccatgctgttgtatgggctgaaagaggtctcctcactacacaagggtcctccatcttaatgcctctttaataaaaactcttctcaaggccgctttacttccaaaggaagctggagtcattcactgcaagggccatcaaaaggcatcagatcccattgctctgggcaatgcttatgctgataaggtagctaaaaagcagctagcattccaacttctatccctcacagccagtttttctccttctcatcggtcactcccacctactcccctactaaaacttccacctatcaatctcttcccacacaaggcaaatggttcttagaccaaggaaaatatctccttccagcctcacaggcccattctattctgtcgtcatttcataacctcttccatgtaggttacaagccactagcccacctcttagaacctctcatttcctttccatcatggaaatctatccacaaggaaatcacttctcagggttccatctgctagtctactactcctcaggaccctcccttccctacacatcaagctcagggatttgcctctgcccaggactggcaaattgactttactcacatgccccaagtcaggaaactaaaatacctcttggtctaggtagacacgttcaccggttgggtagagacctttcccgtagggtctgaaaaggccaccacgatcatttcttcccttctgtcagacataattcctcggtttggccttcctacctctatacagtctgataacagaccagcctttattagtcaaatcactcaagcagtttctcaggctcttggtattcagtgaaaccttcataccccttaccgtcttcaatcttcaggaaaggtaaaacggactaatggtcttttaaaaacacacctcaccaaactcagcctccaacttaaaaaaaggactctgtcaagaatagagcccaaaaactcaccaaccaaacaagtaattacactgaatccccttgggcactctctaatcggatgtcctgggtcctcccaattcttagtcctttaatacctgtttttctccttctcttattcagaccttgtgtcttccatttagtttttcagttcatacaaaattgcatccaggccatcaccaatcattctacatgacaaatgctccttttaacaaccccacaatatcaccccttaccacaaaatcttcctttggcttaatctctcccactctaggttcccacactgcccttaatcctgcttgaagcagccctgagaaacattgcccattatctctccataccacccccaaaatttttgctgccccaacacttcaacactattttatgttatttttcttactaatataagaagacaggaatatcaggcctctgagcccaagctaagccatcatgtcccctgtgacctgcacgtatgcacccagatggcctgaagtaactgaaggatcacaaaagaagtgaaaacggcctgttcctgccttaactgatgacattaccttgtgaaattccttctcctggctcatcctggctcaaaagctcccccactgagcaccttgtgtcccctgcccgtgcctgccaaagaacaacccctttgactgtaattttccatgacctacccaaatcctataaaacggccccacccctatctcccttcgctgactctctttacggacttagcccacctgcacccaggtgattaaaaagctttattgctcacacaaagcctgttcagtggtctcttcacagggacacgcgtgaaagagagaaccctgaaatctggcatgccggtgaaaggataagaatttcttatgagtcagtctctgggctctttccctctatgcaaactggttaaatataaagtagaagtcacgtatatctcctctgtaagattttaaattaattggtttaataataataaaagcttaagtcaaatattttgtcagaaaagtagaaagtgtaatgccttttagttcatgtgactttagcaatagttgggaaataaagacagttttcaagattattggaaaaatacagttgtcttcaaaatgtaaacatgtggtgtacattatgttcaaatactaggtttgctaaatcctttaacatcataagctactcctttggcttttgaaaattgtttaacttgcctgctttccagctaggtaaggcctggggacacgtggagttagccatgcccctagctgtgctggaagtagtcaaaccttatcagaaactttatcagaacttaccagttttttttgtttttgtttttgttttgacagagtctcactctgtcccccaggctggagtgcagtggcgcaatctcggctcacccacaatctccatctcccagattcaagcaattctctgccctagcctcctgagtagctggaattacagacgcccgccaccacacctggctaattttttattattatttttagtagagatggggttttaccatcttggctaggctggtcttgaactcctgacctcatgatccacccgcctcggcctcccaaagtgctgggattacaggagtgagccaccgcgcctggcctaacttaccaggttttatgttaaaattcgccattataggccagtcacagtgcctcgcacctgtaatcccagcatttggggaggccgaggcaggtggatcacctaaggtcaggagttcaagaccagcctgaccaacatggtgaaacccccatctctagtaaaaatacaaaattagctgggcaaggtggtgcctgcctgtaatcccagctactggggaggctgaggcaggagaatcatttgaactcaggaggcagaggttgaagtgagccgagatcatgccattgcactccagcctgggcaacaagagtgaaactctgtctcaaaaaaaacaaatttgccattataacatgcaattaagactactagaaacagttttacatgcaaggtgtataagaacagtagaaagtgttgggggtttttttgtgtgtgtggaaggttacaaaaggtttttgcttctttaaaatttctgagtcatcattttggcaaaataaatagtttacggtaatctggaattccaaaatcaaacttcagtttcaaaattgtctttcctaatgcctggctttctagatgaatcagagggcccctgaaaacatccagaaaagaggtaaacaggattatttgacatgtttaggtacatgggattgacaaaatgatgttaaatcttctttaggttatatttttgtgaataatatattccaaaattgtatgggatttctcaaattctaatgtctaagtatatgttaccaatcacaattataattatgttaagttattgtaaaccacaaaaatgaccaaattttcttgtataaagctactaacccacgtaaaacaacaacaacaaaaaattaattacatatcaagaaaagactttcatgttaaaccagctaatactgaaattgtttaaaatagtttataacctgtcgctttgcagatgccgtcactgccaccaggagccctgtactatcagccatggtcaaccccaccgtgttctttgacatcgcagtcacggcgagcccttgggtcacgtctcctttgagctgtttgcagacaagattccaaaaacagcagaaaactttcatgctctgagcactggagaggaaggatttggttataagggttcctgctttcacataattattccaggatttatgtgtcagggtggtgacttcatatgccataatggcactggtggcaagtccatctatggggagaaatttgatgatgagaacttcatcctaaggcatacacgtcctggcatcttgtccatggcaaatgctggatccaatacaaacggttcccagtttttcatctgcactgacaagactgagtggtggatggcaagcatgtggtctttggcaaggtgaaagaaggcatgaatattgtggaggccacggagcgctttgggtccaggaatggcaagaccaggaagaagatcaccattgctgactgtggacaactctaataagtttgacttgtgttttatcttaaccaccagaccattccttctgtagctcaggacagcaccctccaccccatttgctcgcagtatcctagaatctttgtgctctcgctgcagttcccttccatgcctagctggactgcagagttgagttaaagtttatgattatgaaataaaaactaaataacaacaaaaaattgtttataaccaatgcttgatcccatattcctaggaaaacaattaaagcttcaggtatatttggtcttctggtcagccatttaaacattttataaagggatttcattccattgttattttccatgcatgttttctggttgtagaaaagctttcccatgcaagagggctgatgttataacagtagattattatgctacagtgtattttcaccagattaaaaaaaaaagctttttatggtttgaatctgctggaaacatcagagaaagactgtccttgccatctacactataacaaaacttcaggaccttgaactttgggttcataatctcacaactgagaagggcccctccatgctcttggagctgtgcacccactggaatgcttaaggtaaaactaactagggaaatttctcccaagaagaagatgacatcattgatgtgaacagcttttcccaagttcacagattaagacttctactatcatgaaactcttatttttgaatattttttcttgcttatgccttctacgaacaatagaagtggaaaaggggtctgttatgtgcacttatggggaacatttttatttgtgaaggagtttgcagccagccttatacatggataaaggcccaatgtatgtaagaaactttaatggtagatgtgttagctcataatcaatcaaaaacaaaaaattgattcactccacataacccacatcgtgggttaaagagaacattgccagaagtccttcactcttctgaaagggcatcatttgttaggtcctttttccatggtttaaagtaaaagaagcaatgattagaaatgtatccctcatgataggttccatagcaaattctactctaaaggctacagactctaaattctcttgtgaaagttataatagaattggctaaacagcgaagtatctgtgcagctgctggcacttgtggcctatacagaaatacatcaaatgaagactatagaaattcagtggtaggagactgacaaagaaattgattagtcaagtctctctctgttgcccaggctgaagtgcagtggcgtgatcttggctcactgcaacctccgactcccaggttcaagcaatcctcctgccttggcctcccaagtagctgggattacaggtgcacgtgaccacacccagccaatttttgtattttagtagagatggggtttcaccacgttggccaggctcatcttgaactcctgacctcaagtgagccacctcacccagccgtgagtaaactgtatctagctcattcttagatccatttgattttaggaggtttggtttatggggaccttgggtaaggagtatactcccaaattcttggtattatcctcctaatagccataataatggtctccctgacgagctgtatgctctcaaaggttttaaatgcttgcatgagccatctctagaatgtcatatggtctctcttcaactggaataacaggagctcaaagaaatatgcaaccatgaggacaccataacctataaatgacatgctgagaccagaaacccaaaatgatggtaactgagagtggcactgaggccctaggttttggtcacactctcacctaagtgaaaacctgatcaaaaagggaatttttttcaacaaaattctgggaggccgttgttttggactgatctcatgcactaggccccaacaaaccaaacaaaaccaaaatggggccactcatgccaagactttaaggaaacacatagattctagaaaagactaggttttgttttttcttctgcaaatcactacaacaaacatttctgacagtataggtatccaccccctaaagtttccattaaatcttttaaccaaattcatttcctctcacctagagaccatcaagcttcagatgatcatgtaacaaaggttccagccagttccaagtgaagacaccacccctggacatcaagaagctacccttcctccactagatagagcagggtgagagttccatgatccccaataggtagggactatgccccaagccagcatgaagcagttacagaaaaaagaccatcggtccctctgcctcccataaagatttatggggatcacatctcttgaaggggcagatgaggcaggaaaatagggtctgaagtgtgaagatcgattcacacttcagctataacaggaaatatcctctccatagggtgtatgactatgtaacttgaatacttcatcctctccatttacataaggtgtatctgaagtaaccaatggaatcctctgggggtaaatgccccacaattctgtaacgggacctttgagcccctacgctccgcctgctcccacactgtggtgtgtatgttcattttcaataaatcccttcattccttccttactttgtctgtgcattttgtccaattctttgttcaagacgccaagaacctggacaccctccaccggtaacaaaggggcttaataaaataaggagttgctactgagggtctaggaagtggtgaaaagggaagagaggaggaagcaaggataactagagatctatgtgaagtgagcacgggacagaagcactaataggcctaggagagagggggaggaaggagagacccagcggggcgcaacctcccaagcccagcactcaaccttgaatagggtggggtgcggggtggggggagctccctgccaccaaccagctatcaaaaggggcagtttggactttaaaggagttgtgagagagggagggagcagctgaagccccaacacaaactagcctgccttctcacccacccccagcccagtcatcaagccggccaacacatcttacccttccctcttcgtgactgacccattggaatgctctgagttgtaaagacctttcacttaaaggaaaacgtactgtccctcctggtctcccctcccagcccccaaccacccctgcgccacctccgttccctctcaaccggactcttagcaaagaacccaggtgtggctgaaaggctgcccaccgtgggaacagctttagcagttttcccaggaaaaagccacaagccctggaggcacagaggcccaaagacaaaaaaaaaaaaaaaaggcctttcctcctagcaggaagcaagcccgattcttgggaaagggaagggacagactcagagcctcagggccaaggggtgagatccagcaccccagcaggacaggaatctagctgggtgacctctctgagcctcagtctcctcctctgaccatggggacaacaaacttcgcttgcaaggtgtgcggagggtaacggatgtagggaggcatttagtagggcttgttctctaaccacctctctccgagagtttcaaagggagtgggatctggggaaggttgaggcctcaggcctgggaactaggaatactttcccttttacccaccaccatcccaggcctggaagaagatcagaagttggacaggagaggtccggccgcgcggacgtcaccttagcgcgccactgtcggctccggtgggctcgggtgagctcgggtgaacgcagcgagcgagggcagaggccagcagaggcgaggagtggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccggggggcggatgggctcgggctgtgtcgaggggaggcggaggtgagcgacccgcgaagagcgcaggagcaggccgggggccacgctagggcggacccaatttcggaatagcgcggcccgggcggcggcgtgcgctgggaggaatgctgggtctgtcgctagcgccaaacttgaccacgctgcgaccttttcactctgtgctctgaccttcaaatctccctcccccgattttttttttttttttttttttgagacagagtttcgcttttgttgcccagggcgggagtgcagtgacatgatctcggctcactgcaacctccacctcctgggttcgggcgagtgtcctgcctcagcctcccgagtagctgggattatagacccccgccaccatgcccggctaattttttttattttatttatttatttatttatttatttatttatttttgtagtagagacagggtttcaccatgttggccgggttgatctcgaactcctgtcctcaagtgatccgcctgcctcagcctcccaaagtgctgggattacaagcgtgagccaccgcacccggccttctcccaatttttaaaactcgctggctgggctgacagctacagggccaggaattcaaaacttagcctcaccagtctcccctcctcagaccgaggaggttgttttgttttgtttgagacagaatctcactctgtcgcccaggctggattgcaatggtgcgatctcggctcactgcaacctctgcctctccggttcaagccattctcctgcttcagcctcccgagtagctgggattacaggcgcctgccaccacacccagctaatttttgtatttttagtagagacggggtttcatcatgttggccaggatggtctcgaactcttgatctcaagtgatccgcccacctcggcctcccaaagtgctgggattatgggtgtgagccaccatgcctggccagacctggggtttggacccattaaagagcttccttacagatggctggcggtcttgccaccaattgtttcaaaagtagatgtctggtttagagtacttaagacattcacagattcaaatgttgaattttgaaatatccctgatatatttctgtattgtattaccaaaaaaaaaaaaaaaaaagaagttagacaggagtttggaaccagagaacagcctgttgggggagtggggactacagcagggctacccaggcccctcctcctccctgtcccttcggctcccaccctctgccaggcttacctgtaaatcgggccatacttctggaaattctggacatggtgaaggtggactttgtgtgtgcccgtctccctccagaaatggtacaggtttagccagccattgtcaccaggagaggggatctcattgaaggggcgaggactgcgggtggagatgccagctccctcgccagtgggcaccctgagacgccccagcccctccctgggggcactcagaaaggtctggcagcctttgaccaggactgagcgtgggggaagacccttggccagcatgctgtccccacagctgtgactgtacctgctccacttcagcggggactgctaggatgactgtagccctgggccaccagggccaagattataactaccagctcaaggccataccagaagctgataaaatgttcacgtccttcctcctgctgcaggctcaaacccgcagacagctcctcccctactcggtatgaaggttcagtctggaatttctgcagcgtgaggttctccaaaggacagggagacccctctgtctctgccctcagtgccagccctagcagactcctgaaatatctgcctgtgcttttgcctgagctggggcctcccactggcccctgcagcggagtccatgccctggcagccattggtcaagactgcagacaacctgtgtttgggggaaatgaggggcccaagagaaggtcagagctatcttgccagcttgggcaacatacgtcttagttatggccccactgtatagacacacatcattgaacaacagggataagttctgagaaatgcatccttaggctattttattttattttattttattttattttattttattttaagagagtttcattcttgttgcccaggctggagcgcaatggcacagtttcaccttggaaccctaatcctcgtcgtctctccccagttgacccagatttggggctgtaattcagtacagctgactcagaggggctctgggtcccttgagctgaggtctgtggtcaggctccactctggacacactctaagaccttggcaaatctggttgccatggaactcaggatgtcagctcttccctgtccacacacttgatctgtgctgctttcccctcagagctgcttccataccccctcccatcatatcatatccccagacccatccttccagcccaggtcagcccccacacccaccccccatcaccctgcacctaccactttcccaaacaacaagggtcagtcacctgtagagttttcaagtcatttcaacaaaattacagcccacttggtaaaaatgtgtaggtcagaaaacatacatgtgccatgtagagcatttcatgacagcaatctacactataccttatacttatcattggaaggtacaacttcttgctttttttccccaaaatcttattttctggcaaataaggcatttaaaacacacatctaagagacagaaaatagactggtggttgcttagagctagggggatagaggaattagaggatgggacataaagtgtgtagggattcttaggatgatgaaaatgaaaatattctaaagtatattgtggtaattattgaacaactctctgatacactaaaagccattgaattgcatactttaaatgggtgaattgtatggtgtgtgaattatatctcaatagagctgttaccaaacacacacacacacacacacacacgagtgacatcctcctggcctcttctgttgtatgtgtcagcccatagatcacccacaatggcaaaagttgtccttacacagccacttgaccccagactccaatactgttgaaccactttcaacaaatttagagcaacagtttttagaagaaaaaaaaaaagtacttatcaagagtggttgttgctcttcccgctggagtgaccactacctcatcagtcatgaaccttctgataaagagagtatggagaaagcctgttttgcctcactgatgaccttgagcctggaatgacatcagccaaggaaggcagtgtctcacgagcagcggcagggtgatgagcttccacaaagaaaagcagtcttccaaggactagtttttcctccaagggtctcagcactgaggtgacatttataactttctgacttaaagtcaatcccattgttctacgcagccccacattcctccctcagaaggagccctaatcgatgtggcatggaagaacttgtggtcctcttggcagccaccccaacttccgttcaggcctccgcacctcccccagtgttgtggggcactgaccgcctccccagaagtggcccgggctggaggttattgcctcatcctctccaatggccatggtcacatcacagcataggccagcgattcagtttgggccaatgaaacacagggaaaggtttgctgtggcttctgggagaatagctccctcacttctctgaaagagcttccagaaacacatcactcactccaaacaaggctgaatgtattagctgtttactgctgcttaacaaattatcccaaaatttagtggcttaaaacaataaatgtttattatctcacagcttccgagggtgcagcacccaggagcagcttttctgggtgactgggtggctgggtggctgggtgactgggtggctgggtggctgagtggctcatgctcagggtttctcacaagcggctgccatccctgaagcttgaccagggtgtaggatcagcttccaagctcagtggattaaactggccctgcttcaaaacttttcagtggctgtttcaggactattgagaagattaatgaatgatacatacatttcaaaatatatatattacacatatacatgtgtatattacataatttttccctccctctctctgttcttgccagtgcccaaactgaaattttcaccctctcaaaagtgatgggaagttagggtccaaccctcaccaagccccttacgatgggcaagtgaatcctctgctaggtgaggttagcctagtgctcggctatgccaaagtccttcttggctctctcaagacaggcccatacttatagtgctttctcctcccactcctgcctcccacattctgtaactatcctatcattctcagagtagagggtgtacacatttagacccatctaaacgttgcctaggacggggaacatgattttattcattgcaggcagcttggatggataaacagaaaatccaaatcacagacttaaagaagatagaagtgtattctctctcccataaaggatgtccaaggctgggcagtccagggtgagtgtgtcagtcccagcaaaatgccaggctccatcttcctgcttcaccacgaagacatttggttggcatttctaaggccacccgatggtccaagctgctgctggagcattaaccgtgttgctggccagaaggcggaagaactcaagaagaccaaaaggggccctccctgaagagccagcttcatttaagccccttcctcaaagtcccacacgagtccaaccatatctgattggtgggaacttaaccacattgaggcaggagaatagggaattagggcaaccaaggattaaggtaggaacaaaagaagagcaggtgcagccagttcacataagcaaaaggcacagcaggtacagccaattctaggcaggattaggcaacatacaggccacatcttcacttctgtgataaccacaggccaagtcgccacttaagcctctaattggtcacggatcaatccttcattggatgtaactgattggaggcctctggagggcaccgggggtgttcatgttctttagcttaataaaatctctaattgaaggggctcctgagccacttgctcaagcccactcttgctctgtgaattgtacttgcacatcttcaataaatctgtgccttcattactccattctttcgttgctttgtcttttgttgctttgtgcgttttgttcaattctttaacatgccaagaacctggacaactcagtcaagaccttccattcagtaaccacatgactgtacctaggtacagggaggtaggtacagggaggctggacaatgtcgttttgctctggatggcaatacatccgctagcagaggtgctggccagaccatagacataataatacagttttgtatcatgaaacaagcaacggttttggagccacatggactcaggttcaaatcctagttcaaccactgagtggtcgcgtggcatagggcaagacacttgagctacttgagacttaattttttcatatttaaaatggagataatcagacctgcctctcagagctgttgcaagataaaaaaaagcacttaaaagattcagaggttctcaaagtagcccacctaatatcattgccttaaacatcaccctcttgctcagcttagggtatggacaccatacatgaaaattaggtgattctttccctgtttgttttcacatgcacagctcagggtatttcactaagtcagatggtccccccgactccaccctatttctttctctgagggcatttcatctgtttcggtgtcaccccactctaacagtttaaagggaggagggagaggcaaggacctaagatgtttggagagaaatcagccctagagatgggactcaaggttatggcatttctcagcttaagtatcagatgtggctgttaaaactattattaaatagattccttttgctgtttggggtttttcctgtttgtttgtttgtttggccttgggaggggtcatgtggccatatggtaaagagacattcccaaggaaggaatgaaacacattgttcctgcccgggccagggcttatgtagtcagggattatgaagactgaatgttctgtgtcctggaggaaaggggtccctgctttggggactgtttctttttatggatcctgggctattccttctgtccaacaagagtgaaatgaagggaaatacgggacagagttgacatagctttaggggcaggagtaattggggtaaaggaggggagaagactggacccagaagtcaaaggcccagagcccccggcaaaggagtgttgccaggttgggagcctctgcaaagggcatctctgagggctgttcctaggggcccacccattgcagccctcctatgagaacttaactccacatggtgaactggaacctgagccctaatcttagctacccagggcagcctctccctgctcctctaaatcctcatcactcctgtaagtccagaggaacccccacaccccaacttgaagggtgaatgagtacccaggcactccctgcctgggtgcacactgtggctccttgtccccctctatacattgcccaggctggctttgaactcctgggctcaagcaattctcctggctcggcctcctgagtagctgggaatacaggcgcgtgccaccgcgttcagcttcatttttatttttacagcttcacttcacttcctcagtgcaaacatgttaaaatattaaaaatttgctgtaaagtttttgaaaggatatttataattttgctcttgaaaccatttggctaggagtgactgatttaaattacaattgggaattcttgtgaaatgagaaaaacctagcccacacattctttcagatgtaatgaaatttttatgaatactaaatttaacagttaatgaggttgatataatgttacagttggacacttgattaagaatttattgatttccattttgcagtgttcttatttgagagccaatcattttttcttcagctgtgaaatattcacatgggcccttgggaggcccccgctgcgggcttctctagcgggcagtacataagtaaccaggccaacagctcttccctgtcctccccctgacacacctcgcacccctttacacaggcacataaggaaaaacacccatcgtggctggaccatggagacagagtccagttccagaggaggaagaggatggggccagtcagacaagggcacagaagccatgccatgccatgtcatgtaagcaagaagcttcttactgcaaccagtggctggggctgctaagggcactaagattcaagaccagtgagccacggaggttggcatgggcacctcttccctcctggggacagtaggtagtgggggcaggaggggaagggccacctgcctggtttacatagtcggccacagagcggtggcccacacttattcgacgactatagcctcagtgttccaggcaggtgtgcatggggccagcgggctatgagaggcttccacgtggcacaaggacagcaccccacaaggagaacatgaaaaagctaacacagtagcacaggcaagtgcacagtaccccagcctcccctcggaaccagagggcggagtggactgaggccaccctcagccaggtctgcggcagaagctgaggcagagaaatgccactttgtccttgctccagtctctctctcagccattcagataccgcttccttcactccagagcctcagccggcgcctctcagatcaaaccttgtgccactaggtggagccaaagcccacagcaacagcgccgggctcggacacccagccgcccgcgtgcaggaaggaggtgggctcgcgaggcaggggactgggggccccgggctgagtctgggccctaccggggggccaggaaaggagtgggagagccagccacagcccacagtggacttatttggtttacatggtccgttccgtccgaactcgcactgtaggctaaatggtcccagagccaaccccggcagccgcaaatccccgtttgtcagataaggaggctgagggcctgaggggaggatccaggagagccagaacagggctgaagccagagcccgcgcccctgtccacagagccttcccctgcaccgcttccgggatgtatcccctgcccgtggggagggcgcacgagaagaaggtgcggcttccagaagggagatcctgggaacgaggccgggagacacgcttggctccggagcctaggactggctccggggcacgagccgcagtcccctccagcacctcctggtgggggccgcagctgggatgctggcttcgggcgccggcggccggagcagcggaaagcatccacctacagaggctgcggtggagggggcggggcgggcgcggacccggaggcgccgcattggacgagggggttgctggggttctcggattggctggccatgagggggcgggaccaaggccagggctgagaggcgtgaggacctggagcgtgaacgcgtggggaaggcgcagagacctggcgcaggtgttgcggagccttctgagactggcctaagctgcagaattgatcgagcatctggagtggccatcggccgtgttgcccgcagacacaggtgtgctgcgacagaccaagctccagggtccctcaggtagccaggtgtgcggcacagctttgtccctcccagaactcagtttccccagcagggggcccggggactattccaatccagtactctggcctgcccctcccctcgctctcactgacctcccagcagccagaccaggtaggtatccaggctccttcctatcctgccccctgccccgctccatcctcatctttcccttaaagaaacctctctccaaggtccacggttacatcacatacagctttgcacacccagtgcccagcacagaacccccaccctctgtggttgtcctttcgcttctcgcaaggtccatgggagcaggggaccaggctgggacaacatgtggccccacctggttgctataaaagctcaggtaaggaagtttacagaaatatgttggggttactgcacctgtaaaaagtgaaaatggccaattatcatcaatgtcaagaagaaaaattgcccttgttgccctttcactgtagtaaagtgctgcttccaacaaaccagcacacaaatgccaaccacaggtgcattccgcttgggaggatgggggagaaactagttgtttgactctgtacaagaaccaatcaccaggtttccttaaatggcacactttctttgaaatctgaagcaagaaattacctctccggacacaaccaagttcatctcgtgtcctctcaggacatacagccgggctccactagagggcagcagaaagatggagatgctcgagagaaaaggagacttaagttagttctcaccatccgtggagggtgtgaggaacccaataaaaaccgtactggtattagttcctatttgttgactggttactctaggccagccatccctctgactgatctgttaaaaaaaaaaattaagtaatttgggccggacgtggtggctcatgcctgtaatcccaacactttgggaggccgaggtgggtggatcacctgaggtcagcagttcaagactagcctggccaacatggtgaaaccctgactctattaaaaatacaaaattagccggccatagtggtgcatgcctgtaaccccagctacttgggagactgaggcaggagaatcgcttgaacccaggagggtggcagtgatccgagatcgcaccactacactccagcttgggcaacaagagtgaaacttggtctcaaaaaaaaattaatttgatcctgccattaaccctatcaaggtggatacaattgtgttaaccccattctacagctgaggaaaaaaacaagttgaataacttgcctaaggtcacacagccaataagaagcaaatctgggatatgaaccctgaagtagagctataaatctgacattcataaacctatgcaattttgcttccgttgaagagggagggaaggatggcgagcagaggtggcagctgaggcccccacagatattacccttgtgggctctttaaggccagttccagaagcaggcaccagacaggagcatctagctaattaaggaccttgggtcatcaggcaggtagggtcagaaaatctgagctcaacctgcacataaaccccacacaccttgcaggaacctgtcctagcccacccatcaccatgggtggcccagctctccaataccctgggtgcctgccaccatggtgaacccttgtaaccactgtgtcccctctggcttagatgtgtgaaattgaccttgacccactctcttccttaccttataggcagccttgcctgcctccaccatcagccaggatcgggcctcctcatgtcagtcaagaagatgccaatcagcagcagcaactgctgccaagaagctggagtccaacaaggatcaaggggatgctggtgggatcctttccagggcaaccttgagaagagtttcaggccagagcctaatcctttcctgattttcttcccaatttaacatttactgagccgctactgtgggcaggcaccttgctgagtgcacaagggggacttgctgggtgatcttgagcacactctttaccacccccacctcagctcttggttagtttctcttctgtaaactaaggttgcagagaccaggggttctttactcgggactgaagggtcccctaaaattgggtgtgtgtgagaacatctttctggggcagggtttctcagcctcagcactattgatacttagggccagatcattcttagatagatccctcccagaacacacctgtgggctggcatttgcgtattggtttgtttgaagtagcactctgctgtagtgaaagggcaacaaaggggcaatttttcttcttgacactgacaataattgaccatttccagtttttataggtgtgttgtgacctttaactccaacacatccctgcaaacacccttagcccaaaatctgacctgtgcattgcaaaatgccaaaacccactaaatgcctctctgaagcctcccagccccacggcctttccacccactccacctgctgtggccaggctgggaggggtgcaggaaggtggcacactgccatgtacaatttggaagaggaagagccaggaacccctccaggcccagctctctgtgagccctgccaaggccacctacacctgcctgactctctggggcccctcagccctggcctgggaaagaggcttcgcccaaatccaagatgcaggcccctgccacagggcttacctacacccctgtgagagccctgggtaggggtcagaaaatggggcagaggccagagccagcactgggggcagaagcaggcagtccctcctcccatggttaagcctgcatcctctctcctcctgcgcggtggcccttcctcactgagcacctgccaaatctgccaggtgcgaagcctgctgtcagggccagaaagtcagaggcaaattcaggggtgagctgaacagtgtttaacaaccaggtctctggactggggtgaggggccctgatttgtagtctttgcctatttctgtggtgcaaatattcctaccctggcagatataaagccagcagtattttgtcactgagcgtggagctggttcacaacatcacaaagtgtgtgcaccaccaggtgcaatagacacaaattaccttacgagcatgaataatggtaacatatagtaaaataattaggaaatgatgagttgctagtgggtatttccttttttaacaaaatgtatttaaggttatataatttaagtaccgacaatgactgtgcttaacaactcgttcgcaaaattctgaaaatgtggccaccagcacctatgagccggtaccagctggctgcaggcccatcactgggaattgagtgtggtccctgctctctgaaggcgacaggtctacccagggtgggccggtctgtggggggacagagggatgcatgggggccacggagaaccagaggagacactctgtgcaggggttcagggaaggcttcttggaggaggcagcattatagagaacaaaggggagggtaaatatatcccagaaaagggtaaggagagagtgccaggctagagaggacactggggaaagaccaggagaaaacaaagtgtttggcgtggtccaaaaactaaaaatgtgtgtctcagtctggctgatgggatggctgggttccagcccaggttctgctgctgatgcctctgtcacttggaccaagtccactccattctctaggcttctcgcctctgtcaaattggggtccgaaccagatgggttccaggcccgctggtgatctagacccccaagaagtctgcagaggggccttgtgaacatgtatatagctcatggaggaagtctggcccacaactgacacttcacaaccagatcttcccctccctcctcctctccccttcacccggttcccccaggtgatcctggaaattctggtttggcttcagaaagtaactataattacagccttttttttttttttttttttgagacagagtttcgttcttatcgcccaggctggagtgcagtgacttgatcttggctcactgcaacctccacctcctgggttcaagcgattctcctacctcagcctcctaagtagctgggattacagggggacctgccgccatgcctggctaatttttttgtattttttagtagagacgggtttcgccatgttggccataattacagtcatttatagaacactttgctgcctctcctaattaccaagctgtgcaattccagttacgcatgtaaggaaacatctcaggaacccctccctggggccagcctgtcaaccgcagcccccaggccagctggaatggagtgggagtgcccgtggctgctgctgacgtctccctcctggcttcctttcatgccagaccaggaaggaaaccttggttcaaaggcctgccctggggtgggtgtgggatgaagagagacagggaaagtccctcaagatgatgagcttgcgacatgggggaggggagagggactccttctggtgatgcagaaggcctccgtctacacagcaggtgagtcttagaatgccggggcgggtcgtggtttcacagcatgagttagagcttgttccccaggaaaggggctgtttaagtttagaaagcaatggtccttccactaggtacaggttccccggcctcatgtccatcaccaccactgaagctcccttagcaacagccctcaccctgcagagcagccatccagccctgcctctgatgcctcctgtgactgggattagtaccccaagcctctgtgacatttgggtactccattaatgagaaagcttttcttccatcaagataagcttccctctgtgcaatttcttttttgttgttgtttggagattttgttgttgttgttgttttgttttgtttttttgaaacagagtcttactctgttgcccaggctggagtgcagtggcatgatctcgactaactgcagcctctggctcccgggttcaagagtttctcccacctcagcctcctgagtagctgggactataggcacacactaccacacctggctaattttcgtgtttttagtagagacagggtttcgccatgttggccaggctggtctcgaactcctgacctcaggtgatccacccgcctcagcttcccaaagttctgggattacaggcatgacctaccacatccagcctcctctgtgcaatttttttccgttttctttttctttttcttttttttgagatggagtcttgctctgtcgcccaggctggagtgcagtggtgcgatctcggctcactgtaacctccgcctcccaggttcaagcgattctctgcctcagcctgccaagtagctgggattacaggtgcccgccaccacatccggctaatatttttttttttttttttttgagacggagtctcgcttctttgcccaggttggagtgcaatggcacaatcttggctcactgcaacctccgcctcccaggttcaagcaattctcctgcctcacctcaccagtagctgggattacaggtgcccaccaccacgaccaactaaattttgtattttttagtagagatggggtttcaccctgttgcccaggctggtgtcaaactcctgacttcaagtgatccacctacctcggcctcccaaagtgctgggattacaggcactagccaccacgcccagcctatatttttagtagagacggggtttcaccatgttggccaggctggtcttgtactcctgacctcatgatccacccacctcggcctcccaaagtgctgggattacaggcacgagccaccacagccagcctatttttttagtagagacagggtttcaccatgttggccaggctggtcttgaactcctgacttcatgatccacccacctcggcctcccaaagtgctgagattacaggcatgagtcatcacgccccacctcctcttttttttctacccacaggtcccatctcaagtctctggggctactactccctctgccctgggtgtgccaatggatactgtcccccctactggtcctctcctggacaggtgtccagctcccctaaacctcgcctggttccttagccccaccagtttctgagacagccctgatgtggaggctccctgggacttctcactgtacataccacctcccgccaggtgcccacactcagtcctaggcacagagctggcaatcccaaggggctccactcctgagccccagcatcccacctcccacaactcgaccatctgggtggcccccaggcccacacccatgccacacccaaatccaaccccaccagcttcctctgcccctgcccctcaccccaggcccctttcatccagtcttcaaagcgtcaaactgctgctccccctgctccttcttccaagtgtctccaaaccccacccctctcttcccagaccccgagccctgcccatcaggccaccatcctctgtcccctaaattctgaaaaggcccctccctgctctccccgcctaaacccgccccctcccatgtgtcctgagagcagcatagcgtggaggttaggggcagggctccagtgcattccatcccctgctcctccactcactgactgtgtggccttaagcaagctgctcaacctctctgtgcatcgttgtcttaatagtatctctctcctagagttgcctgtgaatagtctggttgccaaggaattcagagtggccgatagaggacagaagggaggggtaaaacaaagcagaaaggggcacaggagccaggtccttaagtccttaagaccttcaatgctcaactaaggcctgggaaatttctcctgagatgagtggagagccttcaggatagtcttaagtctctgatcaatgttgtgcctttggaatgtcttggtgcctatggtgcctatggaatgtcttgctttctttcctgcagagactgagagcccctcctgtcccaggggtgctgagaggtctgtctctggctcccccaccgctcccatgtctctgctgggactggtaagtcatggagctatgcccggcagagttctcttgccagactccaggcctctctcaccacaggagatcaggactggactcccaggggtctgacctgacttccaaccccaggagggtgggtggtgtccagcgagggcttgtctaggtcgtccagccttccgctgttggcctcagggaccatccaggcagcctgcccaagttactcttgacccctcctctgacacagactctccacctacctacaaagctctttcacaaatgtgtcattattttgtttaatcctcataacaactctgggagttgggtgttattatcccattttacagttggcaaactggataatgtatgatgtcttacctactcgctaggagcccagtcacaacggttcatgcctgagtgggaggaggattgggggtgctcctccacccacctcagccagccaggcccagcactgagtgaggggccaagtgggaggggaggcagcctgtggcggcgggaggggggcccagggaagtggagggcaggtgggggctgctggcactgggacctgccaagtagagagcgaggccagaaggggctgggaggccttgagggcagggagagcaggaacgggaatgaagaggcaggctaggagcaggctccaaatctgaaacctgggaggaacctccttgagtcaccctactctttgtacagatcaggaaattgaggcccacccagtcaggaagagaaattcgtctaaaaccactcagcctgccagagaccaagccagaatctgtgccagagcgcacccaggctgttcctggagaacccaggaaccagccccacggggccaatcagctggcactgggctgaccagcaggcactgaatgaaacttctagcctccgggcctctctgggtggccagcagggggcggtactgccccaggagtgacagctcccagactcccagccactgccctcaggcccatcccaaggtcccagggcagaaccagggctggggacacagaaggcataggtgggaggcagggtttctggggtgggaagaacagcacacagagctgagcatgggactccccggccccattctgatgccagctccttctaacctgagcgagggaggaaacaagcccttcctttctccttgcacctccaccagttgagagaacattctagaaatgcacccagctccatccaaagtctgctctctcgagaggggaaggggctggagaagagactgtctcccaggccacaggtttccacagaaagttgtcctgcaaaggaggctagacctaaggagaaacttctagaggcctctatactgagtatccaacctcaattccgggagtgtccctttcccaaaataatgctctaggagaaggtggggaaagggtggccaactgcagtgctatgtgaagacaggggctagatgtccttattgctgtttcaggaccctcttaggtgcgacaagagagaattttctccaggatggctaaagaagagcaggggcatgggggagtgagcagggccgcaggggtcaagaagatgagccactctggcccccaggagagatggccagggtgcagggggctccgtgtcacccccatcagccctgggacccttcccaatggcgagggcttgtattcctaaccaaacttctggatctggtcccagcgggaacccctgctataatgagtgcccccaaggcctcccttcaaaatcccaggagtccagcttctcggggcaaaagccccacagcagctggcaatacaagatctaggaggcaggggatcttgaggccccaggtcagaaaggccccacgcacctgcctctcccaagatttaaaataccagggggctaggggttcccatcccctgctactaggcttcgtggtggtcctcagccccaagcccactgtgccctgtgcagcatggacagatggtctccaaggggcccctttcagcaccactccccttggtttcccatcaatgccaccatacaccaaagttcacacactgtctactggaaagcccctgtcagggccagttgtcctacaattaactcttcagttctcccaggctgatggttccaccacacagagagcagacagggtgggcaggggcttggggagtcacagcaggcacccagggacagaggggcaaggaaaatggagatgggggcacattcagggggtggggacagcatcctggcaggtcccgggcctgcaccacctggaggagccggtgactcacggggctgacagaagaactgaaaccagacaggagagtgcaggaaggaggaagaaacacccaccaggtaacctgtgtcctcagacatgtgcacttccaggccagagtttctatgaatcagtgtctctagacacaaccaccttgatcccttccgttgcctcatgctgacgtctgagtctggcccgtggccatctaaacccccgcactctggttcaaccaccatcaggcccacatagcagctgcttcagatcaaaaatctcctcttcaggggctttttcaccaagctgatggtaaaggcaggactcctgggtcccggtgtccactgcagccactctggcttccccttagcccctctgcaccccctgctcaccacctggccagtgtttctgctcttccttctgcctagcattcccctaccacccctgctttgcctagcaggtacctactcatccttcaggtttcaacccatgtcacctcctccagtgagctttctctgacctctcacctaagtcaaatcccccattacatgtgctcctggcaccatgcacccctctctgagccctttgtagagtttagttgtgtggttagtgatgagtgcctgcctcctgtactacagctgaagctccaggagggcagggaccagggcctggtctagttcaccctccattgtctctgcagcatgtggcagagtcagtgctaggcacatagaaggccctcagtaaacgtgctgtgaatgagtgggttccccagccagctggatgtcccacggtttcccccaccccaccccatctggctctagctcctctctgtgacccttttcatctgcagtccttggagcctcctaatggttgggctctgtggtggggaccaggcaacctgcccctggggcctcaagatcaaggcaagacacaagactcaatacccctccaacaggttacaggggcagcctcagtggcaccaattgctctgacccgtgactcagaggaagccagtcctccagagcccacatccagtccacatcctccttgatgattttgcatccagctgctgttccaatctcagggcctatggccctcagggactatccagcctccacctagaaatcagacgaccagaaatggttaggacccagcccaaggtcacacagcatagctgtcacagagccgcaccaagaatccagggcgccaactctagcatagggttctccccatgctataataaatgtagctatttttaggaagtgaattagcaagtcaaatatgaagtctactaataataccacatttctgcttttcagagtcttcatcaccttatttgctcctgcaacatcagggtgggctgggcactgaagtaggtggtgagctcatctgaaaggtgtggtccagagagaggaagtgactggtcctgaaacgcaataagcccagccttcctgcccgccctgctcagtggtactcccagagagggtgcagtgccccagaagtccccttcccagggcctggctggcagcctcccacctgggcaggctcctcggggcactcagaccagccgctgcctccctcgcctgttgtcctcttgaccctcccaccccatcccccaagctgaggtcagcctcctgcctttcctggcccctggcagaccttgcttctgtgctagctccagcccaaacctgcattctcacagcctgtgggcctcaggtggcctcaaggcctggcatccagttgtattttttcccctgcaaattccttagcacatgccaggggtagctctgagcaggaaggcacgggcagccagctttgcagcctgagctcccctcaacttgggacctcagttccccatcaaaagggacaacagcctcatcccaagaggggctggagttagatccagcccctagtcctgcagccccatctcctaccccttccccctcccccacagaagctcctcagacatctggcagcaccagacagggctggatggacggaaacatgaggtcagatcctcaattgcttcctgagcccttcccagaggagcagggcgcttcccaactgggaaacagctgagctgctccataaaggaaaccggagaggcggggagggatggagaccattgctggcagaggaagcgacagcgcccctatttctcagatgggcaactgagccacaagccataggccagcatgctgtggccaccacaagcccccacctcttgtgaaagtctctactgagcccaagggcctagcatgagccaaggagggggttgggctatggctaaaaggatatctgggccagctcccaggagccttgactcccaggacagggacctgtagggatgggtccttcactcagactcatgctggggaattctgcagtcaggaaggcttcccggagaagggtgctgtggggggctcaagggcaacaaggagggaggaaggcattgagatgggctcagcaggtgcaaagggcagagcagaggaggcgctcagagatccccctcaggtaaccgacctggcctgtctcgcctcccggcaccggctggcttgcagaggaagatctgggctcattgtccattgtaagctgggtatgtcccagtagctcaggctcctggaccctgctgggccagcagggaggggcgttgtagcaggagggagacaggccaggccatcctgatgaggagagaggagaaggaggggcctccccagggtggcaggcacaagcctgtccagggaaacccacagctgcacagggggcaagtgggtgcctctccctctatccattatctggcaggatgagatgggcactctccttgcctaggcccagacctggtccccacagccgggaccccccacccggcattgtcctccctagggagccatgctggttgtgggactgcggccatgcctggcaggggatggtgccgatgctgacacagcaagaaccaggccagccgtgaacaaagaaacatgggaaggggccacgtctgcaggagtcgttcctgaggtggcggccagcaccgtggactgtaggctgaggaggcacaggacggcctctccctgagtgttccagccagcatgttcctgatcagatactcgggggccaaagctgatcaaggccctcggggcacagctcagtccaaaaatccccatcacctccccccagggcccaacccccttcactcgtgacagaaaaggcctctgaatcacctctcaaccctgacagcagggtccgctcaccacccccactttttttgccatgatccccctcagggtgggaggcgagactggacaggaacaggggagcccagaagggcccatcctgggcccaaaggcagacagcacccatacagcaggggctgcagtgccctgattggcttgtggcaggtgttgtgggggaggcacccagtagcagggcagctggccaggtgtgggagccctgacgttgggcctgtcacacagcatcagggaaggagctgctagtaccggtggggcgagggctgggagcctcggggaagcggtggcttttcagctgagagagcgagaaacattggctgaagtggagttggtgccccactttccaggagggctgcccactgcccgcagggcccccggtcagggcgggagggctcggcaccgagaggtccaccgagccagaccaggcagagagagcacatggaccggcggagaccaaggtcccagagaggtggggaacaggaggcgccccctcccctgccacatgaggaaagtgggcatgctgggcaggaagggaggggatggtgccagagaagagtgccagcgtccagggtgagggaatgccagcaccatagactgtgggtggggcaaggtaggcaagtccagtgtggctccagggtacctcagatgctgagatgtaagcagggtagggacattttatccatagccaggttctgggagtgcccggggacagcattacccttagatgcaagcaagaaggagccctgccctggcacctgcattctagaggattccactccagccttccactggccttgcccctccaacagggaaataaagtccatgagccaaggaaatgtgtccacccgagccccacatcccccctccaaatgcagaaccccagaattccctgcccacagggccccaaatctaactccacagcccacgtgggcctttccgctgggcctgccttcctgagaaccgacctgcagcgggtgtgcacaccccaaggcctcgggagtggccaaggggcagccactgctacgtatatggatgggtctgggaaggtcacacactgcccaagggggagcccgggatgggagctggggttggctcagcctctgcctgccacattccagtcctgcattccaggagcccaagaattctaagtacaaacctggtcctcagggtgttatgaaggtgtatttgctaatgtaggaggatagagcatatcctatttagaggttgttggcttgatttataactttgaaatatccagacatatagtatgtgggcctccatttttactcctgccctgggcccaggcaatgttaggggtaggatcagagggcaagccctggcccctgccccacccctcaggagacccctgctctccagccagtgagcgctgccgaaggagggctgggcaggaagccagcagccgagggagcccatatgcacctgtggacctagcttcagggctggtgggacctagcaggctgggtccttggggctaggagcaggggaacccgagagagcgcttctcccagggttgagcttctgcttgaagctgggaaagccacagagaggctgagcttgtggcccagggacacccagcctggatgcggctgctgtgccctccccctggaggtccctcctgcttccaaggctcacccacctgtgcatccagctcggagctcagggtgcttcgatcccttttttgagttcattcctgtggccaagcccttcccccacggtttcccatgctggcacctcaggaggatcctgccccttgttccctacccagcttcaaccccttcctccgaggctccaagccccctcacccccctcactgcaaatcacctttcttccattggagccaggatcttagctcagggagcgaccccagccccagtatacaaagagaagcctgcggcccacagtcccagagcgaggctgcagctgagcccaggctaggacgggtctcctgccccaccccttcagctcagggggcatcacccacctctttggagcctcacagacccccctggttcaaatttccactaacactctctgtgatctcccacaagctgctttatattctgagctccttcatttatgaaatgaagataataaattttgccttgtaaagtcgttagagggattagataaaatacacgcataggccaggccctatgccaagaacaccttagggctgagacctccttccctgcctcactctggcaatggacattactgagcagcaccaggatcccgaggcccagacagatgtgcctcttgccctccaggagcttccctcatgctgggaaaacagacaccagccaggaacccgcaggaggctcccagagacggggagtgtccaggagggagacgaagctggaggcaggaggggagggcaaggggttgagaaggctggtcaaggagggcctctctaagaatatgccctgaggacctaagggaaccagttgtgcagcatgtggaagaagaatgttctagagagggggaactcaggacggtgccttgcaggttctcagaaacgcctggcgcttatctgagcacacactcacggaccctgttaccacaccacagcggggcctctgtgtggggctgataaggccagaaaagatctcaagatattttctttccttttctgtgagtggcctgagataggctgtgtggggacatttggctcacggcctgcctcacaggccccccccgtcaccagggcaccatggagcactcactgctggacctcccagtggggactcgggattggcccccgaggggggctgccagccagtgctgggggcccatgcgtgacggggctgacctggctcccctgtcgtgacccacagaggcctgctctctgcttgtgcagtctctgcctgctcgagtgtacagcgtacaggctctgggctcagagatgagggctggaagccagctatgtcaccttcattccctcacctgtaaaatgggggtgctgacagtaacatcgtcctcagagggttcctgtaaaggagtgggggagatggtgctagagcctggctcatccaaacgccaggcaaggtggctcacgcctgtaatcccagcactttaggaggccaaggtgggcagattgcttgaggtcaggagtccaagaccagcctggccaacatggcgaaacccccgtctctactaaaaacacaaaaaattagctggatgtggtggcgtgcgcctgtaatcccagctactcaggaggctgaggcaggagaacagcttaaacccgggaggtggagtttgcagtgaggcaagatcgcgctgctgcactccagtctgggtgacagagtgagactccacctcaaaaacaaaaacaaacaaacaaacaaaagctcagtaggtgctacttcctttcttacaggacctgtgcctcctgggatgacccccaccatccacccctaggcaccaggactgagtcggctctgaaaagaaatggggaatgaagctttgggacttggttcctgccttcagggagccaatggtccagccagggggattagggttcatgtcccttcctgggcctccaggaggtcatgaccttcaaagcaagaatgaggaagcccacgatggtagcgtggggccctgcatgaagtgcctgtgacgggagatggaagaactctgtcatatgtccgtgagagtgaaaggaacctcaagcattcaaggaaaccaaaccggtacccaagatagatgaagagatcaggaatttaccaggtcacagaggcttcttggcagccacctgcaggagacggataacaccatggccagggcccccatgctccataccgtgtctgtgacctccacagactcactccacaatgtgactttgggtaggtcacagtacctgtacggcctcagcttccccacctgtcagatgggaagaacaacagcgccctccccatgaagccatcatgagcaccacaccaggtaaatcatgacctgctctcgtgcatgcagggatgtcaatgaagacgagttccttttccctgaagtgatgaaagggacttttagaaaagaggaagtgggtggattcttaggaaaccttagttccatcccaggcaagtggctctgatgattcagtaggtgacttccaggtgttcccaggaggcgcaagctaccaaagtcatgtcctctcacctgaattttcatccagcccaaccctgcctctggacacctatcccctcttgggacctcgaggccaggcctggagaggatgtgaacgcctggaggccctcccaagcccaagcaggaggtagacgcagggacagtgggcatcttccatcaggcagagcttggccaagattccagcagcacccaaagcctgctgagcaactcacagatgcccatgcctggcaggctggtctccatggtcaggccccagcctctctcttctgggcccctctcatcctgctccccaaagtcccacaggcttccctgcctccatgactttgccaaggccacccacctgcccccgtacactcctgcttccacctctgtgcctgcaggcctgccctacctggaggccttcccctgtgttctatgggtttctcaccacatggtctcatcagttatctatcaaagcggctgacgctccctccactcctgcctctgcccctccttgcctctgcctgtgttccccctcccatcaccaccttagcctgtctcccctccttcctcaggactcaggagccactgaggctgtggggcacctgccgacattctgcctggcctccctggcttctcagccttcccccaccgcctactgctgcctctgggcatcaaaccagctgcttgagtctttcccatcccacaggacccctctctcaatagccccacacccccacacctccagcctctgccctcggctctggaaagcacggtctccacccactgcctccattaaccccctcctccccatccccttaattcctgggatctaacccctgccccaacatcccaccgaggccactgatcacctctctgctgttatgtctggggcacttcactgccacccctgcctccactcctcaacaccattccaaagcacagacccttttttctttctcttcttaaaacatgtgcccatactcctggctcctgaaacgcccacccagatttcctgtcacctccctgcccactccatcactgtccccttcaaggttccacttcctcctcctggggccaccctcaaagaagccccacccaggggtctgtccttggcctttctcccctcccttgcctccaccctgggagacagacctctcccacccctagcctgcccctcctcctgcatcctcaagccccccaccctctggctattgaggtccagaccacctccaggatgtcccttgagatgccctcccttctctctcccttgtcctcagcccagatgctgaaaggggcaccagctttcacccctcctgatttcatccagtctcaagccgttagatgctgtctgtactgtccacacccaaacagacgcctgactgtcctccctcccccagccaggcctctcctcagccgcccacatgacactccacttggatgtataacaagcatctcagccgttccagctcccgctccccacagcaccccaacccgcttcccccaccaccgcattctccccacccccggctggcagctttctccttcctgatgctcagaccaaaagccttcgaggcatcccagacccctctccctctcccatccactggcaaaccctactgctctaatctcaaaggagacccagagtcagactgccgcccccaccctgggccaggcccccatcatttctcatctggatcattgcaggagcttcctaattggtctccctgctcccaccttttcactcctgcccccaggtgttcccagcacagtggccagagccgtcctgttcagatatgtcactggatcgcacctctccagttgacgcttcccaatggctcctgtgtcgctctcaggaaaagccggggaattattgcgtgccctggcctccttgcctgcatcctctgctctcctccctgcaccctcctctctctggctgcactgcagaggcctcccctggggtatcagttgaggcaggctggggtgtgctgtggtgaccatccctactcactgggccttaaaacagagaggggcatttctcattccagcttcacgtcatgagggtcagcagggagggctacgctgcatcgtcctctctcatgaccatgtcggggacatctggagcatcacctgcttccaggcagggtgaagggaatgtggaatcactcgctgactcctgcatgcttcagctcggaagtggcacgcatctcttccactcgtatctcactggccaaagcagattacacagctgggcctaaccccaaatggaagaagtgtagcccttccctgtttccagaagaagagacaggcactgatggacaggggtgacagcctccccgctgctgttcctcgaacgcgccagacacgccccagccccgggcctttgccctggctgttccctctgcctggagtgcccttccccaaacacctgcacagctcgcccctcaccttctttcagtctttgttcaaatgtcaccttcttgatgacgctttccctgaccacctcacttaaaacttcagatgtctcctggacacgggctgccaatcccccttacctttactttagctttccacggttctaacagattacctaattacatatttcttatgtctattactattgtctgtttccatcagctagaaggaaagccccttgagggcaggggcatttgttggttttggtgactgatgtaagcccagctcccaggacagtacctggcacccagtaggcactctatacttttgctgcatgaatgagtgaatggattaggggccccactcaccaccaggtctcgttcccacatccttcagagcttttcaatctacacttgaatccccaacccaaactcgctgccttccccaggccctcactgtttctcgtctgggtccccaactcataacagcccctgactgtccccggtctccagcaatccccttccaatccaacaccgctgtgaaaggcaggatagcaaggtgattctggcgtgggctcagggtcctttctctggctctgctgtttaccagcagtgtgactttggactggttccttaaccttcctgtgctccagttccacatgttgtgataatagcacttctctcataggggttacagtgctgagaggtttaaatgagatgctgcatgcaaagcacattataaatgtggattattgctttacacttgccagatcttggtaccagacaaaggagatccgaatctgctgaaaactgtcccttggctcctggtagttttcagtttcttctctgcacccaggggccctcccaagctggtctccttctcacttgcctggtctgtcccttcttgctcccggtcccaccaaactccccagggcctcctgagcccgtcatgctgcctcctgccctggcctgggcattgggtgttttctctactcttcactgacttttacttgctttcttacttaacagaaatcccagagcttttttgcactttcatacacagaaaactttcagatttttttttcgagacagggtctcgctttgttgcccaggctggagtgcagtggtgtgatctcagctcactgcaacctccgcctcccaggttcaagcaattctcgtgcctcagcctcccgagtacctggtgcacaccaccacgcctggataatttttgtatttttagtagagacagggttttgccatgttggccaggctggtcttcaactcctgacctcaagtaatctgcccacctcagcctcccaaagcgctgggattacaggcgtgagccaccgcacccagtctcacattctttttagagctgtcttgaattccatcatggggacataccattgggatatatcagtcccaagctgatggctattaatgtttttgatcttctgccatcacaagtatgcagcttggtgtgtgtgcatctgtcatattcgttcgggtgtctctgtaagacagactcctggaagtgggattactgggtcaaaggtagctagtaaagcacgacgggccttgccagcccagtgtgctccccaccagacccaggatctagccccaagtctgagtgatgcagaattcacgccctcacctctgtgccatcctgcctccttcagcagtagggctggagcgcatggtgaggggccagttctactttctgcctcagtcaggatcggtccacttgagcgtgatatgtgggggccgagccgggaggcgttggagctagccgaggagatgaggccagcccccaaacacttccagaacactctgagccttcatgaaggctgcaggagggagcatggcctcttgcccacattctccccacctgggatcttctctctggcggctgcctctgcctccccatcagcgccagagcaggactggcagtggcaccccaggcaccagtgagcaggctacagggtccgtccccacctagggctgcatggtcagaccccttgaagagggaatggcagaacctcaagaccttgggtgggagggcagcccaggagagccagccccaggccatgccatggctccgtggctcatgtgggcagccccccactggccctcacagaggcagagctgagtcagcagccagggtcggggtgcctctgaggcccaggcctacttcactgggaggtgtccctgcacagaagtgagagggctcaggaggggcctggctctctgcctctgctgcttcaggaaaagtcctgctccttggctgagccctcagggtccttctccagccccctgcccaccgcctgccctccggtctcctacaccccctcacactccagtcagtcatgtggaaatgcttgcagttctccacatgggttattccactgcctgcctccacgcctctgaccacgcagctccttcttttccagctaactcccacttgtccgcaaagacaattcaagagtcccttggagcagcctgttcgcacctatgcactcacacagcaccttgtttgtttagacccgcccagtgcctcacagcaaccccatctgggttcactgtcagagctctgagcccacggggctactcgtcccaaaggcatacagcatgtcccaacatctgacttcgaagctgggacaggcctggctccgggagggacagaggcttctacctggggtagctgagctgtccaaagaagtttcagccatgtcgagcccctggcgttgccgaaatcccccaccccacggtgccacagcaccagggcagcccctaggaaaagccagcccctcagaggccctgtgctaaagaccagaaattgcccctgggtctccgcaggagttctgcaatggggaagtgagccctcctgaggcctggctggcaggaggctcttcaaggccagcatcatgtggacttcccccaaccactcgcgtttctgcacagcagccacggagacctgggggctgctgaaaaacgagatcagaaggcaacgtcagcctgagtgggctgaaacctgagatgaggaaatgagaagacgtcagggggctggaggacatgggtttgaggacagccagcacccagcactgcagctgaggcctcctgagggagccagagggaaagcaagtcccctccctgcggcctgagtctctgccagtgcccagcactcccaaaggatccaccccaacctgagagaccccaaagacattggagcagccccagacacctcctcccagggccacaaaggcccctgacaagcccacagcagtccaaggcctccaactggagtcatctttggtaaatctggggcccatcagcacccactgcccttcctggtgccctaagcatgctggcagggggactggaaactgcatcccagtttgcagtgggtgtatgtctcatacacccacaatacctgatgtgggcgtgactcaccttggggacctgtgagtcaataagggtgtatgagtaaggggcagagcatttcaacttagtcccatagcacatgagctcactaagcaaacattacctatgtctagatttggggccagtcactacccactggaggctgtgggctccaaggtatggcagcaggggaggccagccaggctctgcccagcttgcccctccttgtgaggacggacccagccaggcctcccgcatccgcccttagactgggggaccctgggtgggggtagaaagggggactgaaagtggtgtctggagttaagcccatctcctcatcccccaccatggggatcaagatgggggctaagagtcaccccaccaccaccccaacccactctgaacgcaaaacagaaggggacaagcaaaacagaactgaaactgggcaaaggagaaacaggtctgggcccgccccagggacctctgtatctcaccccttacccatacacatcctgaccagggcctctcccccagcctgggaaaacctttcaagcttggccctctctcacctgggctctctcagcctcctgccctcccccatcttccctgctcccagcctcatgctgccccaggcctcaccccatcagagctaaaaggaccccaggctgggcatctgtagatcagggatctggtctccctctgccactaccttttgggatgacctttgggaagtcattcccttctctgagccacagtttcctcatctggcctgggctgtgggcatagaatctgcaggtgagggctctaatgggtgagtttcaggccaggctgagacttttcacattataacactgaggcacccagcaccttgactaccactcatcctggggacttgggaagggacagaggctgggattggacagtaacagccaagaccttcccagggcacaaacgctgcctccctgaagcctgccctgactgtccatgcaggtcactcccatcacttcacctcctccttccctccactcagcaccagccaccactgggtcacatctatgtccctttggctctgcaagagcagcctggacccctgcatcccctaccccagcacaggcctgacaccaagcaggggctcaacaaaatatgtgttgaaggccaggcacagtgactcatgtctgaaatctcagcactttgggaggccaaggccaacagatctcttgagttcaggagttcgagaccagcctcggtaatgtggtgaaacctcatctccacaaaagatacacaaaattatctgggtgtggtggcatgcacctgcagtcccagctgcgcgggaggctgatgtgggaggattgcttgagaccaggagacggagattgcagtgagccaaaattgcaccactgtattccagcctgggtgacagagcaagaccctgtctcaatgtctctctctctctctctctctgtgtgtgtgtgtgtgtgtgtgtgtgtgtgtgttgaaagaataaaggcagagaaaataacaagtgttggtgagactgtggcaagattagagccctcacactctgatggcggggatgtaaaatggtatcacctctgtggaaagcagtttgtcagttgcccaaaacgttgaacacagagttaccatgggattctgcagtcccactcccaggtaaatagatgttccaaagagttgaaaacatctgatcacacaaaaacttgtacacaaatattcatacagcgttattctggatattattataacagccgaaaagtgggaacaatgtccatgtccatcaactgaggcacagataagcaacatggcctagccacacaatgagctctcattcagcagtgagaagatggggcgtcctggttcaggctaccacatgataacccctgaaaacagtatgctaagtgaaagaagtcagacacaaaaggtgacatgtacaattccatttatatgaaatgcctagaagctggatgcagtggctcacgcctgtagtcccaactatttgggaggcccaggcaggaggattacttgagcccaggagtttgaatccagcctggaaaacatagcgcgacctcatctctgaataaattatttaatttaattttttaaaaaatgtccagaagagacaaatgcatagagacagaaagtacattagttgggggacaaggaaaggggaagtaactgctaacaggcacgaggtttcttgggggtgatggaatgttccagagttagctagaggtaggtgtcatagagcattatgaatatactcaaaaccactgcaatgtgcattttgaaatggcaaaatttgtgttatatgaacctttactcaataaatacataaataaataaataataaataaataaataaataaataaataaataaaaaggcaacaacagccaccccagggacaggtttggaaagccaaacttgtctgactggctgggtggcttgtctatttgtgtgtttcttaaaacagcatcctacaggagaactattctttgctcagggaaacccccaccccctcactccactcctacctcgagacaaggcctctgaggagcagatgggaggagaggggctctggggaaacatagggggcattgcagtggggtgctgccctctccttgggcaggtgcccccatgatgagcagactcaaggtccagctacagtcccagctctggtacaggtcctgtccctttcctcagtttccccatctgcagtctgcctcccggggtctttctgaggtcagtatgtagcatgacagagcctgagaactgccaaactgccatgttctctcagagacccctttttggcatgcattccagatgtgggaccagaggttgggaagttcttcctttggtctgaccacagtattccacttggagacagcagtgggaagaggccttccactgagtcaccctgactcaactttcatcagcttcaggccccccgtgggggtccttcccccaccggatgctcactttgctgtaatggggcaggatgtgggttccctgctgtgggagagcagcccccacagcagctgctccctaagatggttctggcaggaaccaatgagaggagaaagctgatcctcaacccctgcaggggccctgcagcccaagcagagggcctctcagcccacctcggtcccaagtaggacagattgacaggtgacctccctgtctcagagcctcagggtgtcttggaacaagtgatcccatcatcttcctctgaggtccaagactcgggtgctaatggactctgtgtagggaaccctggtcactggggcagactctgtcccagacctgatctttgccattttgccagagtggcccacctgactgcttctctctgctgtgtgtatcacttgtattaaccgcgaacccagcaaagagagcaggagcttgggccgggcacagtggctcacacatgtaatcccagcattctgggaggctgaagcaggtggatgacttgaggtcaggagtttgagacaagcctggtcaacatggtgaaaccccgtatctactaaaaattaaaaaaaaaaaaaaattaaccaggcgtggtgtaatcccagctactcaagaggctgaggcaagagaatcactcgaactcgggaggcagaggttgcagtgagtcaagatcgtgccaccgcactccagcctaggcaacagaacaagatcctatctcaaaaaaaaaaaaaaaaagtaaaagtagaacccctgtttcttgaggacaaagattagatgcatctttttgttgtgaaattttggtaaactacttactctttctcagcctcagttctttgaactatgaaatggagacaatagtaatagtatcaacctcaaagggctggtgagaaaactaaccaagacaattcacacaaagtttcagaacagtcccgggcaggtgcgtgacttacgcatttggcttttgttcaccactattactacttgcttattgaagctgagccaggtggctgagcaatgtccctttctggcaaggagggtggaggcaagtgtcacatttcagaaagatccctgggctcctgttgaatctgtccccacaccaaaacatgcccgtgggggctctagctcctgccccagcagcgaaaggggctcctccttctctggtgcccagtcctagctcacctgctcttcacaagcctcctcccagcacagcctgcaccacacaggtgctcagtaagggggttgctctgaacagggagcaggcccacatgctgagagtggtggaggcgtgcaggctctgatgaccacctgaacccagactccagggcaggacaggtccttacagaccgtaagggcttcctgcctaccctcttcccatgcagttacctcaaccctgggacaccaggaaggttgagcattccaggaaagccccgacccacccaggaaacccaagtacctggtggggcctcatctggcccattgtcctgaaaggacaggaataaaggctctctcctcatggccacacaccctagggacgtccagcctccagctttctgtgggtggggcaaatgactgaggaggcttccctccctgcaggcgcctccctctggggcctcctgtggtccagtcgtccctggtccccagctctcaggtgggtcatagggcatctcagcaggaccaccaggaagagcatcaggaggggaaggagccagagagccctccaggccagtgcactgctaactcaacatctcatcttcctatctcgtcccttctgctcacctccggagactccccctcccctctcatgctcttcactggcaggttatgatggcccagagatccccaccagagtcccagatatcagtggggatcccagcctattcctccaagctcccagttgccagtgacagggaggcagaaacagcctggaaattaactgtgggttctccctgagcctgtggatacatggaaagagagcttcaccaccacccccttctctgaatatacatacaggatctgaggagggaggattctgtgtggatgcatgtgtgcacagatgtgcatgtttgtacgtgtgtatgggtgagcaggtcatacgtgtggtcccatgtgcccacctgttgtatatatgcatgcttgttttgtgtaagtgagcataagaggtcaagccagagagagaaataggaacaaggagagacagagagagagagaatagaaacagagaccaacagggaaacagaatgagactgagacagagaacaacagaaggccagacaggtagacaagccacagttccatcttccctggtgctggctgccaaggcagacaactctcctctcacttcattgatgttctgcctgtgtttatacccatgattggggtggagttcaggaaaggatgtatcagggctaggacgcccccacctccacactcacagggccagtcagggccctctgcaggggctgccatttcctcaagctgaggaatgggcttggatccctcggatgccttccagggtgcaggggcgctcccagtgactgggctcttgtggtggctggggagggggagctcctctgacaggccccatgctgggggaaacgtcctgagactgacctatcacgggctgacatgcacaccaaggaggtctcacatctgctgggaaatgaggggctggtggaggtgagaaaacctcaagttctaatgccttcccaacaccttcacctcacctgagaagcttctagattccacccacccctgtttccttgggggagggtgttgtgtggaggtgggaagaggcaggagtccaggttctaggccaggctctgaaggggcaggtagctcagagcaagaggctggccttgcacctgctctgcctaatgggacagtaatgcccacgatggcattccgcctctgagggctgtggtgaggctgtggagagatgtcagggacaagaaaaggccttggaaaccagctgtgggaagaacagcccatgagctcagcatttcccctggcttccccgaaagccggcccccaggagaggaaggtgactgtgacttctgccgccaccacttcctgcagctgggaccctgctcactcagaatgtggaaccgtcatgggccagcagtgtcacctgcacactcactcctgccaccaggaaacccttctgcagggcaggtccccaagccccgtatctcaggttctgaccaggatgtgtcctcagcagtggtcgcccgacattgatgggagggacgggtcccagctgggcatcaggatatggagggtttcattccagctctgccaccaaggtactggttgcctcgaggcattccccttgctggacctcattgaggagacttcctgtattgctaagcaggcaggaaccccagaagctcagagccggaaggcaccagggcttcccacaagatgtggaggacccaaaacagggagacaggccctggcacctaagcgttccttctgggctctacacaaggtgtgggtggcaccagagctactgcaggctacttgatccaaggggcagtcctgctccaccgtgggctggacgaagacatcatctactccagggcatccacgcgtggggtgggagccaacagacctgcggtgctgccttccagcttgggactggcccccgtactccatcccgtgcacccagcccttccggctcaccccttccatggcatgttgtgctctctcgcaccccatgctttgcatgtgctggtttcattacctgcaacaccttcaccccacttgtgtctggctagcgtcccctccagaatggagagtggacaaaacatggggtctggaattccaggggtcagggcccaggctgttaggaaaggcagagtgtgaagcagaccctcagcaggcctcacagcagggagtgctgagctcagggttctcaggggccaggatgggacagacgccgaggagatgggggtcggtagctggggcagattgtgcagacagtctggattgtggaggagctgccgggcgcagggccccacttggcgcgggcggctgtgggggaggctgaaactgcagactatttttaggctcctgctgaattgagagatgaggatgctctgggctacaagccctcattcgctggggaaagactaagggggccccagttcccccgatctgcccccagagctcaaagtctccagagcttcctcttttgtctctagggaccaagggctggggtcaggaagtggactggaagtatccccagcaccctagataggcaaacacccacaagaagtgatttccataccatttgcacactgccctgcttcctgatcagaaggaacggaaacgttccctttcagaagaccctcagcggagcagtgcattcaccagagtccactttcacctgccccactgggtatcaggagagtcccaggagagcgacacaagctctaaagtcagaaagcacaaacgggggttgttagcactgtggtgtagcatccgctaggctcggggtagcaaataagttccatctgatcaattgctggtgactcctaaggagaaatgctggtgaggatccattcattcattccacaaataatttactgaccacctactgtgtgctaggtgctactctaggtgctatgaaatttagctgtgaacaaaaaaagacaaaattccctgcccccgcagagcagatattccgtaacagtgttgtccaacagaaatacaatatgagccacacacataatttaaaatgttccagtagccacactagataaaagttaaagaagaccaggagcggtggctcacgcctgtaatcccagcattttgggaggccaaggcgggcagatcatttgaggtcaggagttggagaccagcctggccaacatggtgaaaccccgtctctactgaaaatacaaacattagccgggcgtggtggcgggcgcctgtaatctcagctactcgggaggctgaggtaggagaatcgcttaacctgggaggcgaaggttgtggtgagccaaggtcctgccactgcacttcattctgtgctacagagcaagactccatctaaaaaacaaaacaacaacaacaaaaaaagttaaagaaataggtggaattaatttttgtatgttatctagccaaatatatcttatatctgaaatattatcatttctttttttcttttttttttgagacagagtttcattcttgttgcccaggctggagtaaaatggagcaatctcagctcactgcaacctttgcctcccaggttcaggcgattctcctgcctcagcctcccaaataactgggattacaggtacacgccaccatgcccacctaatttttgtatttttagtagagacagggtttcaccatgttagccaggctggtctcaaactcctgacctcaggtgatctactgacctcagcctcccaaagctctgggattacaggtgtgagccaccacgcccaacctctaatattatcatttcaaagtgtaatcgatgtaaaaatttaaggtcatttttttcatattatgttttcaaaatccagtgtgttgtttatacttacagcacatctcaattcagatgagccctatttcaagtgcccagtagcccccagagaatgcaagttctgaagaaaatcactcatatgagctcaggaaaggaatgccacaattgatcagcaatgcctgctccaggcataggctacagctgaatcaagctgcaagccatgtgtttccccaccatgatataggctcagccccaaaggacgtgttcacctctacctaagcccttctgagctcatttattttgcccaacttgaaagaactgccagagttctgggaccttgacttggttcgagtgcagcggttctggtgtgaacaccaccctacagaaacgccccagcatactaacagggccagcgcctcccgagtgtggttctgtgctccttcccttggtgggggctgactcatggccattggtgaccctgagaatgtggattttgtttttgtttttctcccaaggtctcttcctcccagagttaaccaatattgagataaaagtgtttccgagccagatttagccatttcagccccattccactggcccaagcctacagacctcctgtctggcactgtagccaggatggctgcactttcttttccagtaagcagaaggctaaaattggaccatttaaggagctagaaacacctggaaatggtgaggagtgggtctttggtgtaagagatggggtgtaagaaaacacggatctcaggctcccattatcctcaccattattatcattatcatctaccccacccctgctcaaaatccttcaattgctccctagtgtctgcaggataaagatcttgctttagttcccaggatcgggaactgctggagtcatccagtctcacctctagatactctcccttctctcatcttattcattcattcagtaagaatgtcctgagcacctaatatgtgccaggcactgttctaggtactagagatacagctgtgaacaaaactgccaaggatttctggcttcatggagctcactttactccagcgagcccataacaccccaggccctctcacactcccaggcctttgtaaatgctgttccctctccattcagtcactctcctcctggggaacttctacacatcctctaaggccctactcaaagccttccctgagcactccgctcaatgggttaggttcctcctctgagctcccacctcccacctaggaccgtcacacgtatggtcactgtccagcccacagcccttccctaccaggctttaagtgtctccagggcaggggctgtgccttctcccccagggaccccagagcttgcttccaggtgcaccctcccaaagatcaggagtgaacaggctgaggcattagtgtaggggggatccaggattcctctggagaattccatgtcattctgaaatctttgcctgggagcatcttcctcctggcattccaggggagggaatcacaggagcaaatgcagagcggttccagcaaaggaaggtagaagtctgaggagagatgggaagggtatgatttgatgtagcagagagacaagaggacagcagccttccctcggggagagaggatgacaggacatgtggatgggggataaaccgtaatgactctacattcctaaagtgggagggaggcagaacgaaatctgcagttccctgctgccttccccaggagagctgagctttcagtctcgtccctcttcctcctccccaacgagaatgcacaagagaggggagaaggatgggcctggttcctgcccctggcctggctctggtccctggcctggccctcaagaagccagtgctgggactgtggatatcgtgtggttatggctagagcagatcctcccaccacccgggcccagcctaaccgtcctgcccacacaccgccagctagaggcctgctgtgctgcttgtccattggggaaaacagggcaggaggcttgtgcctggctggcctcatccctgccagctcatttacatggaatttacacgggctcatttcatgccttaatgcacacggcttccctcccagcccagcctctcctggtgcctccacagagacaatggagtgggttccatcactcaaatcccctgccatggacccatcagagcaccaggagcatctctggaaagagggaggctgctgaggcccagagaggacagggaactcagtggagaccaccagcagcactccaggagggaccaaggcttaagcccacactttgtccactcgccgctcagaccatttggggctggaattcactcccatcctttgctttgccaccagcctccagcttgctgagcaggagcctgtgaaacccccatcctgatgccgatgcttggctgtgcactggaatacagacggactgggacagacgagatgtgcaggaaagggtccacagaagcccaggtccagccctgccttttacacaggagagaaatgaggctcgggaaaggcgagggtctgcccaggaccacaaacgccaaaaatggtggcagcagccccaggtctctgccccagctgcccagggctcttctgggtcccccaaactcccaaagacccctggtcccatgtacctgctgagaccttggtcccccagggcatgccgagtgttgggggagaaaaggatggggagaatcctcaggaatgggctggctatgagagtgcagagcaaactgaagtgggagggagcactatgggtgggggcaattccagtcctgtggggtttgccagagccaaccagaagctgggctcggacagagaagtaaactgccccaagtctgccatggacccctccagcagtcactgctcaggaaaaacgcctagcagaccccaaaggcctaggtccttgcctccagggacaggggacagagaagggaacaagggggaggggaggcctctgggcttctatctggacttctatctgcagtgctccctactgtccctgcccttcatcccaggaccactgctctcatcctgacctccacccgccaccagacagcctcctaactaactcccctgcatccttccaccccagcctcagaggctccttcctgcataaacttctgtgttctaaaacctatttacttgatcttggagggagtcctgagtttctacaactcaaatcctacctcatcactcataaaccctccccacaggtccctccctactctccaaccctcacccagacccctaccctgcctggagcaaatcccattcccacatctcttcagccggcaccagcctcctgcacacacactcaaggccacagcatcccacagggtcgcatttgatcagcttgccctccagaactgccccttgaaggcagggagtcctgaggctgtttctagcatgacccaggccaggccttccagggggaagtggtgggaggtgaaggctgggaatggggaaaaggggtgcacgtgctattggggctctggggtcaaggctcgagcaagcagcacgctgctgaggagtcgtgggttcaggtccccattcctgcctctcactagctacagccctgctgagctggctcctgggccctaaccaggacatgaaagaatgcatgtgatgctcacgcagccagggggtggcgagtaataaacaggagcccccaccaacaccccctgaccaggacagctttgcaggcaaggaacaggcgcaggtaaataaatagcttgtttattagtaatatgttacattattaaagtgcattgagaagaggtgcaggggccaaagctggaaggccactggccccagccactgccctgggtggccagacacagccggagaagggcccagctcccccctgaaatggatggacagggctgggggcagggccgcctgcctggagagctcggcccaggccatccccaccggaattttcacagtttagcctaagttataacatgtcctgagcgaaggtgggaggctaggagcatggaagcacagcccctggggaagggggctgagaggaagggaggaggccccccgccccccaaccctcaacgccaagggcagagtcctggaacctccccctgaggacccggctcgtccttccaaatgaacacggtgaaactagggctcagttttctccttcattctcccgtttccctcaccccaccccctcccataaccacccccaacactaggggctccaacaacgtccccctcagaccgggctcccagggcagagccagctcatgccactctccaagaacccatgcccgtctccagactcttatctcatccccgggagcctcagactgggatcacccccgctccccaacccatcccttcccagcccctccctttcccacccacccccccgcatgtagttttggtattttcatacagatgcagtcggaagtagctatacatgaaataagcctaacataaaaatagagctttttccgtccttccgtccggaaagcaaacatccttcaataaacatgcaaggcggctgtcctgtgggacccaggaccagagagggagctgcagaggacagggctggacagagggtagccctgggtcttcaggaacaccagccacccagccatgagagagggaggggaaggaggcaatgtgggtaccaagagtccagaaggactcaggcctcagccccagggtcgagatggagtcccagctctcctatccaaacccactccccgacccatgggctcttgggctgggagcatcgctgcatttagtcaagtttgaggagtctgaaaaatattttccagaagataaagtcttgggtcatcgatgccccagcttcacagtcggtgccctcattctcagcccctcaccatccgtgcgccacctggggcccagcagccgcctgcggctggacgtctccaggcctggcatcctccactgggttattctgtcccctggaagaagtggcaggcaaggagctcccgggccagccggctctgagtgtgagacgttctagtgccctgggctgcagaagcctgaggcatgcccagcctcgggaggccctagtggaccagcaagccaagagtgagtgtgggcagcacccccagccagagggaggcggccagggcacaggcatgacccagcaggtgctcggccatgatgccgtcctcgggcagcagctgccagtgctgagcctcgcggaagtaggagccctcctgggcctcgcagaagtagtggccgtactgctgcgccgtgaggttctcgatgaacaggatgcagttggggctctggtgaccaggttcgcagctctgctccacgttctccttgtggcgccatgagtaggtggcgtggcgggattccatggggcagctcaggtagtagcgagagtttggggccagggaaaccttctgcagtggggccttgtctggggaggcagtggggaagcagccgtgaggagggacaaagagctcccaggggaggatgtgtcctccccacggactgggatcccaggacaaggcttctgaatgaacgtggggaacccagccctcagcgtcctccttttttctcccgtctcgctcatcccaccaagagggctccctctgcaggactgtatcctgccccatgtacctggggcccacaggacaaggccatgtctccctcagaccaggacaatcagggcagggcagtaccccactcattgggccacagccgccagcagggccagatcaggtacctggtttggggttgggacactccttgtgtggctcggctggattaatggattgcagcactgacctggagtgggaaggacgaaagaggatcagcagatacaaggctgcagacctgaccctcctatccttaccccagtgcagttccagcagagaggagggtcccacaagaaaggcccagtaccgccacctcctccagcccgacaacacctccccctctcccatgcccaccttctcccagggacgagggatcccggccaacgtaccgttcggagctgtagatggagatgcagcggccttggtcccagccgcagtaggggtctcgggacatgaggcaaccgtggcagcccccgccatagacctcacacaggtccaggggcacctggctcacctcccactgggagctcacatacagcttcctctggaaggacagcaggattgggtcaggcccgggccccaccccacactcagtcctaaatgtccaggccctaaggcctagaagctcttaaaagaacacacaaatcacatgcaaaggagccctgtcctcagctgcagtcactgcatagcccatgggacgcagtgggggaaggctcacccgctcagcatccagcgacatggtctggatggcagccgcgcggcggaagggctggatctccatgatgttgaaggcgaagctgtgctcctgctcccccggttccaccaccttgtggatagtgcccctgtctgtgtatggtggacagagggtcagtgggcgggagtcccactgaggggccaggcagctttcctctaggccggggaggggtgggaagtcacaactcaggcaagggtcacaggactggtgtgggcagggcgaggagagcgtgactggggaagaatgtgggagcctaagggcagcctggaaccttccaaggctgatccagagaggccatcccaggaggcccaggggtccctggatacggcctccaacattcccaaggctgcacgggaagaacagaagcaggagccccacaccagcaaggtcagtgcggctgctgtccatgcatcacctcgtttaaccctccacagccctgcgaggtggctgtcatcttccccactccacagataaggaaatcaggctcagaaaggctaagccacttgctcaaggtcacacagctggtgagcagcagagaccgagttggaacccaaatctgtcagagcccaaccactcagctgcttctacaactcccctgcctcctggactcttagggaatatatttactttaaatacattttttttttattttggagtaattttagattcccagaaaagttgcaaagatagtacagagagctccaatctacccttctccagttccccctaatgttaccatcttacataaccacggtatatttgtcacaactaggcaactgacattggtgcattactattaacaaaactacagactttatttggatttcactagtttttccacaaatgtccttcttctgttctaggatccaattcaggactccacgttgcatttgatcttaggggatatcttaattttataaaatcttagatctaaaaaggatcttggattctaaatcaagagttcccaaggtcttataaccgagctgcctgcctcctagaccaatgctctctccgttcacaattagggaccaatgggcaccctgacccctggtcctcccaatcctacctcacctgctctcccagtttctagaatagcctacctccctctctccctccctcccaatttcccagggcatcacctgccccaaaaaagcagtcagatgattgcctgcctaggatgtttcctctacacatccgtgatcctcatctgtggactctgagatgtggccagatgctccttgggcctgataaggccccaccccagccactgccttcacagacatactgccctatacctccttccaaaccagccccagtaacagcatacccttggcaaaattctcaggaaaagagccaatacttctcccagttgtgagagcctcccattctctgcagaggacttagaaagctctatttttcagtctagcccaaatacgaatgatgcaggctccaaaatggtgcctcctccactgcccttagaacgaagacaccttctctaatcactcaagtgtgctcacctcccaagtctgcaggaagggaatccatggcccaagtccagccttccttgtcctagctcctgctcccagttccgcactgtgtgacctctcctcttctgctccccagtgccctgccatccctggctgaccacaacagctgtgccagccactactggagccaagcaaggatgggggcccaagggtgtagccgggatgaatagggagtaaagaggcagggaatcaggacccaggccctgccctgtgggaaattcctctccccaaggcttccaggagccaaacaatggtgctggggttccagtttcctacaaggtcaccaaagccgagacagttccaaggtgaagcagcaacaggagatcacatggggaatgtgaacaactgaggttgggcgcctgggcctgaattgaatggccccaggggtgctagaggccctttccagtctcaaggaaggcagctggcatgggaagctgcgacaaacccaactcaggactggctcctccgtgtcctgtggctttccagaaagcaggagcatctcccacggcattccacccagcttcccccagcagggcctactccagggaagaagagaagctgcccctgtcctctgtgagatggcaaaggttctgccccctggaactccttcctcatacctaatttgtgccccatcaactcctcaaatgtttcctctcacctgcacaatcccaaagacaggcgcagggcctgactccctcattctgcctggcagaggccagtatccctgtggttcaggcccctcctcctcatttgccacgtctcttcctaccatcttcttccctgagtcagacatctggaccaaaggtgcacctggctttgctcagactctccagatttccgcctccaaatcccagtgcttgcttttctcccatccccctttccctcttgcccctacctcctccaggaagctctccctgcctgactcttccacacccacacacattaacccctgacaactccagtcactcaattattccttccacatgtaaagatccaaccagatgttaactacattattccttacacctttcatgcccgtttttacaaagcaaactgagggtcccggggtagcctctcacctgtagttaggtaaagcacatgaaaggtctccccgtggctggcttgcatgcggtggacggccactttctggtagtggtatttagagtggaacaatggcgtcttcagaggccccatgggctccaccctctgcgccacctctgggtgacggtcagccacctggaaggtctctgtgggtatcggctgctggtctgggaggcactgggcaaggagagcaggcccaggtcagtggggtggtgggaggtgaggcagaaggagggctgggcctgggccacggctggtgtcacgctcaccttgccaggccgcgggttgggaaggcttgagtggtagcccttgagtgaggaggtacggaagaccttgtcaatgtcaccgagggaatacacacagacggctgagtagttcctgcagtgacatggagaccagctcaatggggggcccagaacccacccatccacctccactcacccaggccagccttgtgcctggcactgagttgccaaccaccactgaaaatggggagggatggagaggaggaaggagaggagttcagcctaatttctttgtgctgcaatttaaaaccacaaacttgtatcctgttacagaatcactgagtctagaggccatctgctctacccaaccccaaggcaggaggaaccccatcataggctgagcagttctctagccctccctgggcacaggctgtggggtgctgatgccccaggaggccagacccccaaccccttcccagcctgggggaccccactcacccaggagccacagagcagggtcttggcttcctccactctatccctaactctccccacacacacccaacacttccgcctgccgtgtgttcaatcaatgagagtgattaagaagtgtgaattatcgggctcaggcagtgcctgagcaggtgtaatagcacccagctccccgagagatgcttcagcagcttcctcctgggcccagtgtccactctcggcacaagcaggtggtgggacacacaggcacaagtgcagtcatgagtgtgcatatagggcatgcacacacacccatgagtgcagactcactcacacaacagtacatacatcgcactggctgtccccccaccccacacccagcaacagcccagcctcttgagcctgcagcccctgctcctgccacaccagggaggccctcagcagggcccaaggcctcctgtccctactggacactgaaccaatgccagccccggccccaggacaagggccactcaccaggggttggagaaaacaccatagaccctggtgtccctccactggccgctggggtcagggagcaggaagacgtcttgcagcctgttgaagttcttgttggtggcagcatcactgcataccagcatggctttcagaaaagtgttccacttggagactgacagtgaactttccccaccctggtccccctggaagggtagaggggagaagaggcccctcagcacctgcccgggcttccccacacaccccaggaaaccactgccagcaatatcaacacctgggcccagaggaggaaggcaggctgtgaggggccaggacctgccgggggtgccccaggactcagggcaggtctccagatgagactccagcaagcaggcctggctgatccagagcccagggccagcagtgcccagggtcagggcaggtgagagtgccaggtccccacagagcagacggactcagacacacatttactgactcacacacccacacacgtggcacagcacattcacacaggcaaaacacacacacacacacacacacaccccatcatacacacgctcacacgccatcatacgtgcacaggagctcagccacctttacccacacacagacacatgatgctccatgcacacacagctgctcccacagtccctgacacagacccactcatacatccacacaacttctacatgcacacggacacacagaactcaccctcactcaggcctattcatgcacagacacgtagccagcagccctcacgcccctgctcaccctgcacaactgggccacacgggacacattgagaggagcctcaggattcttgtcaggattgtcctctcggaagaagtagtagatcttgtcatcgtaagcctggtcttggtgcacgatggtggctttgatgaactgtgggtctgccagggacagaggcgagtgggcgtaaggctgggaagcttgcccgggagaccatcccaaccctgcacactctcctccctccttcgggtctgcacaaaccatggcaaatcagatctggaataggactcagaacatcaggtccaactccccgaggggccctagaccctgcacctccaccccacacctgttttgccctcttcctacaaagatgtcatcggcccaggagcaatgacttcatgcctggggactgggggaaggtccctgggggcccctatgtcacttctgctcaattggcagagccctgatgaggagggagttgggggctgcctccacgtgaactcagcagaggataaactttggctcctggggaccctgcactgggtctggggctccctctgtttgtgttcctgaagagggctgggcccatcccactgctataccttgtctgttcctctgctcccagccaaccctaacttctcaggcctataccaaggtcctgctttcctgcatggccccagcggccctcagggagccctcccagaaacatcaggatcccatctgccaccttaagtgctcacacccccttgcccaccctcagcccagccggagcctgactcactctgcatgacagtatcactggtgtacagctcactctcgccccggatgcggcggaaccgagggatcttcccattgtattcctgcttccggatggtggaatacacctcgtcccctggggtcagtgggagggagaaatgagtaagggcaggcagctcctggaagtccctcctccggacactggacaaagagctgaccactcctctcccagcccagttcagaagcatccccctggggcgcctgctccagcactgccctaccttcaaacagaaccagggagttctcgtccgggctgaagggggcgtagcctctcatctcgccaagtggcaccacagtgccattcacctgtgggagatccagagggttggatggccacataatcccacagccactgcctcccatgacggccagtttctcggccaggagccccatcctcccagggcaaggccagcattggagtctcgccatctccttcccaccatgaggggcagaagcccacgcagtagaaggtgagctgatcaggcacatggggagcagccttctcaccaggttccagcagctggggtgccgggcgttggtgccacaggccagcagcccctcactccgcctctccaggagagtgatgtagttctcgcagtcctgcccggggaagagagaagggaggagagaaattggttgctggaaggccctggcaagcctagcactaggacccccaggatcagggaagaaggtgtcagaagggcttagcataggtgacagcctcccgggacagcccagagtgtgtgcagctgacgccatcccctaagcacagaggaccacgtctccccatcagtctgggactcgtggggcagggccatgcttccttccttagaccctcagggtctcctctccctttaccaagtggctcagacccctccataccccctcccccactcacccgcttatccagacaggacccctttgtggagccgatattcacctgggggaaggggagaagcattagttcaatctgccaggggtgaggtacccctgaaatgctttccacacagcctcaggataagccccaaaggaagcaaccattattctcatctgacagatgagcaactggggctctgagagggtgagtgatctacctgaggtcaaacagggtctcatatccagagctgaggcccagagggttcagaagaccaggcatgggctctggggcccagcttccagcctgggctttccgcagcagcgctgcccagctggccaggcccattagctcctgtttttctccacaccgccccagctccccactccaatctggactacctttagggagcctcccccaggagccatttataggatacggaggtgggggcagtttaggaagagaagccagctccctcggattccctgaggacccttggcagggccagaggggagataagagggtagggggggtgttgggggaagagagaggctcaccgtgcgcacagatgcgttcttgccctcggggaagtcaaagaggtagaccttgccacgtcctcccacccacacagaggagctgcctggctcgtggaaaagcaccgtgtgcggctcagtctggccaaagtccacccggtcctgccctacatggcctgaggaggagacaattagtagaaacattgaagccaggtcccgagagagaagactctgggtcccctccacatggcacactggaaccagtgcttggtgctcagggtcctggcagggcgtcagacaagctctgggctggggtggtacccagactcagagagtcaaggacaggagaagtaagagatcctccggtgggctccagcaaccagctgtcctcacccacagcacggcccctcccctagtgtggcagcctctccttccttcacagtatgtgtgatctcagagtggggaaggatttagggacctcttgggggaacagaccccctcctctggcacacacttttgagggctgggctaaggcaggaggaccagggctccttggccatgctctgggaggttctctgctgccctaagccaaagcaagcagcgccccccaaccccgggcctttcagcaggcagcagggccttcaagcaccccccttggagtccaggttcccaggaatcacaatgctcagaaccccttctcctccttcaggaatccctctccaacctctcctggcccatccccagccccttagtgagcactagactagaggaggaaaggaatctcaacatctactccgtcccatttcacagatgggaaaacagaggccaagggaggggcagcccaagggcacacggaagcaggtcagtagcagaccctgaaccagagcctgcactcctgcctaccaagctggactctattccatggcccactctggcctggtttcacccatgaggatgctagctctccggggggtgaagatcggctcttcctccccagcaactctgggacaggggaaccttcacagagcacagcctgggactttcagcagaagggctgaccgggaaaattttccccaaaaaagaaactgactgcagccactgcctctggggaggtgtctcatctccagtgacactgctgaggttgtcctggttgcaggagtaaattatagggatgggatggcctgtggttgtgcccccagcaatcagccacacccagcatcttcccacctctgaccagcctgggcctcacctaggaactgggtctgaccactgttttttcagctgcaggaaactctggggcagccagcttggcagtgacacccaagctccagctctgaccaaaaagaactaccatttcctcaactctgcccccgatccctcttattcccattggagccatccctattgattctgcatttaacaggggcaaggagcagctggaccacacactgtgccaccacaccttcattctttaagaaacatcccttcatggccaggtcacccccggaagtgagcattcttcacctcttctgtggcctggcgcactgtgcagagaagaatgctgaggtaccctgggagacatgccaaggtcacaccagcaggcaggacacattagcttgtcccaggctgcagtatcagttctcagcagcatggcaggctacagagagaagtgctgagctcactgtccttgggtggtgtggctctcctggtgcacatcacaaacagcccaactgaacagctccggggatatcagccctccctggcccccaagcctccctccctgtaggcccgagatgtgcagagcaagggctgagaggtactggcacttcggtgggagggagggagagctggcaggtcttgggtgctgccctgctccccctcccttcctgggataaaattagagtgctggggtcacagacacagtcttcctgactcagctcccgtaactccccttccacccgcagcccaaactgcagccaccatcctctgtggcccagccagagatccagacagtctgccgccccaactcccctcctgctcccctcccatccaccgatagccagactggcagccaggaaaaggtgcgtgtctgcatctagagatgctgggctaggacctgagatccatagtccctgggagtcaaagcagaaaagttctagccgtcagactgtgctagccaccttcatcagtcaccttagccccactcctgcaccaaggccacaggcccaggtctccgagggggccggcaaggccaatgtacaactactcaagggaaaagaggcaccagacaggactctgggtgggggcaccctggtctaggaattgcagggctgttgaagagaagaggaaaacagtcctgccctggggagtcgagcctgatggcagagacatgactgggtcctggagagcaaggtctgagggggaggtctggccctaccctgggaatacatctgaggggtcagacagccacaccacagaaaacttccacagctctccagcaaaactgtcttagcatggaccccagggctgcccacaaagtatctgctgaagacatgaagggagggtgagggctgctggcccctgggtaggagctgcagcactagggcccggacaatcccatgcggatctgcaagcctgagcccagttcccttcaaaccctagccacaatggctagggtggaggaagcagggactgttcgtcccattttgcaggaaaacgaacaggagcccaggaccacggcctcccatgacccccaggttcctggccctcccacctctgttcttggtgatgcgtatggactagagggaatgacaccagctcagccccaggacaaggccttggcccattctccaccccagccccagcctgggctcccgcaccgcctgaggccctcaaaaggcctgattgtgcccgggaagtgtcgagcagcagcagctcgatgaatacatgaaaggaagctttgttcaggttggcaggagcgggggctgggggctaaggggcaggagggctgcctggaagtgaaggcagcaccaagccatcagggccaggcctcgagtctctgcccaggcaggggctgagcaaggccaggggctacccctaaaaaggccaggccaagggagtatgtatcatatccctgaacattttctttgtgatgctttatgaacccaaacggagaggtgaggtagataaaagctggatgggccctgaacaggccgggagggaaagccaggcagaggacgcaacctgagcaaaggtggggaaggtggctgtatggaggacagaggccatgcgctgcagcctggcagagtcctaatgagaagaatcgggaaggtgagctgaggcccacgtgtgatgggggagggaagatgcagcctgtccaaggacacactgacccactgcccaccactctcccctgctgcctgaacctacgagcagggccaggagtggaaaatgcctccccatcctctggcgtcccccacctcctggctccccctgcttcccatcctgcttgtctaaaaggagcaccgtctggcaccgtgtccccccctcactccccagcctgacgcattagtggctaagtggtagctaaaagctcccagaataaccaggggctcaggtaggggagggggctagggacatatggggagggcatagcccagaggcaggccaggaacaagacaacccacctcccgccccatgtgattccgagccaatcctcactcgtgctggaccaagaaagcacattcaggctgccccgtacccagccggactccatagttcccctgagtaccatttctcatggtggcagggccagcaaggcccagctccggccagataggagggctgcaaggatggctgggttgtaggagataacctccaccagacacagccgcagggccgggtgctcacagggctctgatcccattggaaagaatggggcctgactccttagggaccctaccctcgatcaccaccccagcagctgaccgactgtggcaagtctgggcctctggcatgcatttcctaactcaggcctgcctggtggagcacgtttcctcttctcattcactctggtgctgtcaccgtctggcccgctgtccccatactcttgttgtttgtgaaagaggagtgcagctccaggggagggcagagtgggaggtgttgttgtccatgaaggggctgggtcccatgctctggtctggcaaagccagccttgcaacctgacccactgacccagtgggccttgaatgtaacctcaaggagccttttgaaagtgggcagagagtcaggctctgaaaatggcaggaatgtgggcacccccacagagaatgcctaagtcaggcagtcagagaggccccgggccaaagagcagaaagcaggccgacctcaggttggagagccagcacatctggcaggagcgtcctcccacagttgtgcccccacccctgcactgccaggcctacctcacaccctcgcccaactacgtgtctggaaaagagagtagagggaaggcccacgtgatgcctaggaattagcctgcagcctctccaccctttggaatcccacatccacatgtcaaggtggaagggagaggatctaaacagtcattgaactgaaggacacagaggccagagaggctgtaccaccggcccaaggacacagagcgagggaagctccaagtttccagtacccattacccagctgcttctctccaggatcacatcctgggcttcctggagagcctctgatttgcaaaaagctgtatattcagcctctccctacttccctgaatcatccctactctacccttccctctcttgctcactaggtgccgagtcactaacctgataactaaagggaatcacccgcccacccaccttccaggtgaggccctgatctcctaggggcctttagtgatcaaagccttaaatccaaaggagtgactaatggtggaagtgtaggtgccgtgcatgtcagagtggtagaggaaacccttccactaggggtgggaatacaggaacaaatgtttctgtctctcctgatatggccaggaagagggtgtgagaagcctggtttccagggtggcaccggctcggtgctaaggataggtcatggttgcaggtgggtcctggcaactctcaggcagggttaggttctagattagctagtcgcctggcaggggcagagcctgtgtgctggggcaggtggtggggcctcgagacagcactcagctcatggaggactgagaagtctaacttgtttatgagctatgagaagagcgagctgtgtgctgggccaaaggggagcatcctcccacccaccaaggtcagctgtgggtgggaggggagtatatctcatgtgtggctcagccctggctccaagaagcctcattatctctttggtggctggacagctggctggctgtgacggtgattggggctgggccttcctgggttcattttcctccctgtggattagctgggtgcgagtcagggtgggtgctggtacttgtttgggcctgggttttatgacccaccaggattcttgaaacaaatcacaaaacaatcagggtgaagtccatgggtctttttgggaaagtgtgactctctgagtgccagagaagtcagacagttttctggaagtggaggcagcagaagaaactgacattctcatctgcttccactgaccagcccaccaaacctccagccaccctgcaaagaaggcaggacaacctgtattgccgttttacaaacaggaaaactaatgcccttccaagccaccaaggtctggatgctctccccatggcaccactgtgctcaaaggaccagaagaaggtttggctattggggagactgtctggggcaaagtcctagggagaagggacagtgtggaaagcaagccccttggtgagaggctgtgctgagcaggattcagggactcagggaaggaaggctggcactgaggcccagctggagtgggtaagatgccctgagcccacgcccagggaaggccggaagcccaggacaaacatcatgtcccatctaccttccagctgttctccagcccagcaggttccaaaagccccagagtggggccgaagtcgctggtggctccttcaaagcagacaaagggtagcggtgcagggcctgcccttgggcccacagccagggcaggggtcggggagagggcggagaatggctacacaaccccaagtggagggagggaggcaggtggaagactgctgagaaacagaaggttccccagtcttagccttagcctgaaccagcaggggagactgagcaagggcagccagccagcaaagcccattagggagaactggcaggggctgggctgccagggctgcattccatcagaaaccagagatgccagaggaggaggaggaagatgatgacgacgatgatgatgcccctaccacccaacccttccatcgcatttactacgtgccaaacactattccaaatgatttttagatatattaactcatttaatcatcactgaactctcatgaagtaggttcttttattatccccattttgcagatgaggaccatgagacacagagaagctgagtaacttacccagcattacacagctagtaaggggtggagcagaggttcatactcaggcaagctgactccagaatctgtgcttataacatcgtattccagagatgagcccttggaggcttccaaggtcagcccttcccagacagatgaggagaccaaagcctaccgagggtgaggcccagttagaggctacttggctaatgaagtcctgacctctgcccgtaacaccctgaagacagtgtgtgcaagtgagcacaggtgtgcaggcccaggtgaatgtagtgaattcctatgctttgatgttgccctggcatccgttttgaatataagctgggttttctcacactagaagcagggctcagtcaaccttgacaccgtttccagctccccacctcctcccagttcctccatgtgctcaatccagatatctaccgtagacagtcgtctcctggtgactgcttccctgtgggatggctacatacagcccacttgattggtcctgctgaccttgtcccacagcccgcatggactgtgcagataggccagtgaccttgtctcaagtcacaacatgacctcctggaactcatgactgcttgctgtaaacccaccaattaaaactccccatggaggccaggcacagtgggtcatgcccataatcccggcgctttgggaggctgaggtgggcagatcatttgaggtcaggagttcgagactagcctggccaacatggtgaaaccccatctctaccaaaaatacaaaaaaattagccagacatggtggtgtgcgcctgtactcccagctacttgggaggctgagacagaagaatcgcttgaacccaggaggcagaggttatagtgagctgagaccacgccactgcactccagcctgggtgacagagcaagactccatctcaaaacaacaacaacaacaaaacaaactccctgtggaaaacttgttttaataacaccatggaccccataaagatgctggcccatagatccccccaccctgcacatgctccctgacctccacctgtgtgtggcttcaggtacaccaggtatccctcaagacctgttagtaacaaaatctttatttccacctgcctctctcttaatcatggaagaggtgctctccatcttaaagatcctaagttacaacagtggggcaggaatcttctcgaggtgcagcgtggggccccggtcctgagtgactgattagaaagacaagtctcccaagatctcgctcagaacataaagtactctgtggggccgggtgccatggctcatgcctgttatcccagcacttcgggagaccaaggcagaaggatcacatgtgttcaggagttagaggctgcagagagctatgaatgcaccactgtactccagcctgggagacagtgagatcctgtctctaagaaaaaaagtactgcatgctctgaagctgaccacagtgaagggcagagtgtgctcaccagccaggtccccactcagccagccctggcgaaaacactcacctccactcctcagctcaaggacccaccatggctcctaactgcccatccaagcagggcccaaaacctcagggcagggcagtcaaggcccacctcatctctgcacagctctgccatggctcatttccatctctgcactttgctcctgttctcccctccctggattgaccttcctccttttctctgtgcacatggatcttacctgtccttgaaaatgtagctaaatcccttggatccaggaagtattccagactgctccagccctcactgcccgtaccttcgaccttgtaccacaaaccatctggcaccaccatcttcgctcagatcatgctgtctgatgggatttcatctggcctatggggccctgaaggtgaggaccaggcttcctcttgctccaagtcttccattcccagggagcagctcagacagtggagagaagcaagactggggcaggccaaactcccatgccagagggacaggtatcttagaacagattcctgggccaccaatggagtgcagaagtcatcacagtgaccttccttcctcgacaggctgggccagagctcctgcctcagcctcccaagtagctgggattacaggcgtgtgccaccacacccagctaatttttttgtatttttagtaaagacggggtttcaccatgttggccaggctggtctcgaactcctgacctcaactgatctgcctaccttggcctcccaaagtgctgggattacaggcgtgagactctgtacaaacaacaatatgaatagctgtctatgctgcactctgcccccaccctatgctcctgcccctagctctagcctggctcctcctcctcccccaggaagccttccttgattgcaccatcccacactgacctttcctgctctcacctcctgtcacagtcctaggctacatctgcaggtcattcctgacctccccaggggtccgccctacttcacaggcagaagactcacctctccaggaatgtgggggctccccaagggcaaacccagggcttctcttcctgcctctcccccagaggagccgaacacagacctaggctggctgccctccatgatgaggggtcacccaggggtgctggcacagagcccaagcctctggctggaagcatggggtgcagaaggcatggcaggatcagcataatcccaggctgtcatgacagttaaaacctgattagcccgagccgggacacagatcaacctgtccttgggacctgaggcccaacccacctgaggaaagaccagaagaggtatatggagctggtccaaatccaaggtcctgaagagaggacactcacagctggtgtggctcctgggaacagacagcactggggcgggaagagtctgggcccaactgggctagcagaggaggaaaggcactgaaggggcccccagcctgggacagagtatgatggcagacagaaagctggaaacaggctgagagctggggcagaagcaggctcagacgactcagccccggtcccagctctgcctctttgggtgatctcgggccagtccctgtcatctctgagcctcagtttccccatctgtggaatgtttggctggcccagctaatctctgacatttcttttctgacatcctaagctcgcgctgtcaggctgtgtgggttggggtcatccaagaaggttcctcagaggaactgagaaagaaccagcagcctcctttctgggcagaaaggaggaggagggtgagtggggtgcagagaggaggcggagccagggagcagtgagggaagaactgtgggagtctaggaggcagtggggccaggccaccatgcagggcctggggaaggcggcagctgtgtgccatgtgttctggatggggtgcagcatagggacagaggtcctccgggaggctgggcacagatctggagagatggcaaggccagggccagggagaataaagggcttggagagccaccccataccattcggggcagagaggggacagtccctcaaggcctggctggctagggaagggggaactctgtcctctgaggaggcagggcccaacaaggtgccgtggccctccatccccctgctttctttctggcctgcctggttccctgaggacaggacagctggccatacacctggtggctggccctccctgcaagggtacggaaccctggctcttctgaaggcaggacaggttaagggccccttcctcccccaaccatggcgaaggaaggctcctggggcagccacgctgggccaaaaaaggaaatcaagagaagtggaaacttttcagtccagagctgccgaccaaagcaggggaagtgcagtcagtctcttgtgacagagccgtgtgaagctgggggtggacaggctatcagctagtggcccatctactccagctactgccccctgagggctgccagacctgccccctgggctgagcttcacatcccaccttgcttggccctcctcaaaaaacagagcccagctttccctgcttcccccagggcgccaccctcagcccagatagtgacctatccatgccacccccaccctgccacctccatgctccttccatctctgcagaggaagagcaggagaagacagagctgagggacagaccttctcacctggagactgtcctgcggtcaggagtcaatggggaaagccatggtctccctggacccagagccagcctcccaccagggaactgtgacggggctatggccttgccagcactcgagaggccttccctgcctgccacggcccttctccagtgggtgcgtccttcctcctcactgctgcgccagtcataggatgacaggtatcccctcacctatgcccatctggacaagtttcaaacttttcgggagcccccaggcccaggctgactcaacgcctcttcacatgggggcccctcacatggcttctctcctctctgtggtcctagctgtaagttcttgggtttaaaatcctactaagtggggtgcttcctcctgttccttccctcccccagctggctcctcctcctgccatttcagcttgctccctcttccaggaagccctccctgattgggaaaattgggttaggcatctcctcagtgcccataactgctctctgttacacattctgttgtacctgcaggtttatctgcccatctacatctacactgagaagtctacaagggcacggaatcatcttgttcctcatcaccagatccccaagctcatccccaagaccagcacaagggtggccccggcaaatgtttgctgaatgaatatgtccacccttgagggcacatgctgatgatccatttcctccaaatgatcctcagcctttggcccacgagagaaaaagataggaaagaacgcgaacttaagggtttcccctgacttcccaggtttcaatttctcctccagatttctcgaaatctaagatttaaacaggccaccacagactctgcccagcccctcccatcccagagagagagaaatcctaagacattaaatctcagaaaaggatgagccccctcccctaccctctttgggcatttggggaaactggggttcagtaaaaggcaaagacttgcccagtcacagagcaaattaggtcacagcctgaaccaggctcccgacctcccagctctctcccctataccatggtcatcattggacctgtgccagcgtccattccaccggacctgctctcagaatcttcactgtccaggacagaggggtcacagagcttggtaggaagctcctggtgacctcaccaagcatctctcttggcttaggaaactccccctctcctccggggaattgcccccccaccatgagactctgtggagggagttcaccttgaaggtgatgaacacatctaagtccccaagggggcaaggatttccactggaaatgctgatgcttgggaagccccagatgtgacctcatcccctggaggaggtaacaacaacctcctgccctggggagcagccccagaatggctccccagcagccaccaagtcaacaataacatcccgttgtttcactggacaaaagcgagggagggcagaaccagccgggcaggttgagactggggatatgggttctgtttccccatggacaggctggttcacctctgaccttggggttccaagccttctttagctcctccaaccactgataaaatggaagaggggtgcacagcttacaaacgcatgccaacctcctgctaagccccagccctcacctgcaatctactcccttacagttcctgcttacaggaagatcaggaccacacatgcacatccttgactggcccatgtgtcagtgacagcccttgggggacaatccctacagcctttcttgctctggcaggctctaagggtcaaagacaagtgtggagctcaaggacacccagcaggtacatgatggcccatctctctccctggcctgagctacgctgtgccagactttcatcaagctgcagaggcagcaatctccctgatcagtgcaggctgggcccctctcagagttccctgctttaatctttctctagaacttggggatccaagcagcagaaaataaagaactttccatacctattccagtccccacagctgtcctgactcaaaactaaaacccccatctatgcctcatagagaaatggctccagaaccaccaccatccctgattttgtcattcctggataccaccatactcccacccaccactggtagacagagctctaggcttccagaaagaccccctcttaccctgttcctgggtttgtcctacccaagcccattcctgtccgattgccatgtgtcaccccacaggagacaggaggcagctgtcagtcgggcacaccatcaccagctggtggccctgggggtggggggcaggtgaatggcagggcctgtctggccagtggggcacctggcactggtgaaggagaccacagactgtcgttggacaagactggtgaacggttggcagaccccagccagcggggctcaacagtgcattactaagcagagggcacagccagtgtggctacagcagtgaactgcgggcgggggggtaggccatggagctgtgctgggagcttcgaaaagtgggtaagaggactgaaagcaactttaaatagcctcagggtgggaactaagtgcccaggatgggatgtatgcattaagtgctaagaagtgggtgtgcattaagtggggtgggggtggggggtcatgggaagactttgggacaggcaaacagagtcaaaatgcaaggggtttgatggagggaaagattccagaacactcagatgtggccatttgtcccctccagagtgcccacacgctatgatgtccaagacagccaaggagactgagggaaggcaaagctgctgggagggcaaaggaagcttgggctggagctgggatggcagaggggtgtgcaggcctcctccatgtacaggcggccggagctctagcagcactgctcggcttcctccaggagcacctcaggctgggtagccgagctggtccccagagcacctcattcatggtccctgaaccacctaaatccttctcccctccctaacccagaacctggactggtcctgtgccagatcagagcccctgcctgcacctgggctcccacactgctcagtgaccttgggcaagtcacattccctcagctactgcggcagttcgggccactcgttttgtgtatggttttttttcccctctgctaataatacctgccccagataatgctcagactcccgcaatccctgcaaactgccaaaggcatcaaaaggctcccggtggggccagacccgaccagttcccccagcccccactgcgagtcccccaccatcacgacaggggggccgcagacacgccaaatttggggacagagccgaatcggactgggggcggggaggcatttgtgtgcaatgcaggggaggggagatcagttcctcgcggcagaaagcctcaaacccccgcctaaccggctttctgtcccatagtacagggtctaaactgaggtgccctgggggagactccagtcccccaggttcttattatctaccctggcctaaaggctgcacccccgccctagatccaccgcctgggggtcccaacggccgtgccccacccaacgggcactgccccccaacgctggagccgatttctggtgacaactgccacgtgcgggcaaggggggagcggccggtcccggcattgctgaggcagcgccctggtaccccaagccgccgcaccgcaccatgtcccgccgctcgctgcaggatgcccacccccttgcctggcccgagctccgggccggggcgggggcgggggcaggcggcggggtctttgttcccgctgccgaagcgcggcggcggcggcaaggggtccgcgccccccttgccggcccagcctgcgccccgcgcgccagcagagcccgcagctcaaaaggagggtacccgggttggggtcccaggcggggaaaggtcctccgccgaagcccccgagccagaggacccagagtggctcggggccgagagaggggcccgccccctcccctggcgcccgggcgttgcggctcctggctgccagggacttggtgcgacttagccggggctccggcccccgccgctcgctcgccgcagcgttacagccggctctggtgtgccagcgtgtacactcacacacactcacccaaacccacacgctccacgcggggacagcgcggggacagcccgggacccgcagagctgcgcgcacgcactccctccgggtgcagcacactccgcacccgccccgcgcagcgtctgatcccgcgcctgaccggccgcgcggcgccgcctacctttccagacggcgaagatgcggggtccgctccttaggtggccctgggcggaggcggcggccgcccagagcagcagcagcagccgcagccgcagcggaagccccaaccgagccggcgggccagggacgcgggcgcgcggtgcgctgggggcggcacgtccgggcggaggaggcgtcatcccgtggccccgggagcgacagcggcaatcagccgagactgagccagcgcccggccgcaggcagacccaagcgccaggaggcggagccagcgctgaccccaccccgcccctccccccgcccctcgcagccttttctcgcctcactggctttcctgagcgagagcggaactgctgggggaaccttcgccaccctctcccgggcaactctacggggaaagcccagctgcggacaagccagacttgtggtcttctgccaggggcggcaggccctatcccctctctgggcctcagttccactccccgcaccccgtaaaaagattggcgtagaagtcgtggaggacctctctccaagggcgcagaggagtccaacacccaacaaccttgctatggccagctaagtggttcgcaccctgaggactatggtcctcggaggatgcgttcgcctaagtggacacggctccctgctgagcctaccagcaggcacaacgatgatatgtggggagcactcagggacccgctgttgctttgcctgggagaacactggaaatttttcatcttggcctggctccttcccctccctctcctttctcctccctttcccagccagcagccttctgggctgcctccccccaagccagctggtgtacgctcagaaaatccaaactcatttccatgtgagtggagggggatataattaggaaggccccttccccaagtagagaggggagcatcccccgtgccccactcactgtgggggagggagggtcaaagcagcttaaggggatctctgcccgcaaagtgcctagggctcagctatctcaggcaacctgaccattcagtggggactcccttggggggtccaggcccagaccctctgcagttacctgagcagtccagccagctctgccatcagctcctcctctcagaactacgtgcctgccctttgtaaaagggtctcctctctctagaccagacagggcccagacctaccacttccacttgtgccccagggaaccatgaatggaaaatccacccagctcagtaagtacttatctagtgtttactggatgtctagctgcactgagaggagacaggccgaggaaggagtagaggtgaacatccaaccttcagaactcacagacctagacacgattcacgcactgcagacaccagcaaaggcggtgggctggctgccctctgccctctgccctgctccatggggccaggaccatttggttgttgtttttacctcctggaaccaggaaagttttgctaccaagaagtttggctttaccattctacattttgcttccagttgtcccctccttcttccctcagagtcctgaggcaccccagcaggccaggaaggtaaactcaaggtacctccagagacagtgcagagtgaggttcctggcccactgggtgaagccaacagcctcctgatacacaggggcacactgccccagagagggaggctgtggacagtctaagagctcctcctcaggcctgcacctaagcctgtggccctgaagccagcagtggagcctggcccaggccagcctctaagatggacattcggtttcacctgctagacaggtattgccctcagtgtctgtcctctctatgcaaagctagggcaaactaagaaatcacctgtctctgccttttggaactaagaattcaaatggattcaaaatcaatgataacactgcccatgtgcatggcaactcacaacacataacccacattcacctacctcatctctgccagtcctccactctcttcctctcactgagggagggagcgtaactccactgcagagaagaaaactgaggtacagggagggacaaggacggacctgcccgaggtcaaccggtaaatggtagaacgaagatgggttttctgactgcaataacaattgctaacactgtggttcctatgtgctgtgccatctcatagcctctcccaactcattcaatcttcgcactcctatgagataggagctattagtcacctccctttacaaatgaagaaatcaaggcacagacaagggatgtgaagtgccaggatcgcacaactagaggcaggacggattgaaactcaggtggtttctcaaggacccacacccttgacttctctctgtgtgatgtaccctggcactgctgcctcctgtctgtggctgaagtctgggtccaaaccatccccagaaggacctagatagggcccaggtcaccaggtgctgagtaggagggcagaccagggaatgggctcaatctcccaatcaacagagtagcagatggaaactggggtagatgccagataattttttttccagactggggggtaggggggaaggaagtagtacttaagaccatcctccccacaagccagccaacctggggacaaagggccaggcgagatggcagcccactctctcggttggctgcaggcagccaggggaggagagaactaagcccatgacttgaggcaataactttataaagggaaaggcagctagactgtggggcaggcactatgaccagagtttaggcatggactttcctgcctcaggcagcataggaaaatcaagtcagaatggtataggtggtgtcagaggcctgcctgcctcattggaggccaaggctggctcttgagcctggaccaagaacaggggcacaattcccactcacagccagtgatgggaagtggaccagcagaggaagcaacacatgtggatgctgacacgtctgatggggaggcacattcttgtccctcccttctccatgattccacattcaggggagggaggaagaaatgatgcagggcttctatcgataagaaaaataccttgagaaggatcacttcctgagccccatggacagctgaggcacagcccaatccaagaaggctccttttggaatgaaagaaatggatacacacagacctgagattcatggtcttgaagcagtggcagaagccccgggcaatccccccaacattccaactaaagcctctcacctttcagggtccaacttaactcatccttccattctccagagttatctgacctcctcctcagccctgattccatggctacacatggccttcacaggagtgacccacctcaaacaagaggcctgtgggagatagaaggattccgtgaggagataacatatgcagacgtgaggtcacccacacacagttcacttcctttcacagatacgatgatccaagaatcccaattcttaggattagaagtagctctcagagggcattcaatccccaacagccccctccatgctagatcccaccccttctttgaggcctcagagcttggtggccattcagacctcctggctactaacagcagcaacaattcctattgcctaccaccattactacctattgcagggggcagagacttggaactgatgagaacgaggggagtgggtgggctggggtctgcagaaccctgtgctgtctataaggcaatttcgactcagctccagcccatggaaccatgaagaagtaaacccagtagtgaaaggtagtatgattttcaagagaagctgaaaattgagggctgggcacggtggctcatgcctgtaatcccagcactttgggaggccaaggcaggtggatcacctgaggtcaggagttcaagatcagcctgcacaatatggtgaaaccccatctctactaaaaaatacaaaaattagccgggcatggtagcgagcgcctgtaattccagctacttgggaggctgaggcaggaaaatcacttaaacccaggaggcggaggttgcagtgaaccaagatcgcaccactgcactccagcatgggacacaagagtgaaactctgtctcaaaaaaaaaaaaaagaaaagaaaagaaaaaagaggccaggggtggtggctcacggctgtaatcccagaactttgggagaccgaggtgggtggatcacaaggtcaatgatttctgtcctaatcattctacatgcatttttatctgacaaggtcaggagttcgagaccagcctggccaaaatggtgaaaccccatttctactaaaaatgtaaacattagccgggcatggtggcacgcaactgtaatcccagctacttgggaggctgaggcaggagaatcacttgaacctgggaggtggaggttgcagtgagctgagattgcgccattgcactccagcctgggtgacagggcgagactccatcaaaaaaaagaaaagaaaattgactctttgttgaaactctctcttttaaaatattggcaaataattcaaaagttaaggaggatggatatgggcaaataaaaacaggtctggggcccatatctgggacccccaacataccatgtgcccactgtgactatctcacaggcacaggcacgacagtcactatacctggcccaactcttggcagaccatgtcaggcaaggagtgccaagaagacacttctcaggctgcccaggccatgcctcaccctcccctcagtgctctgcctgcctccaaacctcagccaggacattcccctcaagtgcctgcctcttcctcctagaccagttcagagatcaccaccttccatacatcagttcagcccactgtgaatggagaacttctcagaactgccaccaccttcttagccctgagggtcgtgctcccagcagcatcccatgcctacatctctgctttctatcctaatcattctacgtgcatttttatctgatcaaccctacctaaattgctaagatctaagtagggccagccaagttaagtaagacaaaggaaaaatccaaagaggaatattcagtcagcagagaagagacagattttttttccttctagcagggcactcagctcacctgaaaacactacaggtcctgtgccttccacagacaaatcagcaacatccttagccccaagccccaaacttggccaacgtggcactgggcttgtggtgggagtgccacctggtggccactctggaacagagccgagtcttagcaaagaccaagtgcatctctgctctctgttctagtcatacattctacatgcacttttctgtgatagacactccccagactttctggagacaaacttctccctcccattcctatgcccctaatccatctctgagcctctattctcactgtccaaagcctgaggcagggcagaatctcatggatgtcacatagaatccatctagactaacaaaatctcctgactagacatggctgggaggccaaagatgaagtctcagcctggatactgactcaagcaaggccctgacccagtccaggcctctgtttctttgtgtacaaaatgagaaagaagagctaaaactccatctcttctcctggtctatcttctctctgtatcagagagagacaaagctttctcattccatcttctgcatttccttctataggatgaattaaatatgcttttaaatgatgtcggccaggcatggtggctcacgcctataatcccagcactttgggaggccgaggcaggtggatcacctgaggtcagaaattcaagaccagcctggccaacatggtgaaaccccgtccctactaaaaatataaaaattagctgaggatggtgttgtgtgcctgtaatcccagttactcaggaggctgaggcaggagaatcacctgacctaggaggtggaggttacagtgagccgagagtgcaccattgtactccagcctgggcaacaagagcaaaactccatctctaaactaaactaaactaaaataaaataaaaataaagtgatgtctataggagagaagatgtcccaggaccctcccagctctgatgtgatccttgggcctgctgaggccacttcagtgaggagatacacatgcaaaagggtggttacccacaaacagttcactttctttcatgaatataatgatccaagaatctcaattcctggagttaggagtagctgtcaaaggggattcagtcctacctgagagccactcacaagactccttatggtggccatgcaggttctgcttacatacctccagtgatgatgagctccctcacaagccagcgttgcccatcttgtttagctctgacacagagctttcttccccagtggaagactcccaaacagtggtcctaaatctgccctctgaggcaacaaggacatgtctaatctctcttcctggaatacggcccttcagtgatttcacagaggtcacatccttctaaatcggctctttattcagggtaaataactccagtttcaaatagatccctcatggggctttccttgagaggctctctaatcctggttgatttctaagacacgatcagtccgtcatttagcaaacttttactgacccctcctaggtgctaaacagtccagattgtgtctctctctttcaaagatcaggcctcagatcagaacacaacacctagtgtggaggctgagcagtaaagggctgaaagactagcttccttcctccttattctagcacctctaaaggcactcttaatgggttgagacaacacgttgttaaatcctcttgatctcagcccagggttatccctgggccaattctcaaccatcagtagtggctctctgggatgctcatttgagaaagattattgaatctgggcccaggagaagaaatgagactcgattctgcataagagcaattaattttctggtcccccttggccgggcgcggtggctcatgcctgtaatcccagcactttgggaggccgaggtgggcggatcacgaggtcaggagatcgagaccatcctggctaacacggtgaaaccccatctctactgaaaatacaaaaaattagctgggcgtggtggcgggcacctgtagtcccagctactcaggaggctgaggcaggagaatggtgtgaacccgggaggcagaggttgccgtgagccgagattgcaccactgcactccagcctgggtgacagagtgaaactctgtctcaaaaaaaaaaaaaaaatttctggtccccactgcaggaccttagactttctttgcttctgtccttgttagggttacttcattgtctgggccctgatgccatctagaacattcactggcccagctctgagtgcctggcatctctgatacacatactcaatatccacttatagaaattgagggaaaacgtcaaacaaggcacaactgacgctccaagaagttaggtcatatgtggaaaagcaatctaaacctcaatctgacttagaagcctaagtcccctccaagacctgagctgccactccaaaggtaagtggttaggagacccttcggccagccaggcacaaggccccaggtgggtgcactgatggaatcatgctgacacaatcccacccaagccctagaaaggccacttccccagcatacaggaagcactcctctgtacatggggctaataatatctagttttcagagtcgctatgaggattaactaagatggcacatgtgagtgcctagctcaatgcctggcacagagaggatgcttgataaataagcactactgtgctgtgtaatgtactattaatattagctagttttgccaagatagagtaggccagtgcctgggttgccacgaaagcatttctagcatagaagttgaattctattcccagcgatctcagagcctatgagaacgagacaggcccaggcccagaggaactaggggcacagctgaactgacctgagcccagcccagggccagaggggaccccacctgctggagaggctgggtaagcagaaagagggaggcctgaataaactccccaacatcctcaacaaacacccagggccaaagtctgtggcaacagcaacaagaagccacctcagggtagggctctgtgagcttggtctggggcccaggccagatgggactgaggcgaggagcagatctggggcccatgtgcccagcaagctgtgccagcccagcccataccagcccagccaaatttgagttatatcaggagaacggatctgttagaaaactcacccatctctacatatttgcatattctattttggggtcttttcctttttttccctcagcttcctagaaaagttcttgtgatcacttccaacttcacctctgctgaactgcaaaaactcacactcaatcccatctctcctctaactactatcctctccctcacaagcaaggtcccctgccctctctgcatccactgcccctcacctattcagtcctcaacccctgctatctggctccggttccattggaatgtctccccaaggtcaccaaggcacaagtcaacaagtccaaggtcagcccttctgttactaggtttgtctgtggcatctgaccccactgagcatgccctctttgtccaggtcctttcactccctcagctttgctgactcctgctctcaccttcccagaagcagcagatcctgcgcccgttccatgcctcacatctatcagtcaccattttctataaagctgaactccttagtgggtatcccttttcctctacctttctctgaaaagcttaattgccttctcacatgacacaggcccagtgttcaacttagaacttcctgatcactacctcagcccaaagacatccaactgtctttaattatacacatccccacctggctgtcctatggcacctcattccaaattgtcaccccagtcccttattcttactgctgcaccaccatccgcctgctcacatcctgcctgcctccccactttcagcccccagagctagtctgtccttcacacctagcagctcccctccacccagctcccctgcagcagctccagttgaggccccctccatgtcccatctggaggatccagccagcctcctagctggtcgcctaccccatctcacttcccacaaatccagcctccacacagctgtcagattatctcacacacagatctggtcccccactgccctgcctgcagctgcctcaggggtgctctttgccctcaggataaagccctagctcctcagccggatctaagccctcatcatctcccattcctccacacttcagaggccaagggcagtgggaggaagggcaccagctctggagtaagacagacctgagtttctgggaccacttgtccacttcctgcccatgagactgtgggcagatgatttcaacccttggaaccttggtgtccccatctgttcagtggagacaacagtatactcgcctttcccaaagatctggtatcaattctaactcctaaagcctctctacctcctcctctccttccccactgccacgccgtcaggtcagcctaccagcagctctaagtggatcactgccacagcctcctccccggcttcctcatgcctgccctccctcagtcttctactcccactatactcaccacacagcagccagaatgacctttctaaaacacacattggactctctcccgattgccattctgtgactcccattgtccagggtaagtctaaattccttacatagcttcaaatgatctagcctctgcccacccacttgccttgcaagccaccctgacaaacagggctacaaaagccaggtttgctccccactcccagccccctcagtacatataccttcgtgcccaattctcccttacccttcaggtctcagcgtagtgccactttctccatgaagctttccctcaccctcacacccccacccctagcccacgttagccccctctcctgtgagcgccacagcccctagacttgcctcgcccagttctcattaggctttaatgcaatcatctgtttgtccatcttaccaacaacacagcattgtcagagcaaagataccgtcatgtttatctggcagagagtggaggctcagtcaatgtttgttgaaaggatgaaaggaggcccggcgcggtggctcatgcctgtaatctcaacactttaggggaccaagacaggtggatcatttgaggtcaggagtttgaaaccagcctggccaacacggcgaaacctcatctctactaaaaatacataaattagctggctatggtggcacatgcctgtagtcgcagctacttgggaagctgaggcaggagcccaggaggtggaggttgcagtgagctgaaatcgtgccactgcaccccagcctgggcgacagagcgagactctgtctcaaaaaaaataaatttttttaaaaaaaataataaaaataagaagaaaggatgaaagggacaatggtgaggaaagagtccttggctcatggaaagccccaggctcagtgggggcacttatcagactcaacatagactactcaaaacatggccacaggaagcaaagccaacttgccaagcccctggaggaaagagccaacaaagaagggaaagggaaaccgtggggacggctctgttctgggaactggtattgggggttggtccaagggatagggcagggtgacccaaatgttctgcagcataatgggataggggagttaaggaaccccagcacctttgaaggcagtcctcagaggcagggtgagagctgccacagaatggaaacgagctctgggcaggctgtatcatgggcacaggaagggctgtgtcagccccatttgaccaagacagacccatgaggataggactggcctttgtttccaccacaaacaagcaagagacactgtgtacaaagacagagcttcctggtctttgctctcaaccacaagtaggcagctgggctccaggcagaccactgaggcacacagaggcctggcattgagaagcccagttctgagtcttttctgtcaatgcacatagagagacttctcaaattttctggaagaggcaaagaataacatcctgttcgggccatatctggacgttaagagtatcactgatacactggaggtcatccagaaaaacgaacaggatatgctgggaaccaaaaccatgacaggtcaaaggggcaagtcaatgacccaccatggcattccgtaaataactaaagccctgctaaggtagaagaggaagcaggcttgttccgagtggttccttagggcagagaggggaccaaggggtaatgccctggcaaatagttaaaggacagaataggttgtaagtggtaaatcttttgttcctggaggagacaagcagaaaccaaatgaccatgactgggaatggtggagatgaaacgcctgccaaggcagagggcaggagcacatctctgagcccctttccacccatgttattcccaaatgaaccaaaacaccatctgaggggaagaagtgttctcccaacgaagtattcaaagcatttaaaacccactttctcaacttggacatgtctgcgatgccgcagggaacatcacagggaacgccatgccaaggggaacatgagtgagcacaggcagatggagcaacagcttgggggttggtgccctctcttcaatattaaagctgagccctgttcatgttggtgttgttttttagtattgctatttaactgctcttgtatttatgccttcaggacaaggagggccctacctcctggcgaagctctgaggcctggattctggaatcattacagaacaagcatcaaaaaatgcttggtgagaatagactggtggggtggacaaagaaatctgtggaagccattgagagagagagaaatgtggaaggcaagctgcctccatgtgcttcccctgaaagtccacccagccactccatagactggacatctcggaagcataagcctcttctgggcacagctgtaatccagcagccaccctgaagattgggtgatagctctgcctagacttcggcacatcctgaggctcccaaactccaaagccccagagagtctgggggctacggctggaaacttctcccagaagttaacatgggtatctcacagcatcccatgatgtagggtctaacatcctccatccagggcccagaactaggggccagccctgctttgatgccacagcatcaagaccagcacaccttgtttgccccactgcctccaccaactcagatcagccagaaaggtcaagaactggacaaagcaggagagttgaccatcaggtatattggggaagggagagatggaggcaccttcatgagtgcctcccaagggcagtagcctctgcaacttgctgggggttcaggggaagcagggagttcatggggctcctccagcaaagatgagctccagggctgcttggatgtccccaccggtggcctgcagggcccgcaggctcagctcatcgtcctggatgcccatgtcacgtagctgctgcagctggggctgccactggctctgtggaaagataggaatgggcagaagctgttagctgggatccagtgaagactcacttaggtctgtgctttccggggaaggaaaggaagatgggggagtcctcagcaaagctgctgatgctgagttccacagaacacggtgcttctaggaagactaaaagataggcttgagggttaagagaacaaatccaaagttttacaataaaaaaaggaaattcttggcataaggatcaaaagagaatgtacaaattattcactgtctgaattccaagaggctaaattactttctttctcttgctatgtgtacacacacaacagcaagattttgctctttatgtgatgagtgttacagatttttttcccagtttgttagcctttggactttgcttcggttttttgtttggtttggtttgccacgcagaaattttcacctttttttaaatgtcttaaatttttgtggtatatagtaggtatatctatttgtggactgtaagagatgttttaaatttttcgcttttacaaacccaaaatgcataacttttatttaatggctcctggatactgagtttcagccaagaaagcccttccctactataaggatttgaagaaattcacccatattttcttctagtactttcatagcttcattaatatctctatttcatgacagcagggatgagcacaatttagggaaaacaacgtgttcacatgtgggaagaaggcaatgcaaaggggaagaaaagcaaagtcaaagaggcaggcagtgatgagaacatggagggcttaaaaaaaatgcacacagatcaatttgaattcattttacaggccaggtggaaccagtgaaagcttctgagctagggaataaagtaaacaggcatctagcaacaggggagatgcaagaatggagaagacaagttgttcacgaatcctgcttctgttccctcactgtctacaaggaccacatggaacagtgaaaaccacacaggcttgaaccctatcgttacgacttcatggccttatgaccccagacaagttccagggatgatgctctacccataggcttactatgtggaatagaggaaaacagacgtgaaccaaactgctcatgcatggagctgtgaactacaatgctggcccctcaggtattccacttagctgctagggtgacctttctcctccttaaagcctcccatgggccaggtgtggtggctcacacctgtaatcccagaactctgggaggctaaggtgggtgaatcgcttgagcccaagagttcaagaccaggctgggcaacatagggagacccccccatctctacaaaaaatacaaaaaattagccaggcatggtggtgcatacctgtagtcccagctacccgggaggctgaggtgggaggatcacctgagcccaggaagttgaggctacagtaagttgtgatcacaccactgtactccagcctgggtgacagagtgacaccctgtctcaatcaatcaatcaatcaatcaatgcctcccagggatccctggtgactgctacatcaagtcatcaagtctaatctccgcaggttggcatgcaagcccctctcgtaggctcctgctctttctctggccccatctgcggatcttctacactggacactgcatcctagccttgtagttttgagtatgtcacatatacctccacacatgtgcacaaacaggtagctgtcttcacctggaaatcagccccttcctacctcaaacccccttccctggctagctaacttctaactaattcttctgacaatcagcttaaatacccctctctcagaaaagttttgtctgacctaggcccttacttcaagcagctgggtttcttgccttgttgctccccagctcagtgcctgcctggtgcccctccatggcagggatgagaaccagcttgccactagcccagcatctggactcaggcctagtatacacatgctcagtcaatgatcactgaatgaatgaatgaaatggccatgattatctaagccaggtggtctagggagtcaggccatggtcactaggggcaggagaagcctagtgaccactgtgtatggtctgagagtgtgcccttgctaggaacactctgcacctgtcccactgccatgctccagctgttcctagaatgaagcatgccaggtgtgaaggaccgccagagagcaaaacaaaggctgggcatccaaaataacaaggaagccacatggaaaccaagacgtggggaagactgacctgaaggctgggctgcccagaggcctgaagggcatgctgtagggcttggctgaagagatcattggtgatgggcgtccctgactggacaccagaggacattggtgaggtccctgaggaatgaccctagagacaaattagtggtcagtgccaccctcagcgccatctcaatcttatagcagatgctcgctgttgtcatatcacctcacagcactcctgaggtacccaacttctgcctcccaacaaagacctgccataagacaaccaaacaaaggtaactagaagctctctatgtgggcaggaaaggttccattctcttctgcactgagccccttgtcccagcctaggaccccagcactgcagcactgggagagatggccttgaaagctgaagtgacttgtcacccagaaatgcttaagctggtgatgtctgctccctgtcagggatgaggaagggcatattgtgtgcaggaagagtcttctgaactaataggggggactacacgggaccatgttaaaatctagacttctgagtcctcaaggcaagtgaaggggaggtcactcaagctgcagtaagaaatccccaccaggactccagggttcagcttaaactagatctagcaccagggtcagcaaaggcaaatctactctactgctggggagcttgttccttgggggcccagccttgatcttcccggccccgtcttcatacctgggtgccaggagtcggtgtgtgagagctgctctccggagtgctggccagggccaaggcggtggccagctcactctgggtgatgggccggggcccagcagctccactgtaccccagggaggctgggcgggagctgggagtactgctagagggtgtggacctggtgttctggagaaagaagacactcagaatcagggaagcagtactgtgaaactcccagatgaactccacccacctccagcaatagttcttggggaaactcttaagttcccaggttcagaaaggaatccaaaagcagaaatagtatgacatggtcttggccccccaatggcgtatgtccatctcccagccttgggagtgccaggtcccaggatgcagctcattcccagcaccatctcccccacatgtcagcatgtcaggcaggcaggcaggccacttactgggtgaaagtcatcctcatcatctgagagcccttcaaacaggaagccacctggaggaggacgaacagatttcaggaggaagaacagaaaggcacaggcgcagctccagaatctcagctcaagttactctccaaattcatattttcatctctcccctcggaaaattacaggacagatgcacttcctgactcaaaccgagagttcccaaggaacgccctctgccaacgctatacatagctgctgagtaaagcaaattcctgggccactgccggctcctgaggggcccacattacacttttcaggcgctcacctggcatatcccggtatgagctggagggcatgctccgggaagaggagtcagtcccaggcattggggcactgcctgctacggagtgcagaaccaggacaatggcattgacgagggctgggtgagcaggcaccaacctaggatagaagcaggaagaaacccaagggtgactccaaaagagcaccctcagccataacaggagttctgggtgccccctcacaacaatgcagccacctgtgcctgctctcaaattcctcagtctttagcatcttccaccaggaagctttatcctcctgctgatctgcccccagcaacgggtgcaaggccttcaaattcctggggtccgctgcagattcttcaccctctccacaggcaaggcatgatgggaaaggtgcagcctgggaggctcagggttctggcctgagcacatgaggagtgtctggtctaggcaccactactacatcaggcaaccctggactggtcccttctcttcccagggtggggctgttttcttcacttgcaaaatgaggacatgtcccttttagctttgacactttacggatctgtacacctgcttctccttttgccagcttaaaatccttgaaaagctccctaatttctaccacacgaaacctaaactgagcctggcagacaagaccctttccctcagaatcctgcttcctcccagcactcttgacaaaagccctgctcttgggctttgctctttctcaccccctgacgtatctaaggggtagacttggtgacagactatggatgggctcccagagcagactgcagggtgacaattaggcttctggcctgagcacgaggagagagaaggtaccctctaataggacaggtacacttacgtatcaagcatattgggatcagcgaagacagagaagaggtccttgtcctggagaacccctgaaaaagagcagagctcacctcaaagaaaggaaatcagccagatccaggagggagaagaggctttgcgtctcagagcaaccagctcaacagggacacaggacaacaagccaatcttcatgagaagtagaggaagcaaagcgccaagcaatacaattcaggtactcctcatcttggtctagtgaggatggtcccctgctctccacctcccctgcactttagtcacatcacagactgggtaccaagacacctgtctctttctcccgtatctctgggttcttcccttactcagggtgtgcaggacgccttccctgattgctgtgatgtgggctaactgctatcctcatttggcatcctcatacccttatttacgatgttagttaggccattatctctctgtgggactgagagctcttaaagggctggggatatcaaacacaccttgattactctccctcttcccacaagaccagtcattcttcaaaagatagtccaagtctctttagaggaattgtcttctcctgttttctccttttccgacaactcctatttcctcaaattcagtcctgcacttaccaagagcaatagggtcactgctgaggcctggggtggccacaatgatctgatccagagactccttattgctgagcatcttaaagacctgcaggagaaatggcgggggctgagcactccaaccagctcaatgtactcatcaaatgcccacactctgccaaaggacttcctccctctaagtgcttgcatgtacatcaccacaatggaacaatagccccagaaacagatgaacctctttttgctctaagatcttagcttactggaggggaaacaaacaatttaaaaaaaaaaaaggcaagaccacagtaaaccttcaaatctctgtgctccttttccccacctacagtttagtgcttccaaaataaaagctctcattacaagcccggtaacaaaggtttctctaggttccaatccaaaagtccttttcaatctctgtacaattactatttcatatttgtatatatcgctaagttcacagctatactaattttgcctctcaactctcctacagaaagacatcagcccacttccccagtgaggacatctaggtcaaggggcagtaagcaggcagttcagccaaagtcgaagaatgaggcccagcagaaacagtatgaggatcttttggctgtcaccatacgggcaggttgtattattatcattagagggaatcaacaacgcctgactgagacaggctctttggggaaagacagggctctactgaggcccacagacatggcaaaaactccccaaggaactcttggttgccatggcaacgggcttccagctcccactccacaccactcgccagccagcgttcacaccctctcctacagtcctggctgggggccgcagcacacactcaccgcctccctgtaagaggagctgctgtgcagggcagtgtgcaacacccggaactctctcatggcagccactttgtccacaggttctgggggacaagacattcagagttaccctatagcgcaggtcctgtctctgccacagacatggcaacatcatttcagcatgtgccaaggagcagcctggtctgtgcattcccttccctcatcaccccttaagaatgtgagtgcctgctcagaaaaacccatttgtgccatggatgtgaaaactgctagtaagcatctttacattcacttgtaagcatcttgcacagataaacaaacaaattcaagttgcagcagaggagactcttaccacatgaaaaacggtgctctgatcaacataccactgcaggaattctagactaataacatttgttttttggtgtttttgcctttgtttttcagacagtctcacctcttgcccagccagaatgcagtggcgcaatctcggctcgctgcaacctccacctccctggttgaagcaactctcgtgcctcagcctcctgagtagctgggattacaggtgtgcaacaccactcctggataatttttgtatttttagttgagatggggtttcaccatattggtcaggctggtctcaaactcctgacctcaagtgatccacacacctcggcctcccaaagtgctaggattacaggcgtgagccaccgtgcccagccctgggtcacactttttaaagtatggttatcctcacgaaggaccactacttgtgactgtactgactgtgtactgcccaactccagggcaccactcccaaagcaaggtgaatagcacccctggggttcagggtggcagccacatccttatcgacagtcctgatcatgaggctgtcttttgaaaaacagtcatcttaagtaaattacctaatttattcattcaacaaacatgtactaagcatttactccatgcctggctttaggcaaggaactagaatatgaaaaataagaacccctgccatcaaggaactcttagggcaggaggagaaatgagactacatcaaatacacaattacaaaatgccacgttgaagacctcaacagagacgtggatcccagctagggtaccaggaacacaaaggcagacaggcaccactgagagggagggtgaagatagacagctgcctcccagaggagaccatttgaaatgggtatcaaagagagagctgatatttactgggggggtgaaggtattccaagcctgaatgagaacatgtgcaaaggcatgggagaataaaagaatgtggtgctttgaacaaacagcaagtcattctttgtggctggagcttggggtacacattccagctcaaacagcaggttaaggtgacgtcctgaagggatttgtaacccgccatggaggactaccaaagagatccaggtgggaagacagacaacaatgggttcttctcctataggccctaatctgtgggagaacacaaaatgtgattcctttgtgaagaaaagcactcaaggagcaaatatctaaaacactgtcacaaaacagtttctttacagatctaaaagtttattgtaaccttccaataaaaaggtcatttgtttcaaaaataatcctccaggtagaaggtgggaggaaaaggactcttaatatcttaagccattattcagctaagagccatggctgtcactgtaagatctctgagctaaattcatcctttagaagtggaacgcagccagcccagtggaaatggttttcctcttgagccaggaaaacccctggtccatatcccagctcttgcattcactttctaagtagctgaccttgaataaatgccctaacccttttcttcctccataagatgctaatgctgttacctaccctgcagggccactgtaatgattaaatgaggtataaaagggaaaaaacctggctcacagaagccacaaatgttattttccttctgttaatgccctccagccaaagagctgaggggcatatctgtatttaaacaagttgggtttactgctcagtacagagagaagaatgcacaccacaggaaaccgtgggctgtctcagtaagaggatattagaaaggacttttttttttttgagacagagtttcgctcttgttgcccaggctggaatacaatggcgtgatctcggctcattgcaacctctgcctcttgggttcaaccgattctcctgcgtcagcctctcaagtagctgggattacaagcaggcaccaccatgcctggctaattttgtatttttagtatagacggggtttctccatgttggtcaggcttgtctcgaactcccaatctcaggtgatccgcccacctcggcctcccaaagttctgggattacaggcgtaagctgctgcacccggccagaaaggacttcttacaggattttggttttgtctggctgatttggggaaaaatttaaagaagtgaggttttactctggataggatgctttcaggcagtgggagtgattttataattgagtatcttaataactcttacctagaaggaaggaaaactagagcaaggtggaagctgtaattggccaagaagcagctgttactctcatcagccaagatagaaagatacttggtcacctttgtggtttggataatgctcatgtttttgtgtttctgttcagcaataatagggatcttgtttttgtcttaatccatagtggtctcagagtggccttgactgctactggggatctgtacaattgttcatgatccccaaaaggattccagggcctggctgtgagtgccaggccaacctctggatgtcaggaactctgttcctctttctcacttcccatcagggtatgaaagacatttttgtcttttacagttagaactgaaaggggggtaaatttcaaactgataactagtcacagcaatcatgaacattataaaaagatgtcaacctgccagtgtaacaaagctaatctcttttacacagcttagctttattcttagggaggcttttaaaacacacatgcaaaatttaaatcatgaattccaagcaccttctatttataaaccaaaaaggcatctgaggctttgtatattttctccaagagctatttaaatactctttgaatatcttcaggaaaataccagtatagcaagagcagttagctaactgaacaaatcaccacctgaggcagtttgtaggaagatttgttaacaagggaataaactgcagcattaggaaagtgccaaaagtttccagcttttttctaatgagaacaacgataataacaaaaggatacaaagtttactttgtatcactaaaaaataaactgttaacttaaaggagtttaagtagacacaaactccctgtcccattaggaaacagtggatgacaaacttagaaagtggagaaacaagccaggaatggtgcctgtactttgggaggctgaggtggggtggatggcttgaggtcaggagttcgagaccaggttgaccaacatggagacaccccgtctctactaaaaatacaaaaattgaaggccgggtacagtggctcacgcctttaatcccagcactttgggaggccgaggcgggcagatcacaaggtcaggagatcgagaccatcctggctaacacggtgaaaccccgtctctactaaaaaacacaaaaaaaattagccaggcttggtggtgggcgcctgtagtcccagctacctgggaggctgaggcaggagaatggtgtgaacccgggaggcggagcttgcagtgagccaagatcacaccactgcactccagcctgtgagacagagtgagactccgtctcagaaaaaaaaaaaaaaaaaaaattagctgggcatggtgactcatgcctgtaatcccagctactcgggaggctgaggcatgagaatcacttgaacctgggaggcggaggttgcagtgatccaagatcaagattgtgccactgcactccagcctgggcaacagagtgagactgtctcaaaaaaaccaaaaaacaaaaaacaaaatggagaaacaaatcttccattagtgatgccggcagtaagaaggtcaaaattggactctgtttatcagcatggtctaatccaataagtaataaagatatcatttatcatcagctcagtaaatcatccctttgttccacccaggcttgtgcctcaagaacacacagatccttcccttgcggatattacagaaactctgcctgcctaagggctgcccctcactcacccggtttctgatcaggttcaggccaggactttcgcagaacatggacagtggacccaggttgaatgccatagaagtcaagtgtctggtcatcttttagcttccgaccacagtagatcagatctaaaaaaagaactgtccacttatattttgctcctcaaaacaaatttacatggtttttgtcccgagaaccttattttgattagatagctggagaatgatacatgttttaaaagatactcttattcaataacttaacaaatacttttttttttttggaaaacagggtcttactctgttgcccaggcttgagtgcaatggcaccatcacggttcactgcagcctcaacctcctggggtcaagcaattctcccaccttagcctcctgagtagctgggactacaggcacatgccaccacacccagctaatttttgtagttttttgtagagacggggttttgccatgttgcctagactagtctcttaactcctgggctcaagggatcctcctgccttagcctcacaaagtgctgggatgacaggcgtgaaccaccatgcctagccaattaaatacatttcaacaactatttgcaaatataaactcataaaatggacttacatcgaatctggccagatgtggtggctcacacctataaacccagcacttttggagcctggccgacatggcgaaacctgggccatggcgaaaattagggccgggcacggtggctcacacctgtaatcccaacactttgggaggccgaggtgggtggatcacctgaggtcaggagttcaaggccagcctggccaagatggtaaacctcgtctctaccaaaaatacaaaaattagccaggcatggtggcagacgcctgtaatccctgctactcaggaggctgaagcaggagaattgcttgaacccaggaggcggaggttgcagtgagccaagatcacaccactgcactccagcctgggcaacagagcaagactctgtctcaaaaaaaaagaaatatatatatatatacacacatacacacaaaaattagccagttgtggttgtgcgggcctgtaatcccagttattcaggaggctgaggcaggaaaattgcctgaacctgggagacagaggttacaatgagctgagatctcgccactgcactccagcctgggcaacagagcaagactccgtctcaaaaaaaaaaaaaaaaaaaaaggattcacacagaatctatccacagaaaaactctggagtttaacattgtggaggctgcccaatttaaatcaatggaaaaacaacaaaataggatgaacccaatccaggtatgactgaaaacatctttcttgccagttggatcctttagctattaaaaattaccttttcagtgtaatttaattatatttaaattcctccctcctccacctggactgcccacgccactttttcttttttactgcctttcctttactcagtcaaccaagcaaaaatccttctaatcatccctgaagacctacctcaaatatactgaggagcctcccctgaccaacttctcctttcctaactcatcccaaacttctgttctttcagaaaaagaattcacaatgttggccaggagcggtggctcatgcctgtaatcccagcattttgggaggctgaggcgggcagaatcacaaggttaggagttcaagaccagcctggccaacatggtgaaatcccatgtctctactaaaaatacaaaaattagctgggcatggtggtgtgtgcctgtaatcccagctactcgggaggctgaggcagaattgcttgaactgggacccaggagacagaggttgcagtgagccgagatcgcaccactgcactccagcctgggctacacagcaaaacaaaaacaaaaacaaaaaacaagacaatgtcataaagaacctggtgataaggtagttcagtataatacatggctgaaatggcaaccaatagtttcattatatgatttgtgtttctatttacccaacattcacttccctggagtgttaacattatgaggcaacaaatcccaagcccttactttactcttgtaattccagaagtatcctcccccaaaagagatcagagcagcagcccaaccccagtccagagagactcaccaatcagctcagggtctggaacagactcctggagtttgccagcaataagctgcttcagaaatgaaatactatagccccctagcgagtattctcccagttctgtctctggcaaccgaagaatagactttggagtaagtggctggtcagccagcttcaccgccaggtgccagtctgagagagacatcctctctctttcgcgctctctctttctccctgtaaaagaacaaaacctcagtggttaaaagacagaccaccactctactccacccccacccaccaaagggttgaatgaaagacaattcaatgtgacactgttgaagaggcatagggcgtaccatcaggaggccagaactagaatctggggttctctctctactcatactgtgatggacagctctctaggcctcagtttcttcatccctaacgtggacataaaaacgccatccaatctaataggaatgttgtgagagagatcatctaaccctctcccttctgtatgcccctttttccaattttcttcaactgttgcttgaaccagtagaacagctttataacaagttccctgcctcttgcctctccctatcaaatatctatgctgccacctaacaacacccatcatttttttttttttttttgagacggagtctcgctctgttgcccaggctggagtgcagcggcgcgatctcggctcactgcaagctccacctcccaggttcacgccattctcctgccttcctgcctcagcctcccaggtagcagggactacaggcacccgccacgacgccaggctaatttttttttttttttgtacttttagtagagacggggtttcactgtgttagccaggatggtctcgatctcctgacctcgtgatccacctgcctcggcctcccaaagtgctgggattacaggcatgagcgactgcgcctggccacaacccatcattctaaaacacagatctgaccaagtcacttctctgcttagaactcttccaatgtcgggctgggcgcggtggctcatgcctgtaaccctagcactttgagaggcctaggcgggcggattgcctaagctcaagagttcaagaccagcctggccaacatggtgaaacccgtcactactaaaaatacaaaaattagctgggcgtggtagtgcgcacctgtagtgccacctactcggaaggctgaggttgcagtgagccaagatcacgtcactgcactccagcctgggtgacagagagagactctgtcgcaaaaaaaaaaaaaaaaaaaaaaaaaaaagccagacgcggtggctcacacctgtaatcctgtcactttgggaggccgcggaggacggatcacttaagatcaggtgtttgaaaccagcctggccaacatggtgaaactacatctctactataatagaaaaaatttgcagggcgtggtggcaggcgcttgtaatcccagctacttgagaggctgaggcaggagaattgcttgaacccgggaggtggaggttgcagtgagccgagatagcgccactgcactccagcttgggcgacagagactccgtccctccctgccccaccccggccccccagaaaaagacctcttccaatacctctaaaccatctatataaattaagtctaaacttcatcgcctggcttacaaaactccctgccagcctcattccccaacagagccctacccctgcaaaggacctccacaacatgtaagtacacactcataacaaagctctcccctattttacacctctgctcatctaactctgcatgtaatttctcttccctttttggccttttagcaaactcctaccgaaaccaacacagattcaataacctcagtcccctctctttcctctgttgttcccacatcccctcagaacaaaagggctacaaatatctgcttgccccctcctccaccccaattcttgaatgcccttgaaaacaaaagactaaagttttcttcatccttgtccccatacctggcatacatggaaccccagaaaataaatcagaaactctgacggcggaagaatcttgcaaagcaagataagttcttgttatagtcatcattattgcttccaaagagacctctgatagagaagaggaaagaaaaggctgtgaagctgcctagcagaccttcaagcatcctcaaggtatcttccacctcaagtttatgccagaaggaggtcgttttatataccatgtctcacttaatcctcacaacggttccctaaggcaggcattagccacattttaaagatgagggaagcaagactcagtaaaatcactggcccaaggtcacagatcgctagtaatggggcaggaacactatccggtggcgacctcaccgctccagtgggaccagctacttggctgacacacatcgagcccgcgctgcccagggccccagcgccctcacccgtcccgcggaaggaacccggccgcactgccgccggtgtaaacactcactctggccctctcgccggaaaccggaaattccgcgctgcattctgggagttgcagttcccgctgtggccccccgcccccttataaacagccagtctacaagaggcgctagttgcaaagcttccggttctgggggaaggcgtggcttccgcgctctttgaaatgtccggcgccggaatgtctgggtgctttggttggagagggtcccatttccagtcattcttcagcctggtgattcccgcgctcccctgaggagcatatgaagtacgtcggttctgccaggttggaacgcgctgctggacactcggccgtaaggcggatcccggatcccctcccactccgacccttccctccagaagggccggttcccaaacggcccctttagacacatccaagcggttgccgacggccctcacgatgaaaactgctgtccgttggtgaaggcagcctcttctgtgctcctcgccgctgacttcctgaggcggacctacctgtggaggcataccaggaaccagacgatgaccccctccaaaagttgggtctttgaggagagctactaacttgggttcctggtacaccctctacatgcagtggtgaagcttatctaacagtcattcatagaatcagtttgggaaggggaattttcactgaactctcatagagaaactgtgttttagataacagaaagttctgcacggttaaaatggaacagaaatttttttgcacagaaattaggattaccgaaaatactgaagaaagactacctctgattggactcttctcaaggaattaataattcaagaactaaggaaagaaaaaagtgattatatgaaaatactgaagttgatcgtagcagctgaaggctgatcctgtgtgggtaaatgtaaacgctgaattcccacattccaatgtgcgacctgggattaaggcagcaattgagcagggtaatgttactgaggagagcgaacagatcgcaggatctcagaaggcctaacattaaaggcagatcacccctctgttctcataagttatatggggagttttgaaatggctttcactgtcttcagggagtttatcttcaggataactcccatgtatgttgtgggcgcattaggaacccatggctgttcccaaagtctccctttcccatcctacccatttttagatataccccctctttcagtaatccttcctaactagacttctttagactccttcctctcctgcctactaagttacttgcacctgagctccataatttatcaaaattatatattgtgaatactttcccagttcatgattttttttttactcttaatggtattagataatttaatttcattttaaaacttttttttttttttgagacggagtcttgctctgtcgcccagattggagtgcagtagtggccgatctcggctcactgcaccctccgcctcccgggttcaagagattctcatgcctcagcctcttgaggagctggggctacaggtacctgccaccacgcccggctaatttttgtatttttagtagagacggggtttcaccacgttggccaggctgctcgaactcctgacctcaggtgatcccaaagtgctgggattacaagcggtagccaccacgcccggcctgaaattttgttgtgatggttagtgccttttgtgtcctatgtaagaaatctttgcctgccctcgttatgaagatactatcctaggttttcttctgtgttattttatctttcacatttaggtctatgattaatttcacattaatctttgtatatgataggagttagacatcaagattcatctcttccatatgggtgtacaattgatccagcactatttaaaaattttgttcccactgaatttcagtggcagctttgtcataaatccggtgactatgtatgtctgggtcaatttttgactcttattctgtgccatgggtgtatttttctgtcattgtgccaatgtcacacgtcttgatttctctaactttagagtaggtcttgatatctgctagccttttggctttaagaggggcatggctattctatcaccaatagatgacaattgttaactttgttttatgcttctaaaagtataattttactgaatcttaaatatgtatattcaacaaaatttagattacactgtacatttgtttagtaatctacatattttacctagcttgaatatttcccctgtgctcaaatattcttgagactttttactttgaaataatttcaagtttacagtacagttgcaaaaatattacaaaataatgccctcatacccttaacccaaagtccccagttgttaatagtttacatttacctcatcattctttctctctcactctctcactatgcatattgttcttttgtttttccacccgatccgtttaagagccaattacagacattacccaaagtatttctgtatttcctgaaaacaaggatatattctatgtcacagccacagtacaacccagcaaaatcaagaaattaataaatacaataataccatgtaacttacaatctcattcagctttcatcaaccattccagttgggtggaggctgatcatctctctgccattttcataagttatgtcatagattttcacatctgtcacatcattcatttctccaaagagccttagttccttttagtaaggaatggtatttagaagccaagtttggatgctaggtgtgtttattgctactgagatgtcattatttccagtctatttcagtgactagacctagcaaataaatgaatattgatatacacacccattcatctatatttctatgaaatatatttaaatatgtgtgcatatagatgtgtatatgtatatatagatctatgtatatgtgagcatatatatgtgcacatatatcaaaatatatatgtatatataaaatatgagttcacaccaatacctcaaattccaatccaataccacatattttcctctagtcttcctcttctctataattttacctcccttctgcaatagtaggaaacttgattctcattttccacaatatacttgtattttctcatgttgacattcatggtacctgatatggtttggctctgtgtccccacccaaatctcatgttgaattgtaatcctcaatgttggaggaggggcctggtgggaggtcatgatgtttggatcatggggcagacttcccccttgctgttctcatgacagtgagttctcaagagatctggttgttcaaaagtgtgtagcacttccccctttgccctctctctcctgctctgccatgtgaagatgtgcttgcttccccttcacgttctgccatgattgtatgtttcctgtggcttccccagccatgcttcctgtatagcctgcagaactgtgcgtcaattaaagcacttttctttataaatcacctggtctcaggtagttctttatagcagtgcaagaacagactaatacagtaccataacaatggagcctcctcttcaacttgattcttgagtccttttgacataaccctggaggtttttgatagctccctgctatctagcatgacaagagttcctagctaatcttgtacttcctgccctaggcataaaaattagccatttcttcaagaaattcatatggttttctgtgggaaatggtatattaagaccacaatctgggcactagggatgcttattgctactgaattgtttgttacttgtaagccacattagtggatggagctagggggagatctatatccatagagatataaatagagaatatttatactgctacttcaaattcaagactacagaggttgggtttggttttggcttttggttttatgggttgctttttgttttgttttttttgagacaggatctccctctgttgcccaggctggagtacagaggtgcaatcatgactcactgctgcctcaaactcccaggctcaagcgattctcccacctcagcctgccaagtagctgggactacagttgtgcaccaccatgcccagctaatttgtgtattttctgtggaggcagggtttcaccatgttgcccaggccggtcttgaattactggactcaagcaatctgcccacctcagcctcccaaagtaagactgcagaattttaatttaatattttctatattacatctttatttcctttcttccacactgagaatactagttctcaagaacataagggacaacagtatttaaatatctattttcatttcctttatcccatatcacatacccaactgtctcaaaataacaatactaatgatactatcaccaccaatataattattgagacgtttaaaaaaatgtttgcatatgcccttctcattctatcccctccattcattctctccattttaacagatgtgctgtatattatctgagcctatactcattactctaccttcctctttttaactctcttaatactacaaagaattccatgtttaggccaggtgcggcagcgcacacctgtaatcccagcactttgggaggctgagacaggcagatcacctgaggtcaggagtttgagaccagcctggccaacatagtgaaacccttctctactaaaaatacaaaaattagtgggggtgtgctggcgggcactgtaatctcagctacttgggagcttgaggcaggagaattgcttgaacccaggaagtggaggttgcagtgagccgagatcacaccattgcactccagcctgggcgacaagagtgaaactccatctcaaaaataaataaataaataaaatcagaattccatgtttaatgctttccactggtttttgttgctgttgttgttgttgttttgttttgttttctgacacagagtctcactgtatcacccaggctgaagtacattggtgcaatcttggctcactgcatctccaccccaggttcaagcgattctcctgcctcagcctcccaagcagctgggattacaggtatgtagcacaatgcccggctaatttttgtatttttaatagagacagagtttcaccgtgttggctaggctggtctcaaactcctggcctcaagtgattcacccgccttggcctcccaaaatgttgggattacaagcatgagccactgtgcctggcccagtggtttttattactgaacccgttctttagtggatttcctggaaggactacaatattctctgtgaatgatattccctaaacttttgcatattaatagcagtttatttctggcctttatgcttgaaaatcagtttgctaaatataaaattgttggctcacattttctttcttaagatatttcattttcatctgatgacagaaatctaattttctttcccttacaagttacttgctcttttcaccaggttgcccaagtagtttttaaaattttttgtttaatttccagtcattttacctgactacatcttggtgctgtttgttttaggtcagtagtctcagttatgtggtattctcttccaaaatgtaatttatattttttttatttcagtaaagattgatttttgaattacaggttttagaatagttccgttctcttgccttggtttggttcttaagaggactcatgttagccatatgttgtatctttgttgtttctcttcaatatctgccacttttctcaaatcttttctctttcttcatttttaaaaatattttttaaatgttcctcctttctacattctacttaaggcatcatctgttgtatttatttcttctgtgttccttttgctttagtcttcattttgtatttattttttattttttattttttgagacagaatttcgctctgtcgcccaggctgaagtgcagttgcgtgatctctgctcaccacaacctccacctcccgggttcaagcaattctcctgcctcagcctcccaagtaggtgggattataggtgcctgccacagtgcccggctaatttttatatttgttagtagagatgaggtttcaccatgttggccaggctggtctcaaactcctgacctcaggtgatccacctgtctcagcctcccaaagtgctgggattacaggcatgagccactgtgcttggcctattttttttcttttatttataagtttctttcctgagttctgtcacctcatttctgagttctccaagttctttttgatgttgtgttttcatatatcattttctttctttttttttttttctgagatggagtctcattctgttgcccaggctggagtgcagtggcacgatctcagcttactgcaacctctgcctcctgagttcaagcgattctcctgtctcagcctcccaagtagctgggattacaggcgggcatcaccacactcagctaatttttgaatttttactagagatggggtttcaccatgttgaccaggctggtatcaaactcctggcctcaagtgatccacccacctcagcctcccaaagtgctgggattataaacgtgaaccactgcacctggccatatcattttcttaatacatttcagtttattttgaaaatagatgattatagtttttatctgttctctgttcacatcttattggtatgcttttattatttatagaaatataattctgctgcttattctcttatcataattttgtatgatatttggcttatatattttctgttattcatttttgtgtgaaattacttttcctatgcttttaaaaagagatgtggttcagggtagcattttgaacttgagagagcttcctcctctattgttttcatgtagtgttaaaaaatatggcagcttgctttctgagattctttagctctattagccttcctaattttttttttttttttttttttttttgagacagagtctcacgctttcgctaggctggagtgcagtagcaggatctcggctcattgcaacctccaccctcccgggttcaagtgattctcctgcctcagcctcctgagtagctggggctacaggcatgcaccaccacacccagataatttttgtatttttagtagaaacgggatttcaccatgttagccagatggtctccatctcttgacctcgtgatccgcctgccttggccccccaaagtgctgggattacaagcgtgagccaccgcgcctggccattagccttcctaatttttatctggatcttctcttttcttcatctttatttatgtctgtcctgatcaattttgattccatttctagcagtttttcctcagtatgagaccctgttctggagggaaaccctggcatgccagctttaggattcacataggccgagctgctctagtcctttaagacgttaaagcagttcccttgcatttagtcactattgggcaaaaaacctcccagtttcagctgttgttcgcaaattagtcaagctttctaatgaatgcctgctggctagttagaggaattcctatcctcagatctgttagctgtagcgttgcttccttctgcttctttctgcacagctgatgatgccacacaagtcttgcagctgccgatagtttgtcctcaccaatttggattttgcagttaatggggatatatcatcacctgatattagtctgtttaggctaatataacaaaatacagactgtgtggcttaaacaacagaaacttattttctcccagttctggaggctggagagtccaagatcaaagttcagcagtgttcaatttctggtgagggctcttttcctggcttgcacatggccaccttcttgctctgtcctcatacaatctttccttgatgcctgtaatggaagaaagagagatcttccccctcttataaggccaccagtcctattggattatggccccaccatcatgacctcattttttttttttttttttgggacggagtctcgctttgttgcccaggctggagtgcagtggcgcaaactcggctcactgcaagctccacctcccgggttcacgccattctcctgcctcagcctcccaggtagctgggactacaggcacccgccatcacgctcggctaaattttttttgtatttttcggtagagacggggtttcaccctgttagctaggatggtctcaatctcctgacctcatgatctgcccacctcggcctcccaaagtgctgggattacaggcataagccactgcgcctggccaacctcatttaatcttaataacctcctacaagcccaatctccaaatcacatttgaagttacactgggggttaagccttcaatatataaatttgtggtgggtagggggcaattcagtccatagcacctaggtttttttttttttctctttttttgagacagaggcttgctctgtcacccaggctggagtgtagtgatgcaatcctggctcactgcaacctccacctcccgggttcaatgattctcctgcctcagcgtcccgagtagctaggactacaggcatgtgccaccacacctgactaatttttgtattttttgtagaaacaaggtttcaccatgttggcaaggctgatctcaaactcctgacctcaagtgatccacctgcctcgggcccccaaagtgctgggatttcaggccatagcacctagttattttgtaaacactgtccatggattttttgttttgtcacccagttgctatgcttttaattgtggatccagaaagattaaaaagcttggccgggcggagtggcttatgcctgtaatcccagtactttgggaggctgaggcaggaggatcacttgagcccagaagtttgagaccaacccaggcaatgcagtgagattccatctctacaaaaaatttaaaaattagccaagcatggtggcatgtgcctgtagtcccagctgcttgggaggctgaggtgagaggattggttaaacctgagaggtcaaggctgcagtgggccatgattgtgccactgcactgcagcctgggcaacagagcaagaccctgttctcaagagaaaaaactatgtcacttaatatgctaagtgaaataagccagtcacaaaggacaaatactgtatgattccactaatgtgaggtacctagagtagttaaaatcatggagacagaaagtaaaatgattgtcgtccaggactggggttaagagggaatgaggaattattttttgttcagtggaacagagtttcagtttcggaagatggaaaaagttctggagatagacatggcgatggttgcacaacaatgtgaatgtgctaaatatcactgaattgtacacttagaatggctacaatggtcatttttggttatgtgtattttactctaataaaaaaggaaaaatagaaacacatacaacagcagtccccaaccttttcagcaccagggactagttttatggaagataatttttccacagaccagggtagggagatggtttcaggatgattcaagtgcctcacatttattgtgcacttgatttctgttattattacattgtaatataaaatgaagtaattatacaactcaccataatgtagagtcagtgggagccctgagctagttttcctgcaaatagatggtcccgtctgggggtgatgagagacaatgacagatcatcaggcattagattctcataaggagcaacctagatcccttgcatgtgcagttcacagtagggtttatgctcctgtaagaacctaatgctgccactgatctgacaggaggcagagctcaggcagtaatacgagtagtggggagcagctgtaaatacagatgacgcctcgctcacgccgctcacctcctgctgtgcagcctggttcctaaaaggcttcaaccccaaccccctggggttgaggacccctgacatagaagaccccaaaaaaggaccccatcaaaatttgaatgattccacccatcaatcactgtgctgggattccaccaacccttcacttgactggagaataaagaataaagactatgagtccactaaaatgattgtgaaatataaagataggtcttaccacatctgtaagtctttttcttctcctgtagcctgaaataaaaatagacaaagagactgggcgcggtggctcatgcctgtaatcctagcactttaggaggccaaggcgggcagatcacgaggtcaggagttgcagaccagcctgaccaacacggtgaaaccgttaagttaggaaagaacctaacttcttgattttgtattctctactgaaaatacaaaaattagccaggtgtggtggcacacacctgtaatcccagctactcaggaggctgaggcaggagaattgcttgaacctggaaggcggaggttgtagtgagctgagatcatgccgctgcactccagcctgggtgacagagcgagactccatctcaaaaaaaaaaaaaaaaaaaaaaggacaaaaaagaaatgtctacctttatggctgaagttttatttcacaaatattcaagtgcctattatatgcaagatattatgtcaggagctgaggaaaatgtgagaatgaagcatatacaagaagctcagaatcctgaaggggatatgtacatgcataagtttttccatgaataattttaatacaagagaaaatatgaagtatgccctgttctgtgcccctaaggtgctctgtgatcacagctcactgcagcctcaacctcctgggctcaaatgatccttccacctcggtctcccgagtagctgggactacaggcacatgtcatcacgcccggctaatttttttatttttagtagagatggggtttcacaatgttgcccagggtggttttgaattcctgagctcaggcaatctgcccacctcggcctcccaaagtgctaggattacaggcgtgagccactgtgcccggcctgatgcaaagttgtttgttgttgttgttgttattgtttttgtggtttgagacagggtctcactttgtcacccaggctggagtggagtgacatgatttcggcttactgcaacctcgacctcctatgttcaagctatcctcctccctcagccccacaaatggttgggactataggcgcacactaccatgcttggctagtatttgcattttttgtggagacggggtgtcaccatgttgcccaggctggtcttgaacttctgagctcaagtgatccacctgcctcggcttcccaaaatgctaggattacaggtgtgagccactgtaccaggcctcaaagttctttttcatctttagcatctcttgctgtgagcctcatgacctgcctagctgcccttctgatcttgtagaagagtctatgaagcagacttgaatcttacatgaacagatacttcaccaaaaaggatatctaaatgttcatatggaaatttactcatgctcactagtcataagaaatatgtaaattaaaacaaaaatactactatacacccatcagaatgactacaattaaaaagatcaataataccaagtgttggcaaggatgtgaagaaactagtactctcgtggttctggtaggagtgtaaattagtacagctacttgagacgtttggcaatatgcactgaagctgaatttacacttatcctatatcccagcaattctattcctaagtatgtagataacagaaatgcacacgtgctcacaaaagacatgtgcaagaatattcattgcagcaccattcctgatagcgctaaatgggaaataacacaaatattcaccaatagtagaatgaatgaatacattgtgttatattcaaactatggtgcactataaagtaatgagagttatggagccacccctattcacaataacctggaagaatcccattaatataatgttgaatgaaagaagctagacacaaaaggctatagatggggtcaggcaccatagctcacacctgtaatcctaacactttgggaggccgaggtgggtggatcgcttgaggtcaggagttggagaccagcctggccaacatggtgaaaccccatctctattaaaaatacaaaaaaattagccaggcatggtggcgggtgcctataatcccagctaatctggtggctgaggcaggagaatcactggaacccaggaggcggaggttgcagtgagccgagatcacgccactgcactccagcctgggcaacagagtgagactctgtctcaaaaaacaaacaaacaaaacaaagcaacaaaacacatggaaagccaaatataatcacaagcctgcctggagagctagaatcagagcaccacaatgggagagggggtcaagggagaataagagtgtgctttcaagaccctcacagtaaagatggatctgccgctagaattgcacaggatgtgactttggcccagggctccctctcccccagcagtgttcagatgagcatcaccagtgtcacctcagggactgtcctgggttcagcctctccagtggtaactcatcccctttcttgtctcttacttcagctatgctggaggacatttgttggttgtcttatccattttcccacatcactcccagagatccctggcctcttttcaacagaccatactttccctttggggatcaatccatgtagttcctgggatgtggcttcacataagccaagccattcagcacagtccatcctctgagcccagtgatgggttcagcatgttagccacaaatgctaggatgctgaaactatatttttcactgggcatgaatgagaaagcacatagccatgggggctttctgaggactgtaaggggagccagcctcagagtattctcacatggactaaggcagaagggagggctggaaagaacctaacttcttgatgattttggtaaactgctggatcaagtaacaacaacccctctgaacttttcagtttcttaagccaagaaattacttcttgtgtataaaccagtttgtagtggtctggcagacctagttgactatgcaatatctattcttatttatttatttatttatttatttttgagacaggattttgctctgtcacccaggctggagtgcagtggtgtaatcacagctcactgcagccttgacctcctgggctcaagtcatcctcccacctcagcctctcaagtagctggaaccacaggtgcacaccaccatgcccaactaattttttttttttaattttctgtagtaggcaaggcacagtggctcatgcctataatcccagcactttgggaggccaaggcagaaggatcacttgacccccaggagtttgagcccaccctgggcaacatatcaagaccccatctctgtaattaattaataaatatatgttttgcagtgatggcgtctcaatatgttgcccaggctggtctcaacctcctgggctcaagagatcctcctacatcagcctcccaaagtgctggaatgacagatgtgagtcaccacactgcctggcctattctctccttctcacagaacccccattttatttagagtttttagatatttatctccccacattcttccagagctaaggatgtcaatgtggccaataaggtacaagtgaaagtcactgggtggtatttttggaaaagcaattgattacctgattcaaaaagaagaagaagccagtctcaactggcacatgcattctgccttcccctacccacttcttcctacctgcaaaccagaagagttacagccaccttgtgatcatgaagccaaaagacacacactaaggatggctgaagaagataaaaagagccagattccttgagctgctgcgagagtcctggactgcctatcccagtctcctcgtaatgtaaaaaaagtaaacccctttcttgttaagcctttgctttgctgggtttgttaagtgcagccaagcgcattcctatcaaatagagaattaggtccactgaagtggggtgctgcacataatatcatctgaaacgtggacttcgttgagtggtagagacggagctttgggcagtgggggcacagatactgcagacgggaatgctgacaaccctgctatgctgtgggaaaacatttggtcgatctgctattttatgggagacaccccacataccagccaagtctgtagtgatagggtaaatggctagaataattcagaatgttggcacatgctggtgacttcattccactttcgatgaattcttgaaggagaccagtgaacttgaattatccaggctgaaggaaaaaaggaaggcagtgctacttcactaagtagtacttctgcctatggcctgcaaatctactttgaaggagcatttcataatttggagaattgcagggctgaaaaagacaattgctctgggccaggcatagtggctcatgcctgtattcctagcactttgggaggctaaggtgggcagatcgcttgagcccaggagtttgagaccaacctgggcaacatagcaagaccgcgtctctacaaaacatacaaaaacttagcctggtgtggtggcatgtgcctgtagtcttaactacttgggaggctgaggcaagaagatcacctgagcctaggaaggttgaggctgcagtgagccgtgatcacaccactgcactctagccggggcaacagagccaaacaagaccctgtttcaaaaaaaaaaaaaaaaaagataattgctcttttctccatataggagtagtggctgccaagcaatatggtagaagaaggtaagactggttggtatcttgggcctttcctaagcaccttcctctaagaattcattcagcagaggaagtggagtccgcaaagtggtttcttcccactagaatcttttgtttcaaattgtctcaagtcaataatcattaagttaaaggctaaagggacaggcaggacacaaaggccagtagccaacaaaggaaggttttcaggtctaaaagactatggccatataggagatttggctatggcgactcaaacgtaggatcaaccagaggcaaatacactgagagcctacaacaatttttaaggaatcatatcaccaaaaatgaaaatttaaaaacctggccagcaaaagcgtataattcttcaatcccaggttcctaaactcacacaacagaaagcatattctccccaaagttcacttcagatatggttaagaggataatgaacaagaagccgtctcaaaagaagatggaacttggaccacagagtacaatagagaagggaattcctcctagagaataggttggctgaacaaggaaattattccctgcctggaagggagtcctggccactcctgtctagcaggatctgacatttgttatagatccaatatttgcaatagctttgacatgcttaaaacagagagattctttcctttattcacattcttccttgtcctacattgaagttttattctgttccttctccattattgtatatgagacatgctgggggaagataacttgccttttagcttacagattactggactgtgaagattcacatcaagactaaatggagaaagctgtatatcagctgcagattctgggttttgagatggatgtaggctctgggtgagactttggcactgtctaccttagaaagggagtatattctgtgcatgtgaggatggatagccaagggtgggctatggcagtcactgctttccttctacccaatgactggtctccttttcttcttgactagtacaaccctgaatttgatggaggaagtaatgtgtatttgtccatttttcatgctgctgataaagacatacccgagactgggcaatttacaaatgaaagaggtttattggacttacaattctacgtggctggggacacctcaccaacatggcagaaggtgaaaggcacgtctcacgtggcagcagacaagagaagggaatgagagccaagcgaaacaggtttccccttatcaaaccatcagatctcgtgagacttactcactaccacaagaacagtatgggggaaccacccccatgattcaattatcccccactgggtccctcccacaacatgtgggaattttgggagtacaattcaagatgagatttgggtggggacacagccacaccatatcacaatgtgtccagctaaaacattacaattccctgcctcccttgcaactggggatgacctcgacctctctggccagtaaaacgctgccaaggttatctggaaaagcttcgtcttccagttgtaggtgctactccatctctcctttgcacccctttgccagaaccagatggaaactggaattttcagaaaagactgttgagcatcagaaatggttaatatgtgcctaaccttgtttaaacaaagtgagtgaagtaaggacaaatttataaatatgtgaaaagactactttttcctcttagtttctttaaaatgcatgcagccgtttaaaaataagtagaagctttctttttttatgctctggaacattttaagtagctgtgaaggtttggtaaattctcctgtgaatccatctgggccttgtgacttgttaaagagcaattcgttaatttgtttaaatgttctgtgtttaccagggtcaatttgggtaagtaatatttttgtagaaaattatttatttaatctaggttttcaaaggcatttgtctaggcttgagaaaagtagtatcttaggatttgtaaattgtcttctgtttcagtggttgtcctctttgtcatttcttatcttgcacactgatgcctttttcctttccttttttaaaaaaaaaattatgaatacataatagtcataaatatttatggaacgcatgtgatattttcataaaagcatacaatatgtaatgttcaaatctgggtaactgggatatccttcacctcaaataccatctctttgtgttgggaacatatccttttgttcttgattaggttagctagcagttcgtctacttgactgatttgttttctctaagaaacagcagttcagttaatttatgttttttatattttttcttttttttgaaacaatccattttttattcaaatagaataatatttaacaatcaaggtcatatgacttaaaatcttctgagctgggtttaggattcagatagatagtttattgtcagttgacattaaaacaatgttcttggccaggcacagtggctcatgcctgtaattccagcactttgggaggctgaggcaggtcaatcacctgatgtcaggagttcgagaccagcctggccatcatagcgaaaccccgtctctactaaaaatgcaaaaattagctgggcatggtggcgggcatctgtaatcccagctacttaggaggctgaggcaagagactcgcttgaacccggaaggcagaggttgcagtgagctgagattgcaccactgcactccagcctgcacaagagcaaaactccgtctcgaaaaaaaaaaaaaagaaaaaaagaaaaaaaattatttgcatcaaagttatacaaacaggttttttttagttttaaaatcaaatttatggccagacacagtggctcacacctgtaatcctggcactttgggaggtcaaggtaggtggatcacctgaggtcaggagttcgagaccaggctggcaacatggtgaaacctcatctctattaaaaatacaaaaattagctaggcgtagtggcacacacctgtagtcccagctcctgaggaggctgaggcacaagaatcacacttaagcccaggcagaggaggttgcagtaagctgagatcatgatactgcactccagcctgggtgacagagtaagaccctttctcaaaaaaaaaaaaaaaaaaaaaactttatttaggcctaatttccatgcaataaaattattttaactgtacaatatgatgacttttgacatatatacacaatagtataagtactaccacaatcaagattcaattataactcatgcctctttgtcagcacttttcatccccaatttcagcagctggtaactttaaggttttgccttttccagaatgtcacataaatggaatcatactgtgtccggaattggtgggttcttggtctcactgacttcaagaatgacgccatgggccctcgcggtgagtgttacagctcttaaggtggcgcgtctggagtttgttccttctgatgttcggatgtgttcggagtttcttccttctggtgggttcgtggtctcgctggctcaggagtgaagctgcagactttcgcggtgagtgttacagctcttaaggcagcacgtctggagttgtttgttcctcccggtgggctcatggtctcgctggcttcaagagtgaagctgcagacctttgctgtgagtgttacagtttataaaagcagcgtggacccaaagagtgagcagtagcaagatttatcgcaaagagcgaaagaacaaagcttccacagtgtggaaggggacccgagcgggttgccactgctagctcgggcagcctgcttttattctcttatctggccccacccacatcctgctgattggtagagccaagtggtctgttttgacagggcgctgattggtgcatttacaatccctgagctagacacaaaggttctccatggccccatcagattagttagacacagagtatcgacacaaaggttctccaaggccccaccagagcagctagatacagagtgtcgattggtgcactcacaaaccctaagctagacataaatgttctccaaggccccaccagagtagctagatacagagtgtcaactggtgcactcacaaaccctgagctagacacagggtgctgattggtgtgtttacaaaccttgaggtagatacagagtgccgattggtgtatttacaatccctgagctagacataaaggttctccaaggccccaccagagtagccagatacagagtgtcgattggtgcattcacaaaccctgagctagacacagggtgctgattggagtgtttacaaaccttgagctagatacagagtgccgattggtgtgtttacaatcactgagctagacataaaggttctccaaggccccaccagagcagttagatagagtgtggattggtgcactcacaaaccctgagctagacacagggtgctgataggtgtgtttacaaaccttgagctagatacagagtgccgattggtgtatttacaatccctgagctagacataaaagtcctccaaggccccaccagactcaggagctcagctggcttcacccagtgaatcccacacctgcgctgcaggtggagctgcctgccagtcccagtgccatacgcccgcactcctcagcccttgggtggtggatgggactgggcgccgtggagcagggggcggcgctcatcagggaggctcaggctgcacaggaacccacggagtgggtgggaggctcaggcatggggggctgcaggtcccaagccctgcccggcgggaaggcagctaagcctccgtgagaaattgagcgcagcgccggtgggctggcactgctgggggacccagtacaccctccgcagctgctggcccgggtgctaagtccctcattgcccggggccagcagggctggccgactgctccgagtgcggggccgccaagcccacgcccacccggaactccagctggcccgcaagcgcctcacgcagccccggttcccgctcgcgcctctccctccacacctccctgcaagctgagggagtgggctccagccttggccagcccagaaaggggctcccacagtgcagtggtgggctgaagggctcctcaagtgccgccaaactgggagcccaggcagaggaggtgccgagagcaagcgagggctctgaggactgccagcacgctgtcacctctcaatacagtatgtagccctttgagtctgttttctctcactcagcataacgattatgatatttgtccatgttgatgtgggcatcaatttataaaaacaattttaatgcaaacattcaatagggcttctttcccattttcccaagatttcatctctctctctgctatggacacagatggcttcactccatcctgtattcttcggaccatgataaaattccagactctcggtagtttttgcgttccaagaagtagagcctagagtggtggcctataattacagttactcaggaggctgaggcaggaggatcctttgagtccagcagtttgaggccagcctggacaccacagcaagaccaccaataaataaataaataaatggaacatgtttccctgtcatggtcattttcatccattcctctggtagaagcatcagattccttcaagcaagggtttatgttggggtctctcaatctctgcgttagcacaggcatccagtcttcttatggagggggacggggaggtggaatggagaaacgagagaggcgaatcagagacctcactgccttctgcccattggtgctgcccgtggacggctggcacaggggagcaccccatgcttctgccttcaatggtgcggggaggggcagaggacaaggaaacgcaggaaactaggagtggggcaggcagacatgcttcaaaggctggagccaaggagggtgcagggagagttgggagttcctggaccaggcaggggtcacctcctcaccacagccagaatagctctaccagtgcccatgccatctccagctccaaacaccgttttttctgtttcctaattcattaatttctttctttttttttggagatggagtctcactctgttgcccagcctgtagtacagtggaacaatctcagctcactgcaacctctgcctcccaggttcaagtgattctcctgcctcagcctcctgagtagctgggattacaggtacgcgccaccatgtgcctggctaatttttgtatttttagtagagacagggtttcgccatgttgcccaggctggtctcgaactcctaagctaaaagtgatcacctgcctcagcctctcaaagtgctgggattacaggcgtgagctactgcccccggccctcacttattaatttctatttatgtctatattcattcctaccttctactttctcttggtttactttgcttttttcctttttagttgatgtttacttttactgatatgtgtatttgatgtaatacatttcctaacaatgcttttgcagtacctcataaattcagataagctgtgttttcattattgttattttataaaattctgcaattttggtttgtattaccctgttgactcaagagttgctcgatcgagttctttaaaatttctaggctgggcatggtggctcacacctgtaatcccagcactttgggaggccaaggggggcagatcacttgaggtcaggaattcaagaccagcctggccaacatggtgaaacctcgtctctactaaaaatacaaaaattagctggacgtggtggcaggcacctgtaatcccagctacttgggaggctgaagcacgagaattgcttgaactcgggaggcagaggttgcagtgagccaagatcgcgccactgcactccatccagcctgagagacagaacgagactccatctcggaaaaaaaaaaaaaaattctagttcgaaaagtctttttacttttaattttgttaatttgtcattgtattgcattttgtgatcagagaatgttgtttctgctattgctagttcacgaatgtttctttcaattactcagtagacagttctctgatccaccaattctcaggatacggtcctctccttctggggctaattctagccaatgctatctgtgtgctgccacctccaggacctggctgcactctgctgtcttccacacaaccctcctgacttcccgttcagaagtgagctctagacctagctctgctggtttcagatatttatctccccatttatatgtaaattgaagtttgaggtatgccctgtctcctagtgatgctgtgagggatggggtgatttatttaagttgctttcattgtcaatctgtatggtttgtgaaggactgtgaagggattttaggcatctgccattattccacgagaatcaggaagctttgtgctttctttttattgtatctttgctgctttttcttcattcctgcctcccattggcttaatcaaattttcttttttgcccttcccttcccatccacattgaagtcatagttccatttcggttctctcagtggtatcccttaaaagcacagcatccacatttagcttagcaaactctaaagttaatcagtatcaccacctccctcccaaacagtatgaagatcttagaatgctccaattcccagccaggcatggtggcccatgcctgtaatcccagctcattgggaggctgagacaggaggacctcttgaggccaggaggaccccttgagaccagcctgggcaacatagcaagaccttgtctctacaaaaaataaaaatatttagctgggtgtggtggcacgcatctgtaatgtcagctactcgggaggctgaggtgagaggatggcttgagcccaggaattcaaggctgcagtgagctatgatagtgtcactacacctcagcctggaatcctgtctcttactaaaaaaaaaaaaaaaattgctttttttttttgagatggagtcttgctctgtcgcccaggctggagtgcagtggcatgatctcggctcactacaacctctgcctcccgggttcaagcgattctcctgcttcagcctcccaagtagctgggactacaggcatgtgccaccatgcctggctaattttttttttttttttttttagagacagggtttcaccatgttggccaggctggtctccaactcctgacctcaggtgatccacccacctcagcctctaaaagtgctgggattacaggcgtgagccactgcacctggccaaaaagaatgctttgactctcatcatctccctctcaccgtattattaattcaacaaacatttgtgagtgcctaccacatgccaagttgatacagtaatgaagaaaagaagaggaaagggagggaatgggagagaatctctgtgctaatggattacattttggtgggagagataaacaagatgcaaaattaaaatctgtagtgtgggccagcagtggtggctcacatttgtaatccaacactttgggagggcaaggcgggtggatcatttgaggtaagaagttcaagaccagcctggtcaacatggtgaaaccctgtctctactaaaaatacaaaaattagctgggcgtgttggtacatgcctgtaatcccagctatccaggaggctgtggcaggaggatcacttgaacctgggaggcggaggttgcagtgagccaagatcacgccattgcactctagcctgggtgacagagcaaggctttgtctcaaaaaaaaaaaattttttttagtaggttgcacagtgaaaagtactaaggtgcaaaacactaaagcagggtaggagaatatgaagtgatgtggccacgagaagcctcactagaaaagtaaatttttgttgtgttttggagacggggtctcactctgtcacccagactggaatgtagtggtgctatcacagctcacacagcctcaacttccccacctcagcttcccaattagctggaattacaggcacatgccccacactgggctaatttttctattttttagagatgaagatttccccatgttgcccagttgcccaggctggcctcaaactccttgggctcaaatgatttgcccacctcagcctcactgggattactggcatgaaccactgtgcctggcctgaatgttttcttttcttcgagaccgagtcttactgttgcccaggttagagtgcaatggcacagtctcagctcactgcaacctccgcctcctgggttcagttgactttcctgcctcagccccccggagaagctgggattacaggtgcccgccaccacacccagctaattttgtatttttagtagagatgggtttcaccatgttggccaggccagcctcaaactcctgacctcaggtgatccacccgcatcggcttctcaaagtgctgggattacaggcatgagccactgcgcccagctgaattttgtttgtttgtttgtttgtttattttgagatggagtctcgctctgttacccaggatggagtgtagtgacgcgatcttggctcactccaacctctgcttcccaggtttaagggattctcatgcctcagcctcctgagtagctggatctacaggcacatgccaccacgcccagctaggtttttttggtagagacggggtttcaccctgttggccaggctggtctcaaactcctgccctcaagtgatccgcctaccttggcctcccaaagtgctgggattataggtgtgagccaccgcaccaggcttattttttatttttattttttttagaaacagggtcttactctgtcatctaggctggagtgtagtggcatgatcatagctcactgcaacctcaaactcctgagctcaaggtatcctctgtctcagcctcccaagtagctgagactacaggaatgtgccaccaagctggctatttattttattttctgtagaaccaaaaaaggtctcactatgttccctaggctggtctcgaactcgtggcctcaagcaatcctcccacctcagcctcccaagcactgggattacaggtatgctccaccttgcctggctgaaaggcaacttttgaattaagacatgaaggaaatgagagctagccatgtagatatcttggagaagaacattctaggcaaagagaatagcaagtaccaaagacttaaagcactttttgacatgtttaaggaacagcaaggagccctatgaggctacagtgaagagaaggaggagaagagtgataagatttttttttttttttttttttgagccagagtctcgctctgtcgccaggctggagtgcagtagcgagatctcagctcactgcaacctccgcctcacgggttcaagtggttcttgtgcctcagcctcttgagtagctgggactacgggcacataccaccatgcccagctagtttttgtatttttggtagagatgggattttgccatgttggccaggctggtctcgaattcctgacctcaagtgatccgcccgcctcagcctcccaaattcctggaattacaggtgtgtgccaccatgccagctaatttttgtatttttattagaggcagggttttgccatgttggacaggctgatctcaaactcctgacctcaagtgatctgcccaccttggcctcccaaaatgctgggattataggcgtgaaccaccacacccagccagaagagtgataggattttgaggtcacaaacctaatatggagaccaaagtagaatcgtgtggtccatattaaggattttggtctttattatgagatagagacccactgaagagtgctaagggacatggtttggcatatgctgtatcaggatcattctggttgctgtgtcaagaacaaaatgaccgggcacagtggttcacgcctgtaatcccagcactttgggaggccgaggtgggcggatcacctgaggtcgggagttcgagactagcctgaccaacatggagaaaccccatctctagtaaaaatacaaaaattagccgggcatgggtggtgcatgcctgtaatcccagctacttgggaggctgaggcaggaggatcgcttgaacctgagaggcggaggttgcagtgagccaagatcgtgccattgcactccagcctgggcaacaagagtgagactccatctcagaaaaaaaaaaaaaaaagaacaatgctggagagaaagccagctaggaagttacactaatccatgtgagagatgatggtgacctgcccagcattgggaagtaggaaggcatgggaagtgcttgaatgctgagtgtgttttgcaggcagagctgacagaattttctgactgaccaatggggtgtgagaagtgagaggccaaggaggacacccagtattttgagcaactggaagaacagagttgccattaacttcttgttgactagaatttaatcacatggcataggaggcagaattctaagaattcttcctatgatccttgccttggcataatccctttcttcctttttgaggataggtagaaatcaacatgatctcactcctgagattatgttctgttataaagcaaaaggattatccaggtgggtgtaatctaatcacaagcccttgaaaatcagtttttctggctgctgggcagaaggggaagacagagagtgtattaatcagggttctccagagaggcagaaccaatagaaaggatggatgaatagatagatagattagatagatagatagatagatagatagatagatagataaagggggtattttttaaaaaagagatggagtctcactaggatgcccaggctgttcttgaactcctgagctcaactgattctcctgtgtccacctcccaaagtgctgagattacaggcatgagccaccacacccagccagaaagtattttttaattaaggtgtgtactatgttttttttaggcataatgaatgctattgcacatgtaatagattacagtatagtgtaaacataacttttacatgcactgggaaacaaaaaaatgtgagccagtgcacctggctgagaggggatttattagaggaattggctcatgtgattatggtaggcaaaaagtcccacaatgagccatatgcaagctggagaccctgggatgctggtagcatggctcaatccaagtctgaaggcctcagaaccagggaggccaagggtgtaactctcaggccgagcccagaggcctgagaactcagggaggggagccactgatgtaagtcctggaatccaaaggccgagaagtctggagttattgtccaaggacgggagaggaagagtgtatcccagctccagcaggtagatcagcacattcatttttgccctggtttttcttctctccaagcccccagcagattgaatggtgcccacccacattgcaggcagatctttcccacctagtccactgagactcacacactaatctcctctggaaacaccttcacagagacactcaaaagaatgctttagtaggtttctacgttttccttaatccagttaagttgacacctaaaattaaccatcagagagagattccaagcataagaaaggcactgcaccaaggctgccttgaagatgtaggggactggccaggtgcagtggctcacacctgtaatctcaacactttggaaggtcaaggagggcagatcacttgaggtcaggagttcgagaccatcctggccaacatggtgaaaccccatctctactaaaaatacaaaaattagccaggcgtggtggtgcacacctgtaatcccagctacttgggaggctgagacaggagaatctcttgaacccaggaggcagaggttgcagtgagccaagatagcatcactgcactccagcctgggtggcagagcaagactctgtctcaaaaaaagaaaaaaaaaagaaagaaaagaaaaggtgtagggaccacaggaagtatcccggcagcctctgggaacacagagcagcccccgctgctcacagccaggtaggaatcaggatctcagatctacagccacaaggaactggattctgccaacctgaatgagtctagaagtagattcttttccagagcccagcccatggacaccttggtatcagccttttgggaccctgagcagagaacccagccaagcccagacttctgacctacagaactctgagataataagtgggtgttgttttaagctgctaagtctgtggtcatttgtcacactgcaatagaaaacaaacacatatggccactcctaactgagagaggttggtaaatggtgtctcaagctggatattcatgtgcattgctaaacttggaggaggagttctatgatgaaagaaagagaagcatgaatattagggagatgataagacattcttccacacactgtaaacctgccctgtccaatacagcacacactaaccacatgtgggtatcttttttttctttttttttgagatagagtctcaccctgtcgcccaggctggagtgcaagggtgtgatcttggctcactgcaacctccacctcccaggttcaagcaattctcccacctcagcctccagagtatttgggattacaggcacctgccatcatgcctggataatttttgtacttttgtagagacagggtctcgctctgttacttaggccggagtgcagtggtacaatcttggctcactgcaaccccaacctcctgggctcaagtgatcctcccatttcagcttcctgagtagctaggactacagatgcacaccaccacgcctggctaatttttgtagagacagcctcttgctatgtttcttagacttgtctcgaattcctgggctcaaatgatccaccagcctcagcctcccaaagtgctgggattgcaggcatgagccactgcgcctggtctaaaaacacccttttcattcagcactataggttttaaaaggcagtgttcccataagaaataatggcaaagaaaggaactcccagtcacattcagcaaacctgttttcccagctacattcatgcactggttgatgcaggtaagtgtacaggggaggttgatggagagataggagggtcctggaaacaaaggaagactgtgacattagatgactgcaatcgtggagactcagatggtgcttgtactaccacggttcatcttttgagtatgggcatgtcatagtctggaccagaatctaaattctagtagcaaagcaggtagggtggttattgcataaggaggtatcacaacctgtcatttggggagggtgagggaaggactggctgtcacagcttagcctcaccaaggacgtatgtgtagtgccctctggtggcctgcaatggcacgcaagccagccaaatcagaatcccccatctctcaccccccacacccccaccctcctcccagccacccccatctcaggcaagacaaagccagagtcctaactggtctccctgcttccactcctgtccaccagaatgatttgttaagatcatcagatcatgtcactcctctgctcaaaattcagggtaatttcccttctccctgagttatttagccacagtactcacagtggtctccatggctgtactcggtatggcgcctcccagcaacctttctgtctccacttcctgcccctcttccggctgctcaccctgctgtagccacaccgggctgcctgctcttcctctgccagcataacccaccaagcacactcccacctctgcatttgctgtctcccccacctggaatgcacagatgactccttcatgtccttcatatatgtgtcaaatatcaccacatcatcttttgcactaaattaaaaaacagccctcctcccagcacactatatcccctttagctggattcattttttgccatagtatttaataccatctgacgtattacatatgtatttacatatatatatgtgtgtgtgtatttatatttattacctatctcctactactaaactttctgcttttttgaaaaagcagaaactttgttttgttcccagttgaatccccaggatctagaacagtgtctagcctatagtaggtgctcaaatatatatgttggggaaataaatgaatcaagatctgaataatgagcaggcattgtatgaccttcattgtttctttcttgaatattaagacactatcacaaaaaggacaactctacaaatatatataaaattcataaaattcctattatatcccagcagctggggcaaagaaaaaaaaagaaaaaaattccagtataatcccaacagttttttttttcccaaccaccccagatacatcagacagatggtatacatctcttcgtgactcaatctgctgaacgatgcaactgtcacagtatccaacaggtttctttttaattggattaaattatctgatgatttatttggaaagaataaagtacttgtaaatagccaataaatgtagaaagaagtacagtaagggtgcacttggcttactagatctcagaagacactataaagataccacaatagcatcaatataatattggcctgggcatagacaaataaaccagtggaatagaaaagagaatccaggaatagatatctgtttttaagaacataaaatgtgaacagtgcaattttaattcagtgggatatggatggattatataataaatgatgatatctgtcaggaaaataattggacctccattttatatcatacaaaaacaagttccaagtagattaaatactaaaacatagcaggtacttttatttattcatttatttatatttatatttatatttttgaggcagggtcttactctgtcacctggcctggagtacagtggcacaatcacgcttcactgcagcctcaacctccctggctcaagcgatcttcctacctcaggcttccaagtagttgggacaggtatgtgccaccacgcctggctaattttttgtattttctatagagacagggttttgctatgttgtcccaggctggtctcgaactcctgggctcaagtgatccacccacctcaatcttccaaagtgctgggactacaggtgtgacccaccatgcatggccagcaggtccttttagaaccccaactaagttcagaatatagttaatttggtcctcaggcctatatgaagaaatattactgatttcatcaaagtcacaatttatagtgtacattcttaatcttttggttgtaaaaagtcccatttcacaactgggctgagagtatgaaagcccagattgaatgaagagggagtccgtggtgtggagagggggactggtggtggtaagaatggggtgctggagcccaagcatgaggagagtttccataggaaagtaggggtggtgactctagctgcccagctgagaatatcagagtccaagccaggtaaggaaatggttcatggaggggcaggacaagagattgatcaaataagtaaatattttgagaataatgggagtgaagcttctatttaaaatgaaagaataaatatagtaatgaggaaactagaataaaccctgtggcattagactggaattgaaggtattgggggtggattcatggttttctttttttcttttctttctttttttttttttttttttttttttggagacagagtctggctgtcacccaggctggagtatagcggtgcaatctcagctcactgcaatctccgcctcctggaatcaagcaattctcctacctcagcctcctgaatagctgggaatacaggcacgtgccaccacacccggctaacttctgtatttttagtagagacaggatttcaccatgttggccaggctggtctcgaactcctgacctcaagtgatctgcccaccttggcctcccaaagtgctgggattacaggcgtgagccaccgcacccagcccatggttttcatttgatctaaatatcttcaccatgttgaatctagacaagaggatacatcagacaaacgcagatcaagggacattctataaaataactggcctgttatcttcaaaagtggtcatgaaagtaaaggaaagactgagggactgttccagactaaagaagactaaagagggatgaaaaccaaaagcagtgttttgatcttgggttgtattcttttgcaaggacattattgggacaattggtgaaacttgaatggagtacattgatgcgactgtagtaaaacatcattgtcagtgtcctagtttggatggttgtattatacttaggtaaggaaatgttgctgtttgtgagaaatacacacagtaaagtattctcgtgggcaacagggcatgttgttggcaacatactcttaaatggctcaaggcaaaaaaaaatttttttgcccttgtcttgcaatttttctgtaagtttaacattatttcaaaataaaaagaaaaggaaaaattattgttttaactactaacccaatgaggaaataaacataaaacaaagctgcacatgcacgattagaacttctaggctaggcagggtggttcacacctgtaatcccagcattttgtgaggccaaagcaggcagatcactgagcccaggagtttgagaccagcctgcatgcgaaaccccatctctacaaaaaatacaaaaattagctgggtgtggtggtacatgcctgtagttgcagctactcaggaggcttaggtgagaggatcacttgagcctgggaggtggaggttgcagtgagccgagatcgagccactgcactccagcatgggcaacaacttctagttacatgtacctgtatacatacttcaatacaaaataattgtcaactcccagaaagaatgatttgatgtatttctagaaagaaaggagcactgggtgctgagcgtggtggctcatccctgtaatcccaacacttcgggaggctgaggtgggcagatcgcctgaggtcaggagttcgagagcagcctggccaacatggtgaaaccccatctctactaaaaatacaaaaattagcagggcatggtggcgcgcgcctgtaatcccagctactctggaggctgaggcaggagaatcgcttgaacccgggaggcagaggttgcagtgagctgagattgcaccattgcactccagcctgggcgacaagaatgagactgtgtctcaaaataataaataaataaagtaaaataaaattaagcagaacatttgttactgcccattagtctatatatatatattctagtttaaggtcacttttctttcaacacaaagtggatcaccaaagtggatctcccaaagttctgctcctgggagaattccccttcatcattgtctttcaagactgtctcagagtaatgctgtccattgcccacttgtttcctgcatctggatactaagctgacctgctgtaaaaaagcacaggcttttttctcctccttcagctccttcatataagactcctcataaagtcaaagacatgaattgagggagagtaattggttctacagtggtagggaccatgggagtctgggctacctgctcatgcagctttcccaggtcctctggtcctacttgtgactgatactagacataccgcatcaatggttttgttttgttttggtttggtttttggttttttgtttgtttgtttgtttgtttttgagacagagtctcgctctctgtctttccatgctggagtgcagtggtaccctcttggctcactgcaacctttacctgatcctcccgcctcagcatcccaagtagctgggattacaagcatgcaccaccacatccaggtactttttgtatttttagtagaggaagggtttcaccatgttggccagtctggtctcaaactcctgacctcaagtgatccgcccactcagcctcccaaagtgctgggattacagtcatgagccaccacacctggcccatgtcacattcactattatgatggagtgttgctgtgcactgctgaccttatgaattggctgttctgagaggactcaaaccataacgggaaattccagctgtgcagtcatttggtcatgatccaccattttgtttcttctaagggccagtagcataccagagttgcttttctgtggtgttttgtttttgggacagagtctcgctctgtcacacagcctacagtgcagtggcgcgatcttggctcactgcaacttccgcctcccgggttcaagtgattctcctgcctcagtctcctgagtagcttggagcacaggtgcacaccaccacaccctgctaatttttatatttttaatatagacggggtttcaccatgttggccaggctggtctcgaactcctgacctcaagtgatccacccacctcggcctcccaaagtgctgggattacaggcatgagccaccacacctggcccggagttgtttttcaacagcatgtttaaatcttcactgcagatggtagggtcttgctccagagccccagtgccacttccaaagcttgacacaaattatacatagcatcttctcccacttctgataatctgcagcaccataggatatgctgaattgtattgtcctaggagtaggactgtttacactgtagcctgtatctactgcaaagctctgtcatgctctgggcccgctttaggccttgctcaaagcttccagtctttcgtgacacctggtatatagactacagcagcatccttaggtgtagaatatgctgactctagaatctgaagagatccaccaggtgttgcgcttccttttttgtgggagaaggcataaaatgcaataatttgtcttttactttgaagaggatatcccaacatgcccctgacaactgtactcctaaaaattttagggatgttggggcttggcgcagtggctcatgcctattatctcatcactttgggaggccgaggtgagcagatcacctgaggtcaggagtttgagaccagcctggccaacacagcaaaacccccatctctactaaaaatattaaaattagctgggcatggtgatgggtgcctgtaatgccagctactcgggaggctgaggcaggagctgggaggcagaggttgcagtgagcaagatcgtgccactgcactccagcctgggtgacagagcgagactccatctcaaaaaaataaaaaaataaaaattttgctgggcgcggtggttcacacctgtaatcccagcactttgggaggctgaggcgggcggatcacgaggtcaggagatcgagaccatcctggctaacacagtgaaaccccgtctctactaaaaatacaaaaaaatagccgggcgtgctggcgggtgcctgtagtccaagctactcgggatgctgaggcaggagaatggcgtgaacccgggagtgggagcttgcactgagccgagatcacaccagtacactccagcctgggcaacagagtgagactctgtctcaaaaaaaaaaaaaatttatagatgtagaaggtccctgaatcttcacagagtgccctctgaagtgcctgtcttatttaccaaggccttcagtgtattatccatctcttgttcatctggctcattaacatattgtcatcaatgcaatggatcagcatgaaactctaaagtatgtccagatagttcagaggtgtacaatcttttggcttccctgggccacattggaagaagaattgtcttgggccacacataaaatacactaacacgaacgatagctgatgagccaaaaaataaatcacaaaaaaggctagacgcagtggctcacgcctgtaatcccagcactttgggaggccaaagtgagcagatcacttgaggtcaggagtttgagactggcctggccaacattgcaaaaccccgtctctactaaaaatacagaaattagctgggcatggtgacgggcgcctgtaatcccagctactcgggaggctgaggcaggagaatcgcttgaagctgggaggcggaagttgcagtaagctgagattacactactgcactccagcctgggtgacagagcaagactctgtctcaaaaaaaaaaaaaaattataatgttttaagaaagtttcaaagctctcctgtgccatgtacagcctgcaagccgtgggttggacaaggttgagatagtccaaatctcttcagactgtattttacatagagtggaaggcatagccctgggaggaaaacctcacatgtatattgttgcccattccatgtaaatgcaaacttttttctgactctttttctttttctgattaggataaaaaagaacacatttgccaaatcagtggttgtataatatgttcccgaggccaaagtaatctgctgtagcaaagatactacatcttacataatggctgtaatcggggctatagtacttggttgaactcatggcagtctacagtcaccttccaggatcatctggtttctataaggtcaagagtggtgaattaaacagatacatgatagaaaccaccatccctgtatcctttatatcctaaggatggaactaatttctgctgtacctactctcaacacttttctttgttgtcccccaggagtaaaccaatcctggttatgaactcagagactgggaaatgaccactgagtggctccaaggacccaatggctgtactgtaagccaggcccaagacaggatttcacttacaacctggccccatgtgcttcctgcactctaacaaggagaggttatgatggtgcttcaggcctcgagcatcattgtcatcacagaccctacatccaacagaccctgatatgtctaggtatttttctttcccaggtgcacagttacccaaataaatggccattggtctttttgagaaagaactgaggggatcattatcacatattcttgttatagtattgagggtccttcctcctagggacccagccacctctttaatcatgggattccaagtctcaagctggctctagtctgaacactaggaaagggattgtgaatttttcttgggctatggccttcagtcttctagtcatctttccttaatttcttctgctagtacaagctgagtagtacccttaacaattgcccatctaatttgcccctagggacattttgctttattagtcatctccataactctctgttggccaggtgttcctggctgccactcaaacctcaccagccatgatgataattgccattgcctagcttccggaagttaagcactgccatctggacttttgtttgtttgtttgtttcagtgtcccattatcctcattgctatcagtaagtcaagttctgtactagtctcttctattatcagtcctagcctacagaggagagcgagtacttatctttttagtactttttattctggtgagcctctcaccagcaaattctttctttttttttttgagtcagagtcttgctctgtcactcaggctggagtgcagtggcacgatcttggctcactgcaacctccgcctcccaggttcaaacaattctcgaacctcagcctctcgagtagctgggattacaggcacctgccaccacacccagctaattttgtgtgtgtgtgtgtgtgtgtatatatatgtgtgtgtgtgtgtgtatatatatatatatatatatatttttttttttttttttttttgagacagagtctcgctgttgcccaggctgtagtgcaatggcaaaattttggctcactgcaacctccgcctcccgggttcaagtgattctcctgcctcaacctctcaagtagctgagattacaggcatgcaccaccacacccagctaatttttgtatttttagtagagatggggtttcaccatgttggtcaggctaatctcgaactcctgacctcaggtgtttcacccgccttggcctcccaaagtgctgggattacaggcatgagccaccaaacccagccctttttttttttttttttttttgagatagagtctcgctctgtcacccaggctggagtgcagtggcacaatctcggctcactacaacctccgctgcctgggttcaagcgattctgcctcagtcttccaagtagctggaattacaggtatacaccaccatgcctggctaatttttgtatttttcttttttttttttttttttttttgagaaggagtctcgctctgtctcccaggctggagtgcagtggcacaatcttggctcactgcaagctccacctcctgggttcacgccattctcctgcctcagcctcccaagtagctgggactacaggtgcccgctaccacgcccagctaattttttgtattttttttagtagagacggggtttcaccgtgttagccaggatggtctcgatctcctgacctcttgatccgcccgcctcggcctcccaaagtgctgggattatagacgtgagacactgcgcccggccaatttttctattttttagtagagacggggtttcaccatgttggccaggctggtctcgaactcctgacctcaagtgatccacccactttggcctcccaaagtgctgggattataggcgtgagccaccacgcccggcctaatttttatatttttttggagagacagggtttcaccatgttggccaggctggtctcaaactcctgacctcaagtgatccacccacctcggacttccaaagtgctaggattacaggtgtgagccaccatgccgggcagcaaattcttcacggccttgataagtagtgtgttgttatggtttgaatgtggcccctaaaaatctgtgtgttagaaacttaattgttctcccctcataaatggattaatgtcagttctgccctcatgaatgaatatatggagtaatgagagttctgccctcttgaatggagtaatgtcattatcatgggagtaggttcgttatcacgggaatggctttgcaataaaaacaagctttgtttttttgttataaaagcaagctctatcatgggaatggctttgttataaaagcaagcaagagtaaccagaatctttctggttgccctctcaccatgtgatgttctctgctatgttatgacacagcaagaaggatctcaccagatcctgacttcaggctcttgggcttcccagcctccagaaccatgaactcagtaaacttcttataaactacccagtctgtgctatgcagtgagagcaacagaaaacagatgaaaacgtgttctctgggccttctcatgaggcataattagctaggagatcttctggttacctatagtctatccattctggcacacctatttccctgagtcttttcattctaccatcactatctgccatagcaattccggcatgtaagctttctttggcataggtcatcactttttccatgcttctaggatccatcctggtagtaagattgtaccatctcctattgtccttgccaggatgttaaatcttgtattttgaaagagagattcctgccgggcgcagtggctcacacctgaaatcccggcactttgggaggccgaggcaggcggatcacaaggtcaggagttcgagaccagcctggccaacatggtgaaatcccgtctctactaaaaatacaaaaattatctgggcatggtggcacgtgcctgtaatcccagctactcgagaggctgaggcaggaaagttgtttgaacccgggaggcagaggttgcagtgaactgagattgcgccattgcactccagcctgacagggtgagactccatctcaaaaagaaagaaaagaaacgaaaagaaacaaagagggattcccaagtcaataaactcttccctatccaattttatattccttctccttcatcaagcactctcagaatccagttccacatgtatctccctggctcctgccaatacatgctggctaggtcttgctatttctgtggcatatagtccctttccacccctatcatacccagcacctctccagctgggttatgctgtagctaacctagtataggctaggaggcaatgtgggggcagattctgagggggagctgttgctttgtggagaaaggcactgcattgtccctcagcagggagagagtggtagttcttactagggaggagtgggccaattctgtaggctcaggagattcagaggaatttgtggagtcaaaatattcaggagaggccaaggcgagtggatcacttatggtcaggagttcgagaccaacctggccaacatggtgaaaccccgtctccactaaaaatacaaaaaaaactagctgggcatggtggtgcatgactgtagtcccagctacttgggaggctgtggcaggagagtcgcttgaatcctggaggcagaggctgcagtgagtcaacatcacaccactgcactccagcctgggagacagagcgagactccgtctcaaaaaaaaaatctttaggagcatccactctgatatctccattccacgtgtcagggtcccaagcttttccaaccaggactttgactttagcataagagatgtgccttatttggacatttaactgtctttgaagtcagttgctcagattattattattattattattttagatggagtcttgcactgtcccccaggccggagtgcagtggcacgatctccattcactgcaacctctgcctcccaggttcaagcgattctcctgcctcagcctccctagtagctgggattacaggcgcacgccaccatgcccagctaattttttgtatttttagtacagacggggtttcactatcttagccaggctggtcttgaactcctgacctggtgatctgcccgcctcagcctcccaaagtgctgggattacaggtgtgggccaccacgcctggccagttgcttagattattaagtcctaggctttgtccttgcttttctccaccctttcactgctagagatgttggcttatttgtataaaccaaagaggccttttccttttcataacctggatttttttttttttttttttttgagatgatcttactctgttgcccaggctgaagtgcagtggcacgatcttggctcactataacctttgcctcccggattcaagcaattctcctgcctcagcctcccaagtagctgggactacaggtatgtgccatcacgcctgactaatttttgtatttttagcagagatggggtttcgccatgttggccaggctggtctcaaactcctaaccttaggtgatccacctgccttggcctcccaaagtgctgggattacaggcatgagccattgcacctggccccataacctggattttaatgcatgttactggccctaagttgtttattatcctgtagcacatccatggagcttggcaatagccaccaattccatcatcctcatagctactactccctccatacatctcaagtacctggcacattgtgcccttagagtatccagttctactggtacattctcccaatttgctgccatttgtctgtgctctgcccacctccactaatgggatcctcatcatcagatgggtggtgatccagttccaaaccccatcttaccatctcctttctcatctactttggtagcaactgtggaagaccagattctcaagaaggagatgctgagatagagtttgggaggcaaaatgtttattaaggacccatacctgtgaaaggaaggaagaaaaagcaggactgggcagagggaaagtcaacctgtgctgcaggctcgaccaagctcagccgatcagcaggtcactctagaatgagaagtgctcatcagggctttccagcatcaagtttaaatggctggacctttatacctctgccttgctcagtcaccaaatgtgggctaccccaggaagggcatgacctcaggtgaggcagccctgcagctgaagcaggctctgaaggaactgaaagctggtattgtctgctgccctctctctgcagctaggcagcatgtcctttcttgaaggcgatctgggcaacacatcaccatgtgtctcacaatgacatacagacatgaagggacataaatcctaagtatacaatttggtgaactcacccagctcaaaaagtagaaatgatctgcatcacagaacccccatttattcctcttctcagtcaatctctcttcccaaggtaaccactatccttcttctatcaccatagactcatttacctgctttttaaatttttaactgtggtcaaatacacataatataaaacttaccatgtgagccatttttaagtgtgcagtgcagccgtgttaaatacattcacattgttgtgcaaccaatctccaaaactcttcatcttgcaaaactaaaactctgtacccattaaacaaatccccattatcttttcccaagcctttactaactaccattctaccattctacttcctttttttttcttttctttcctttttttttttttttttttttttttgagagagagagtctcgttctgtcgcccaggctggagtgcagtggtgtaatctcagctcactgcgacctctgcctcccgggttcaagtgattctcctgcctcagcctcccgagtagctgggactacaggtgcctgccaccatgcccagctaatctttgtatttttagtacagacagggtttcactttgttggccaggctggtcttgaactcccgaccttgtgatctgcccacctcggcttcccaaagtgctaggattacaggcgtgagccaccacgcctggcctaccattctactttctgtgtctataaatctgactgctcgccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccaggcgcggtggtgggcgcctgtagtcccagctactcaggaggctgaggcaggagaatggcgtgaacccaggaagcggagcttgcagtgagccgagattgcgccactgcagtccgcagtccggcctgggtgacagagcgagactccgtctcaaaaaaaaaaaaaaaaaaaaatctgactgctcaaagtacttcatacaaatggaatcatacagtatgcatctttctgtgcctggcttattttacatagcctaatatccttaagtttcagccgtggtgtagcatgtgacaggatttccttccttttcaaggccgactaatattccgctgcatcttgctgggcacagtggctcatgcctgaaatccaagcacttcgggagcttgaggtgggtgaatcacttgaggtcaggagtttgagaccagcctggccaacatggtgaaaccccatctctactaaaaatacaaaattagccaggtgtggtggcgcatgtctgtaatcccagctatttaggaaggtgaggcaggagaatggtttaaacccaggagatggaggctgcagtgagctgagatggcgccattgcactccaggctggaaaacaagggcaaaactacatctctaaaaaaaaataataaaaaaattccactgtatctatatgccacattttgtttatccatacattcatcagtggacacttgggttacttccaccttttggttagtataaataatattgctatgaacacaagtagattgtttacctgcttttgagcttttcatataaatgaaatgaattctaccatgtgtattattttatgtttggtttctttccttcaacattgtgaaattcatccgtcttatcgcatgtagcaatagtttacttttctcattgatatatagtagttcattgtataatcacatcccagtctgtttattccgtctaccagtgatggacatttaggttgtttccaggttgtatctgttatgaatagtgctgctataaacattcttgttggtgtcttttattatacgcatgtatgcatttctggatgtaaacacctaggagttaaattgctgggtcatagattatgtttgtttagttttactagacactgccaaatagttttccaagatgactataccaatttacctcctccggaacactgaatgagcattccagttgtttggtatcctcaataacacttgatgtcatcggttattttaattttagtcattctcattgatgtaaagtggtatctcattgtggttttaatttgtatttccctaatgactaatgaggttgaaagactttttatgtttatcagtcaattggatgtgaagcgcttgttcatgttttctgtgaagtgcttgttcatgtttcttgcccttaatttagttgtctgtttttttccttattgatttgtagtattgtggtgtatgtatgtatttttccaagggtgattctccagatggcatgggcttgctccagaaccccagtgaccctgctaggacttgccacaaattacacacagtgtcttctcccatctcccacacaaatgtgtgggtgtgtatgtgtatgtattttttgttttgttttgttttgtttttaagatagaatctcatccagttgcttaggctagagtgcggtggtgcaatcatagctcacggcaaccttgacctcctgggctcaagtgattctcccacatcagcctcacgagtagctggaactacaggtgcccgccaccacacccaggtacttttaaaaaaatttttggactgggcacagtggctcatgcctgtaatagcaggactttgggaggccaaggtgtatacatcatctgaggtcaggagttcgagaccagcctggccaatatggtgaaaccccatctctactaaaaatacaaaaattagccgggcgtggtggtgggcacttgtagtcccagctacttgggaggctgaggcaggagaatcgcttgaacctgggaggcagaggttgcagtgagccgagattgcaccactgcactccagcctgggcgacagagcaagactctgtctcaaaacaaaacaaaataaaacaacaacaaaaaattgtttttggagaaatgagggtctccctatgttgcccaggctggtcttcaactcctgggctcaagtgatccttctgcctcagcctcccaaagtgctgggattataggcatgagccaccagcctgcatgtattcttgacaagggctcgaagtttaacatgaggattgcaaatatagtctccctctctatggtttgccttttttccctcttaatggtgtcttttgattagttcttcattttaatcaattcaaattaccaatctttttctttatgactagtgctttttgtgttctgctcactaattatttttaaaatacacataagaataaacatatactcatcgacataaaaatattcttctgtgaaccatctacgatcatattgtgtaacactactgacctcttggatgaagcccaactgcctactgtgaaacacctgatcaagcccctgccaagccctccagccccgtcccactgctccctgccctgcacttcatccttccactaaccaagcagctgtcacacagcatggcattgctaaccaccctgcctttgcaccggcagtgtggaaataacagtgtgtcggacactgtggcccacgcttcttctcccctttcccaccagagccctgactttgcataggtgtccactctcccccacatagccctgtgcttcagggcaagatgcccccacctcagccacaggaagggcatcctgatggcctaatccaattgtggttccacattcctcctgccatggacataggactcaattctagctaatgagatgcaagaggctcctgggaaagtcatccttgttcctgccaaagagaacaggaagagttagatcattactcatgttggatgttgttaggctggatgataaatcccatacactgaggacagcactgagacttgtctgatagaagctgggcctttggtgacatggagtgccagtgatcatactctgcctaaagaacaaccttctggctgggcatggtggctcacattgtaatcctagcactgtgggaggccagggcaggaggatcacttgagcccaggaggtggagactgcagtgagccatgttcgtgccaccacactacagcctgggcaacagagcaagaccctgtcccgaaataataaaataataatttttaaaaacacaaaaattagtcgggtatggtggtgcatatttcccaactacttgggaggctgaggcagtagaatcacttgaacccaggagatggaggttgcagtgagcagagatcggaccactgcacttcagcctgggtgacagagcaacactccatttcaaaaataataataatactttaaaggccaggagcagtggctcatgcctgtaatcccagcactttgggaggctgaggtgggcggatcacttaaggtcaggagtttgagaccagcctagccaacatggtgaaaccttgtctccactaaaactacaaaaattagctgggagtggtggtgcgtgcttgtaatcccagctactaaggaggctgaggcatgtgaatcgcttgaacccaggaggcggaggttgcagtgagccgagatcgtaccactgtactccagcctgggcaaatgagcgagactccatctcaaaaaaagataaatataaataaataaataaataaataaataaaagtgtaatctgaagctcagcatggcatggtggttcacacctgtgatctcagcactttgggaggccaaggcaggtggctgtctgaaataataataataatttttaaaaaccaaccttctgctggtctatatttccttatgattgaagtcagtttgaatcatggtttctgtcccttttaactgaaagcacctcactagtaggaccttaactgaccttggatgaattactgaatgtggatgtatttggtgtgttatgatgtttaggaccagcttcacgggtgtgcaacctgtgctgtcacaccaggcccacacttagtagggccccacgcttggtttaatgttctgctttcatggttttgaaattcttttatatatatatatattttttttttttgtattatactttaagttctagggtacatgtgcacaatgtgcaggtttgttacatatgtatatatgtgccatgttggtgtgctgcacccattagtcatttacattaggtatatctctgaaattctgaaattcttaataacttacgaacaaggagccctgcattttcttttttctttttttttttaattttttttttttgagatggagttttgctctgtcgcccaggctagagtgcaatggcacgatcttggctcaccgcaacctctgcctcctgagttcaagtgattctcctgcctcagactcccgagtagctgggattacaggcatgcgccaccacacccagctaatttggtattttttagtagagatggggtttctccatgttggtcaggctggtctggaactcccgacctcaggtgatccgcccgcctcagcttcccaaagtgctgggattataggcgtgggccaccgcgtctggcctgggccctgcattttcattttgcactgggccctcctaattatgtaattggtcctggtgatgtgacatttcttatctccttgtgtttctttttctgccctttcaatctttgaatctgcacagcttcatccacaagactctaattcacatgcttcatctgccaaatccaccagcttaactgcaaaatgaggaggttgaaccattatctgatctctatggataccttttagaactgttaagaattcaccactgggcatggcggctcacacctgtaatcccagcattttgggaggctgaggcgggcagattgcttgagctcaggagttcgagaccagcctggacaacatagcgagaccccatctctacgaaaagtacaaaacttagccaggtgtggtggtgtgtgcctatagttccagctacttgggaggctgaagtgggaggatggcttgagaggttgcaaggagccgagatcgagccactgcattccagcctgggtgacagaccaagagcctgtctaaaaaaaaaaccaaaaaacaaacaaacaaaaaaacttaaactttcttgcagatgagcagtctgtgttaaaaaagaaaaaaaaaaaagaaggaaaaaggattcaactttctccccagccattttggtaagcaatgacttttcagtattccagaaggcaaaattcaagtgccctggcctggcattcaatatcttgttccatatattgttcttgttactttctgacaccagcacccattactccccagtaagaattacccactttaactaaaaagaatgatgatgataataataataatagtaacaataatagtgaaaacaatgcattcaaataatggtttatagaccgtattcatacatatttacgtttgttcctcacaataattctgtgagatatcatgtgaaaaataattactctggaccttaattctattacaaatagaatttactaacaagcactatatctcatgcaaaagttcagaaatttaataagtgtagttaattactagtcatttatgacaactttttttttttttttttttctggagacaagaatcttgctctgttgcccaggctggaatatagtggcaagagtgatcctcctgggctcaagtggtcttcctgcctcagcctctcaagtagctgggactacagacatgtgccaccatgggtggctattttttaaatttttgtagagacagagtcttactatgttgcccaggctggtctcaaactcccgggctcaagccatcctcccaccttggcctcccaaagtactgggattacaagtgagccactgcacctagacttattacaactttttatttgaaataatttcagacttacaaaatgatttcaggaaaggtcaaagacatcccatgtactttttttttttttttttttttttgagacagagtcttactctgtaacccaggctggagtgcagtggtgcgatctcgcctcattgcatcctctgtctcccaggttcaagcaattctcctgcctgagccccctgagtagctgggattacaggtacctgccaccatgcccagataatttttgtgtgtttttgttgttgttgttttgttttgttttgtttgagacagagtctcactctgttgcccaggctagagtgcagtggtgcaatctcagctcactgcaatctccacctcccgacttcaagcaattcttctccctcagcctcctgagtagctgggattacaggcgtgtgccaccacaccctgctaatttttgtatttttagtagagacagcgtttcaccatactggccaggctggtctcgaactcctgacctcgtgatccgcccgcctcggcctcccaaagtgttgggattacaggtgtgagccacagggcccggcctgtattttttgtttttttgttttttgttttttgtagagacgggctttcaccacgttggccaggctggtatcgaactcctggcctaaagcgatccgcccgccttggcctcccaaactgctgggattacaggcgtgagccacagcacccggccccatataccctttattcagattctcaaaatgttaatattttaccacatttgctttatcattttctttttttctttttttttcccaagacggagtcttgctttgtcgcccaggctggcgtgcagtggtgcagtcatggctcactgcaacctcagtctcccaggttcaagcaattctcctgcctcagcctcccaagtagctgggattacaggtgtgtgccaccacacctgactaatttttgtatttttagtagagacagggtttcatcatgttggccaggctggtcttgaacttctgaccttgtgatctgcatgcctcggcctcccaaagtgctgggattacaggcatgagccaccgcgcccggccccatatgacgtttattaagattctcaaaatgttaacattttaccacatttgctttatcatttctctctctctctctctctctctctctatatatatatatacatatatatatatacacacacacacacacaggtaatatatatgcatacagacatatatacacacacaaatatatgtatgatatatgaaattatttttccagaaccattggagaataaattgcaaacaggatgaaattgtatctctaaatacttaagtatgtgtttcctaaaacaagaatattgtattctcttgtataacagtagcacaattataaaataaaaataataacattgatataataatattacctaacccagagaccttattcagatatcctccactgtcttaataatgttttccacagcaaaaagaaaaattatttttctaaggtcaggcatggtgactcatgcctgtaatctcagcactttgggaagccgaggtggacagatcatctgaggtcaagagttcgagaccagcctggccaacatggtgaaaccctggctctactaaaaatacaaaacttagccaggcgtggtggtgcgcacctgtagtcccagctactcaggaggctgaggcaggagaatcacttgaacccaggaggcggaggttgcagtgagccgagatagcatcactacactccagcctgggcgacagagcgagactctgtctcaaaaacaagaaagaaaaattatttttctggctcaggatccaatccaggatcacacactgcacttagttgagaaatctctttagtttcttttaatctggaataattcctcagtctgactttgcctcccacgatcctttgtcacttgaagaatacaggccagatattttgtatgaggttcttgttttaggtttatctgttttttcccctcatgattagattcaggctatacatttttggcaggaatattctaaaactgatgctgtgttcttggtttattaaatcaggaggcacattactgactactggtgatgttaatttttatttttaggtcaaggtggtgtctgccagttttccactttaaagttattctttgtcgatttttagttaataagtatcttttttttttctttttttagagacagggtctcactctgttgcccaggctgaagtgcagtggcgcaatcataactcactgcagcctcaaatttccgggctccagtgatcctcccacctcatcctcctgagtaacaaggactacaggcacgccaccaggcctggctaatattttatttttgtagagacaggtcttgctatgttaccctggctgatctccaactcctggcctcaagtaatcctcccaacttggcctcagcctcccaaaactctgggattataggcatgaaccaccatgcctggccaataagtatcttgtggggagatattttgagactatatcctgttcctcataaaacttttacccactaatcttagcatccattgcaaaaattacaaagtctttcattgaaaaagtatacacaagccaatggttaaaaaattcaaaacaatacagtgaacaagtatgtatacatactcactttttgttgtataaaaaaagagaaatagagtgaatagtatagtgaaaagtaaatctcctgatattagatcctcaggacccttcctcctgttacttgtttgtgtctttgtggtagacacgatgccatatgatactgaacctcatttcatttccttttttctgggcataaaggatgacaacatttcctgtcctgctttgcggtgaggctgagaccatgagactagttctggctcaagggctatgaacagaaatgatattgggcactcttgggccaaagcatttagtgccattttatgtctctccagctctctcttcccctgctgcagcaattgtgaaagccacgcatttagatggtgaagccacaaaatggaaacagcctggatccctgagtcaccagatgcagaaacagctgccctgaaaagttgtccatcttgcactatacatgcccatgtacgagaaatacaagccttttctggccgggcgcggtggctcacgcctgtaatcccagcactttgggaagccgaggcgggcagatcatttgaggtcaggagttcgagatcagcctggccaacatggtgaaaccccgtctctacaaaaaatataaaaattagccaggcatggtggcaggcgcttgtaatcccagctactcaggtggctgaggtaggagaatcgcttgaacctgggaggcagtggttgcagtgagccgagattacaccattgcactccagcctgggtgataagagcaaaactctgtctcaaaaaaaaaaaaaaggccttttctgtggttaagaaatgagaatcaagtttaagatatttgagatttttctttttattatttttttccttagaggtaattgtggggtggaggtgggggtcttgctatcttgcccaggctggactcaaactcctgggttcaagcaatcctccagtctcagcctcccaagtagctgggactataggtacacactaccacaccagtttctttgagatttttgtacatcgggatatatagctcattctttttaagatttgccaagtgttccattgtatgactataatatatttaggaggtacatttctttaatttaaatttttgaattgatattatataccatatggttttaaattaaaatggttcaaaaaagtatatatgtgaaaaattctcactctcattgctgccctgagccaataaattccccaccaaaggtaaccaatatttcctgttccttatgtgtacttccagagttatgtcatacataggatatttaaaggaacctcactcgtctcaagtttggccgagacaccaaaacaataaggtcacacttcaaagttacgggcaagtccaccaatacaggatttgcaaaagaagattatagaaaaccaattttcatgccgggcgcgctggctgacgcctgtaatcccagcactttgggaggccgaggcaggtggatcacgaggtcaggagatcgagaccatcctggccaacatggtaaaactccatctctactaaaaatacaaaaatgagctggatgtggtggtacgtgcttgtaattccaggtacttgggaggctgaggtaggagaatcacttgaacccaggaggcagagattgcagtgagccaagatagtgtcactgcactccaacctggcgacagagcaagactccatctcaaaaaaaaaaaaaaaaaagaaaagaaaaccagttttcaatcttcattcactacccatccgcagcctgcaaaagatgttgaagagattgaaaaaaaaaaagactcaaggttttagaaaaagctattgctgaactgagtcactgagtcattgcctccaacctcatcctaaggggtacatgcccctcacctcacactaataaaacgaattttactgggatcacatagtagaatatgtgtttcttcgtctttgagaggcacagtgggctgaagtctgagttgtctgggatgtgtaaagggttaagggttaatgcaggcatcctgtggggtagagaagaggttgcgatttgggatatagcagcacttgcaacaatgggtcaaatgaacatattttctctaatctaagtatgatacaaacatgcaagagctctggagaagcattgccttggatcctgttcaagaaagctgcctggaaagtaagtggacttcagcagaaggaaggtggaggcgtagcaccagatgcctagagtctcgagaaagaattgtaaataaacaactgtaaaagccatgtattcatctatgcaggagaaactgcaggccaagtgtggtagctcatgcctgtaatcccagcactttgggagaccaaggcgggcagatcacctgaggtcaggagttcaagaccagcctggccaagatggtgaaaccccgtctctactaaaaatacaaaaattagctgggcgtggtggtgggcatctgtaattccaggtactcaggaggctaaggcaggagaatcacttgaacccaggaggcagaggttgcagtgagccaagatcgcaccactgcactccagcttgggtgacagagggagacctcatctcagaaaaaaagaaagctgccgggaaagtaagtggacttcagcagaaggaaggtggaggcgtagcaccagatgcctagagtctcgataaagaattgtaaataaacaactggaaaagccatgtattcatttatgcagaagaaactgcaggcggggcacggtggctcatccctgcagtccccacactttgggaggccaaggcaggtggatcacttggggtcaggagtttgagatcagcctggccaacatagtgaaaccccaacttaaaaaaaaaaagaaactgcagagatgagatccccaatgatgggaggaggaagctttaaggaactcagaaatacagcccacatacaaaaagagtaagccttaaacacctgccagagtacagatgccattcatgacagtactagtcaagtgtgaactttaccgtctcctttattactttctccatatgttccaaccttaacaggccttatggctgtgtgattcattcactgctaaagggtgcctaaatgaaggcgcatatggtggctgcaacccagtctgggttccattctccaaactgtatgccctggcatggggttttatctatttggaataagagcagtgttttcctaattcacacagaggtacagttctctcaccatggggctgcatacacccagaaggggaacatattcctaatctacagaggcaccagatggactagcagccacccagtttggagggtctcagagacagtgactagcaagaggaggagaggaggggaagcactgaatgaggaaggagctgagctggccacacactccttttccatagtaggtaacccacctcgtagaggcccaatctgggaaagagggtggagcctctgtataaatgaattttacagtaatggatgttagagggggctggaagttttttttttatcacttaactgatattatttgggaaactagcatgacaggagaacttttttttctttttctttttttttttttgagacagagtctcactctgttgccaggatggagtgcagtagtgtgatctgggcttactgcaacctccgccttctgggttcaagcaattctcctgcctcagcctcccaagtagctgggactataggtgtgtgccaccacggccagctaatttttgtgtttttagtagagacagggtttcaccatgttgaccaggatggtcttgatctcttgacctcatgatccacctgccttggcctcccaaagtgctgggattacaggcgtaagccacctcacccggccaggactttttttttttttttgagatggagtctctctctgtcacccaggctggagtgcagtggcgtgatcttggctcactgcaacgtccacctcctgggctcaagcgattctcctgcctcagccttataagtaactgggattacagcatgtgccaccatgcccagctaatttttgtatttttagtagagatggggttttgccttgttggcctggccggtctcgaactcctaacctcaggtgatccacctgcctcagcctcccaaagtgctgggattacagacatgagccactgcgcccaacctaggaagacttttaatacttatgagtaaccagaaaagttgagggatttgaccatggtttcacctaagggggcacgggaaaactagccccaaagaatacattaaaaggccagtgaaagatgaaagttaagatttttctgattcatacgcggtagcggagactccctactaataggcattctatcctttaggcacaaagctaggctctgtttcccagcatacattgcaggttggtataatcttttgttttgttttgttttgttttgagacagagtctcgttctgttgcccaggctggagtgcagttgctagatcttggctcactgcaacctccacttcccaggttcaagagattctcctgcctcagcctcccgagtagctgggattacaggcgtgcaccaccacacccgcataatttttgtatttttagtagagatggggtttcaccatgttggcccgactggtctcgaattcctgaccttaagtgatcacccgccttagcctcccaaagtgttgggattacaggcttgagccaccacgcccagttgggtataatctttttattaaattttttccagtgaaatgcaaaacaggtttgggttaatacgatgggtatgacttgcagaactggcctataactgcacccccacccataacactcttctattttttcccaccttttgccaacttaaagtagatgatgacaagggctcaagtgatgacagatagaaacctgggtctgtggatgatggcaaagaggagagctgccccaccaagccaaacaactgtccaagactactatgtgaacgggaaataaacctctattttgttaaggcattatattttagttttgctcatgttaaaagaatcacaaatccttcagatctagaaaacaaaagtagaattcatttcttgctgggcaagggagaactgcaaagatacatgtaatccctgtgaacaaagtaaaaaataggtttatatgggattttaggaaaatataagtgattggttttggctcaaagtgagtagggttagtcactgattagataggtttcaagaacaggtgacctattgatgtaaggtttgatgactgcaggtgattcagcccaagactgatattgattcatcttatagtttcctgtgtaaatgcctgcagacatcagctaggttcttcaggcaagaatggaattttctattgtcatctcccattttgcccctgcttgacaggtcatggaagaggccattaaatattgtctagaacagtggtgggcaactgtttttctgtaaagggacaaaacgtaaatattttaggttctgtgagccctactgactctatcgtaacaacttaactctgctgctgtcacacaaaaatagcacaaatgattcgtaaatgaataggtgtggctgtgtttcaataaaacgttacttaaaaaaacaagtggtgggccagacttaactcattggccatagtttgctagcccctggtctagaactctagatgtagtccactgacatggttttccttcgggggtgaaatggtggctgtggtgatcatcatgatttcattttgtttttgattcaagatcatctgttgcaccatctgatgagacagccaacacacagtagagtttaaaattctggacaccagctagacagtatataaatacaacattaaaatatatgccaggcacagtggctcacgcctgtaattccagcactttgggagaacgaggtgggcagatcacttgaggtcaggagttcgagaccagcctggccaacatggtgaaaccccgtctctactgaaaatacaaaaattagctaggcgtgttggggggcgtctgtaatcccagctactagggaggctgaggcaggagaatctcttgaacccaggaggcagaggttgcagtgagcagagatcgcatcactgcactccagcctgggcaacagagcgagactctgtctttttttttgagacagagtttcgctcttgttgcccaggctggagtgcagtgtcgcaatcttggctccctgcaacctccgcctcccaggttcaagtgattgtcctgcctcactcaggctcccgagtagctgggattacaggcatctaccaccatgcctggctaattttttgtatttccagtagagatggggtttcaccatgttggccaggttggtctcaaactcctggcctgaggtgatccacccgccttggcctcccaaagtgctaggattacaggtgtgcccggccggagactctgtctttaaaaatacacacacacacacacacacacacacacacacacacacacacacaggactagatttttttttttttttagagtcagtctcactccatcacccaggctggagtgcagtggtgcgatctcagctcactgcaccctccacctcctgggttcaagcaattcacatgccttagcctccctagtagctggaattacaggtgcgccaccacaccccgctaattgttgtatttttagtagagacgaagtttcgtcatgttggccatggtggtctcaaactcctgacctcaggtgatccgcctgccttggtctcccgaagtgctgggattacaggtgtgagccaccatacccagcctacaactagtagaataaggaaggactggaaagtgcaccaaaatcatgatccaagttttcacagattaaaccctctttttgacctgaagtatggggataagacaaagaaatgttttttgtttgagatagagtctcattctgtcacccaggctgaagtgcagtggcatgatctcagctcaccgcagcctcgaactcccaggctcaggtgattctcccacctcagcctcctgagtgagtagctgtaactacaggtgtgcaccaccaagcccagctaatttttgtacttttggtagagatggggttccgccatgttggccaggctggtctcgaactcctgggttcaagggatccacctgcctcggcctctcaaagtgctgggattacaagtatgagccaccgtgcctggcccagacaaaggaatattgaccaggttgttatcatttgaaattttttgaagtttctctaatctctttgctaatgttgaaaatctctgagacatcttgggaaatacaagtgcaatattttcctttagcacagcacaagttccttttggtgagataaggagaatatgtcatgggcgctctattttggctgactgccttcttgcaataagtctaaagcttagaaggtctttgttaagctttcagtcatttgtacagtcataaacttgaagaattctctcaaatatatgtgccccctgtaaagcatggtgtgaagctgtctggggacaaaaaaaatttcaaaattctcttatgccaaggtttaattgcttgtaacagaaatgaagggaccggatgcagtgactcatgcctgtaattccagcactttgggaggccaaggcgggtgaatcacctgaggtcaggagttcgagaccatcctggccaatatggtgaaaccccactctactaaaaatacaaaaattagccaggtgtggtggcacacacctgtaatcccagctacttgggaggctgaggcaggagaatcgcttgaacctggaaggcggaggctgcagtgagctcagatcatgccattgcactccagccttggcaacaagagtgaaactccatctcaaaaaaaaaaaaaaagaaagtaatgaaagggtttccctttaggcccggtacaatggctcacaccagtaatcccagcactttgggagactgaggtgggaggattgcttgagcccaggagtttgagaccagcctgggcaacatagcaagacctcatctctacaaaaaacgtttaaaagttagcctggcacggtggcctacgcctgtagtaccagctactcaggaggctgaggcaggaggatcacttgagcccagaaggtcaaggctgcagtgagccatgtttgtgccactgtactccagcctgggtaacagagagacccttttttttttttctgagacagtcttgctctgccacccatgctgaagtccaggggcacgatctcagctcactgcaacctccacctccagggttcaagcaattcttctgcctcagcctcccgagtagctgggactacaggtacgcacgccaccacgcccgactaatttttgtatttttagtagagacggggtttcaccatattggccagtctggtctcaaactcctgacctcgtgatacgtccactttggcctcccaaagtgctgggatcacaggctgagccaccgtgcccagctgagaccgtttttttaaaaaaggatttctctttagataattttgaccaaaagggtctaggagtgaggtcctgaattattattattattattattattaagggtctatgagtgaggtcctgaattattattattattattattattattattattattattttgagacagggtcttgctgtgcccaggctggagtgagtggtgtgatcttggctcactgcaaccccagcctcctgggttcaagtgattctccagcctcagcttctcaagtagctgggaccacaggcaccaccatgcccagctaatttttacatttttagtagagatggagtctcgccatgttgcccaggctggtctcaaactcctggcctcaagcaatctgtctgccttggtctcccaaagtgctgaaattacaggcatgtgccaccgtgctcggccatgaatgattcttaatacaggaatcagttgccataaatagaaacatatcaccaattttcagggagtaaccaggagttctttattccacaaagcaagtaccactcattaggagtcacctaggaactgggttcaggccaggaaaatccagaactctcattatggatcctggcaaagataatgaatctgagtctacttcactttaaaactaacttaaaatatctgaaaataatgctttggtatgcctttgtggtaagagttgtacaggttatgcattttttaagataaaccataccagtgattcttcccctgggctgtcagtgctacaaaaatttgaacacacgaactggtccccaccttaggccctttagtttgatttctgtgtaagcaaaaatgtcctactttaggcatgacaatattggtattggtggcttagaaatataaggtttgtgatggtgattatcagtaattatgttaagagttcataataacttcattcattatgaagtcattgatatcacttgaggggattactacccaaaagaattatacaacctaaagggaagtgagtgcaacccagcaactgaatctggctagactgtgggctaactgtggataagtaattgttgtataggaggagtttactaaaggcaagagtatcaacaacagaaacaggaataataaaaagcccgtatacagtagacacagtggctcacacctgtaattccaatactttgggaagctgaggtgggaggatctattgggcccagtagttcaagaccagtctagacaagatggtgagaccacctgtcccacccacagtctctacaaaaagtttttaaaaaattagccagctgtggtggtgtgtgtctgtggtcccacctacttgggaggctgatgcaggagaatccctggagcccaggagttcaaggcgacagtgagctatgattgcaccactgcaccattgcaccactgcacagagctagactctatctcttgggggaaaaaaaaaaaaaaaatatatatatatatatatatatgatcttgtagtatgctaccttcccttctgggtaagaaataaaagggggaaataagaaaatacacatgtatatattcatttgtgcaaaaagaaacacatgacaaactgggttcagtggctcacagctgtaatccaagcactttgggaggccaagacagggggatcacttgagcccaggagttgtagaccagcctgggcaacagagtaagaccccatctctacacaaaacttaaaaattagccaggtgtggtggcgcacacctatagtctcagctactcgggagactgaggtaggaggttgagcctgcagtgggccatgatcacaccattgcactccagcctgaagaacagaggaagaccctgtctccaagaaaaaaaagaatgggctgggcgcggtggctcatgcctgtaatcccagcactttgggaggctgaggcaggcggatcacctgaggtcaagagttcgagaccagcctggccaacatggcgaaaccccgtctgtactaaaaatacaaaaattagccaggctttgtggtgcacacctgtactcccagctactcaggaggctgaggcaggagaatcactggaacccaggaggcagaagctgtagtgagctgaaattgcaccactgcactccagcctgggcgacaagaatgaaattctgtttttaaaaaaagaaaaaaaaaaaagaatgaggctgggcgcagtggctcacacctgtaatcccagcactttgggaggctgaggtggcggatcacttgaggtcaggagttcaagaccagcctgaccaacatggagaaaccccatctctactaaaaatacaaaattagccgggcatggtggcacatgcctctaatcccagctacttgggagcctgaggcaggaaaattgcttgaagctgggaggcagaggttgtggtgagccgagatcgcaccattgcactccagcccgggcaacaagaccgaaactccgtctcaaaaaaaaaaagaagaaaaagaaaaaagaatgatagtgacatgtcaaagtaacacagaaggcagcttgaaaaggtagccagatctgcctgtaagagattagaatcaagtatgggtggagggactcctagttatatgggcctgcctgccagtggccgaatcagagggagacagtctatgggttcctgaatgggcagaacacagagtcatagagcaaaggacagtatttaaggccatgggaactcaagtgtgtctgataatttagttaatttaagcttagtactccttttgtggttttgacttttctagatgattgagagtggtaaggagcacgaggctttgacatgacaggcaatgctttacatagctcaagaatgattgccccagtaaaataagtttatctatcattacacaattaaattagaatagctcctgtagggaatacaaagtccattagtttcttagccactttgagtgtctcaaaaaaaaaaaaaaaagagttttaatcacctcatggttctgcaggctgtacaggaagcatggcagcatctgctccgcttctggggaggcctcagaaaacttacaatcatgacagaaggcaaagcgagatcaggaggcttacatgacagaagcagtaccgagtgtggtggggaagtgccatgtacttttaaacaaccagatctcatgagaactcactatcatgatgacagcaccaagggtgatgatgttaaaccatgagaaaccacccccatgatccaatcaccttccgtaaggccccacctccaacattaaggattacaattgaacatgagatttgggtggggacacagacccaaaccatatcacccccactgcggtaaactgttctatggagagcttttgtaagtgttcgtttgaacttttctggtgctacatggaggctgtcctcatggatcttataacccaatagtgtgcatagatgatggaattcttgaacctctccatgggctcatcatcattctgttgctaaaagaactcacttttaaagacttcagacagagcaacttataagtataaagatctgctaaagcatttcttctcatttttttaaagtgtgggcctctgcttaatgacagcaatttccaagacatcatgaaactcatttatttgttgtctatttttaacagggataccaattgagaaggaaaattttctgtttctttccatggtattctgaagccatggcccatgagtcagaatgttcatgtgtgttagtcattccttgctgtgtttaacaagatatagtaagagataagctcaggtaagaacatactgacttgcaggtgaaaggaaaaggaatagaaggagtccagcaatggagccttgtagggttggagaagctgctgaaccccaacaacaggaaaaaagactgaaaaggctttgagaaacacaggtccactaaggtatttcaattaaacagaggaattcagcactactgcaaagaacagtttaaaggtgttttctcttacctaaacctattgtttcctatggcctcactgtaactgccattaagttgagagagagaggcatggagtgaagaaagaaagagataagcaaaagttgatatttatgtcttgaaaaaaatccagcctggccaacatggcaaaaccccgcctctactaaaaatacaaaaattagccaggttggccgggcgcggtggctcacgcctgtaatcccagcaccttgggaggctgaggcaggcagatcacgaggtcaggagatcgagaccatcctggctaacatggtgaaaccccgtctctactaaaaatacaaaaaattagccaggcacggtggcaggtgcctgtagtcccagctactcgagaggctgaggcaggagaatggcgagaacccgggaggcggagcttgcagtgagctgagatcgcaccactgcactccagcctgggtgacagaacgagactgtctcaaaaaaaaaaaaaaaattagccaggcatggtggcaggcacctgtaatcccggctgaggcaggagaatcacctgaacccgggaggtggagattgcagtgagctgacatggtgccactgcactccagcctgggcgatggcatgagaccctctctttaaaaaaaaaaaaaaaaaaaaaaaaatatatatatatatacatatatatatatatatatatatatatatgtatatatatatatgtatatatatatgtatatatatacatatatatatatatgatggcataagaccctctctttaaaaaaaaaaaaaaaatatatatatatatatattttttttttggcacaagatactgttgtggcacaagatactgtttgctttgaggcaaatcgatccaaaaagtttctgagtgaactgtattgccaaaaaattccccagcctggtccgaataaataagtaaaaccataaagtaacacttggaaatccaaagttgcaccatcaggaaggaggctttcaaggctgtgtagttcccaaggaggacaggcaccccacttcacacaaagccaggaagaacaatggctgaggaagaacttgccagagggcagaacaagggtggaaggagaacaatgccaggataatttttcctaaagagcaaaatctggtctaatctaggaaattcatccactgccaggaaaggatgtcttcataatgcatatctagcagaactccataattgctttggacaggaaggttgggtttttcccattctcccttttccaaataggatttgctattgcccttttcctgtctctgcttcatcattgtagatgggcaggtgggtttattggggtggggagaaagtggcaaccacttggcttttagttcatagattgctagaccatgaggaaattcactcaggccaattacagaagaccacaatccagattctgatatgaatcctataaatgaatggaagtttttgtcatagctcttgggagaagggtgaatatgagatttgctggtcagagaggctgactgtagcagcgaccccttgctatctaccaaaagtcattattctctttaggcacacaacaagactgtttcccatactcccattcaatttgagtgtggtcatgtgacggttttctccaatgtaatgtgagtggaaccaatgtgtgtcactacctgatccaggggataatagatggacagcttctgggccccttaatgaaaaaagtggaggagagtggccccattgacctgaatatccgcccgggactgttaggtgagcaagaaattaagtattttactgagtcatattttggatctatttgtcacagtagtttaacctattattaactgatacacaccccatgagtcatgcttgttcaacatgactatatatgcatatccttttaaacaataattattaatggtaacatactaaacaccctgtagtgaaccttgtttttttgttttctgtttttttttttttttttcattaaatttcctgctaagtgttctgtatcagtacattaataactcctttgccgggcgcaggggctcacacctgtattcccagcactttgggaggccaaggcaggcggatcatgagctcaagagatcaagaccatcctggctaacacggtgaaaccccatctctactaaaagtacaaaaaaaaaaaagccgggcgtggtggtgggcacctgtagtcccagctactcgggagcctgaggcaggagaatgacgtgaacctgggaggcggagcttgcagtgagccaagactgcgccaccgcactccagcctgggtgacagtgcaaggctccgtcaaaaataaataaataaataaaataacttctttgtttttattttctttatttttgctttttttgcggggggcgttggcaggggagacaggatcttacactgttgcccaggctggaatgcaatggtgccatcatagctcactgcagcctaaactcctgggctcaagtgatcctcccacctcagcctccccagtagctatgactacaggtgtggaccaccatgcccagctaatcttttagtttttgtagagacagggtcttgctttgttgcccaagctggtcttgcattcttggcttcaagcgatcctcccacctgggcctaccaaagtgctgggattataggagtgagctactatgtttgctttttgaatagcttaagtaccacatgttattttgcccgttccctactgatggacatttagtttgttaacagtcctttgctattgtccttggttcaagttctttctttccttccctccctccctctttctctctctctctctctctcgttctttctttttaatggagtctcgctttgtcgcccaggctggagtacagtggcaccatctaggctcactgaaacctctgcctcccaggttcaagcgattctcctgcctcagcctcccaagtaactgggaccacaggcacccgccaccatgcccagctaatttttgtatttttagtagagatggggtttcacctattggccaggctggtctcaaactcctgaccttgtgatcctcccacctcagcctcccaaagtgctgggattacagatgtgagccactgcacctggccgattcaagttctttcaattggcactctgcaaatgcaaaagacaggtcagctacatgtccagcattatctagttctattctttaatttaggacttcccttagattcttttagccaagttgcaaagataatatgctctattgattctctgtggtctactattgtaaaatacatattgaaaaataaactcaagtgattacaagtccaatacttacacaggtaggaggactataacatggtgacctaacagcatgattacaatgagacagccctgggttcaaatcccagctctactacctataacatgtaacttaaccttacacaatttactgaactgtaagcatccattttctcacctgttaagtggtgactattgtgaagattaaatgataatgaagtgctcagtacatgatattcagttaacaagtactgtagaatttttcttactacgtaactttaaaaaattaccaaagaaagccaaaattaaggccaggcacggtggctcacgactgtaatcccagcacttggggaggccgaggcaggtggatcatctgaggtcaggagttcgagaccagcccggccaatatagcgaaaccctgtctctactaaaaatacaaaaattggctgggcgtggtggctcactcctgtaatcccagcactttgggaggctgaggagggcagatcacgaggtcaggagttcgagaccagcctgactaacatggtgaaaccccgtctctactgaaaaaaaaaaaaaattagccatgcgtggtggcgggcgcttgtaatcccagctactcaggaggctgaggcaggagaatcgcttgaactcgggaggcagaggttgcagtgggccaagattgcatcattgcactccagcctgggcgacagggtgagactccgtctcaaaaaataaataaacaaataaaataaaaatagaaaaattagccgggcatggtggtgcatgcctgaaatcccagctactaggggggctgaggcaggaaaattgcttgaacctgggaggtggaggttgcagtgagctgagatcgtgccactgcactccagcctgggcaacagagcgaggctccgtctcaaaaaaaaaaaaaaagaaaaagccaaaattaaactttagtctgaagatgggacatgtatcataactgtctttattgttaagataggaaataggggccaggtgcggtggcccatgtctgtaatctcagcactctgggaggccaaggtgggcagatcacctgagatcaggagttcaagaccagcctagtcaacatagcgaaaccctgtctctaccaaaaatacaaaaattagccatgcatggtggtgggcgccttggttttcaaaaggttaaatcattgttcagttttttcaaaatgattttattttacatacttctctgcaacttgccagtctctctctctctctttttcttttttcttttttttttttttttttgagacatggtctcactatgttactcaggctggagtgcagtggcatggtcatggctcactgcagcctcgacctcctgggctcaagcaactcttttacctcagccttctgagtagctgagactacagccaccatgtccagctaattaaaaactttttttttatagagatgggggtcacgctatgttgcctaggctaatctccaattcccgggctcaggtgatcctttcgcctcagcctctgaaagtgttggtattacaggcgtgaaccacctctcccagcctgccaatttcttttcttttccttttttttttttttttttttttttttgagacagaatctggctctgtcgcccaggctggagtgcaatggtgtgatctcagctcactgcaaattcctggcttcaagcaattctcctgcctcagcctcccaagtagctgggattataggcgcctgccaccactcccagctaatttttgtatttttattaaagatggggtttcaccatgttggccaggctcttcttgaacctctgacctcatgattcacctgcctccgatcccaaagtgctgggattacaggtgtgagccgccacacctggctgctaatttctctttaaattgtactgctgacatcttctcagtcagtagaagtatatcgacttcattatttttaatacctttagtcattttttttggtaatcattcatttttaataaagagggattcttcaaattttttggttcttttttttttttaagggagtctcgctctgttgcccaggctggactgcagtggcgcaatctcggctcactgcaacctctgcctctggggctcaaacgattctcctgcttcagcctcccaagtagctgggactacaggcatctgccactacacccagctaatttttgtatttttagtcgagacagggtttcaccatgttggccaggctggtctcgaattcctgacctcaaatgatctgccagccgtggcctcccaaagtgctgagattacaggcgtgggccaccgcgcccggcctcaaattttgtgattattcatttaaattttgtaatcaaacattagggtgacgtgttggagctgatcccatactgtaggttcaggaaatacagtcattgcagacatcatcattaacgttaaagcaagcaacacagaggcttctctcttgggactgagaagggaaagaggtgtaggaaacatatacaaatgtaaaaactattctcctagtacttggcttctggaagtgaaactgaaggactgtactgtccatattaggaaatgactggctgctggatgaccacagtgttaagctttttgtccctttttgtggggagagagatgaaagggaattggtcaggaggacatcagatcagttagctttataatcaatctcttctcttccaacacaatctcagtagagttataagcattaggaaatcaaactttcactttaattagagagattgaaaatctggctccatttttaaaggtgagggttctaaattgtattcctaaatgatgttaactattgttccccgaaattgcatcagggttaaaaatttgtgttgaggttggtttgaattaatctaaatattcaacatgtgctcttgccataaagcagaaagcaaaggcctgaagtagacaagctttttaacctttctggcatttcatagatttcaccttaataaaattctgaaaactcccattatagtataattagcttcctttattttatttatgtatttttttgagacacctgtgtaggtatctgtggacacatttatgagaatcggttggccctgcaactctcccagtcaagctcactgccaggctaactttggcttgtgtaccttctcctcttagtttcaccaatacttgacagagtctggctcagcacagctctatgggatggagggccagatggctcccaaagagccctgaccagaggcacaggcctgtgaccaggtgtcctattctaggacagatggcttgaattgcctcctgctcccttttgctctgacagtctctgggactactgagcgctggggccactacagaaattggatgatgctttgcaaagatggcttttaattaagtatcagggagagtgagacaatccaatattttcaaagatgagtcactctgggattggcctttttgcttgccttagaggtctaacctcttccattcacaggtgagagacagaacaatgtagtcaagtcagttcatcagcatgttggcaaatcggagtcccaggcttggagaagacctttgcagtgaaggcatgtggaaagagaatgtggcaagagagcagctatcttcaggggaatgttggtctgcccactgccaggagggcttgttactctgaaaaagttttcaaagtttacctttgagcctcagtaactaggtactggcatttccccagggtttagtggttagtggaggctgacacttcacataacccaggtcaccagacaccaaataccaattgtctgacttaaaatacaaacagttctatgaaagaggacacccagtagtcagcctgatggtcgtatcccctacccacaggaaaacacactgaaagcccactcaggctgcagatacgttactgacgcatccaccaccacagctagagagataccctcaggaatgtgttgacttgatatacctccttgctgggccccctagtcacattctttctttacacaagttaataccatttactcagcagaggctttacacatgctaatagaggctcctcaggctacaccttcatctcaggacaagtggaaaccttaatcatctggtttcattttaattttccatgacagtaaaaggtacagtgactacaggacagtcctttcctgccttcctggggtagttaatcctaaaaaacctcttgtggggcaattcaagttgaaaatgtaatcagtacttaatttcaatgggaaaacattttatatgtgcacagtgtcccaaaattaacacccactcatgctaaaacatcaaatctcattaagacagacacaattacattaacaattacactggctatcataaacaaaactaaaggcattttcccttcattagttatgatctcattagttacgagattattatcccataatatggccatttacccgttgtttcttagcttttatgcactgtacatttaagactaaatttaggccaggctcagtggctcacacttgtaatcccagcactttgagatgccaaggcaggtggatcacttgaggtcaggagttcaagaccaccctggccaacatggcgaaaccctatctctactaaaaatacaaaaaaaaaattggtcaggcacggtagttcacgcctgtaatcccagcattttgggaggccaaggagggcagatcccaaggtcagaagttcgagaccagcctggccaatatgctgaaaccccatctctactaaaaatacaaaaaaaaaaaaaaaaaaaaattagctgggcgtggtggcgcccacctgtagtcccagctacttggaagactgaagcagaagaatcacttgaacccgggaggcggaggtagcagtgagccgagattgtgccactgcactccagcctggcagcctgggtgacagagcgcgactccatctcaaaaaaaaaaaaaaaaggtcaggcctatcccagtactttgggaggccaaggcaggcggatcactgaggtcaggaatttgagaccagcctggccaacgtggtgaaaccctgtctctactaaaaatgcaaaaattagctgggtgtggtggtgggcacctgtaatcccagttactcgggaggctgaggtaggggaattgcttgaacccaggagacggaggttgcagtaagccaagatcgcaccactgcactccaacttgggtgacagagcgaaattctgtctcaaaaaaaaaaaaaattagccgggtgtggtggtgcactcctgtaatcccagctactcgggaggctgaggcaggacccggaaggtggaggttgcaatgagctgagatcgacagagaaagactccgtctcaaaaaaaaaaaagatatatacggccaggcggctgggagttcgcgaccagcctgaccaacatgtagaaatcctgattctactaaaaatacaaaattagccaggcctggtggcacatgcctgtaatcccagctactcaaggggaatcgcttgaacccaggagggcagaggttgtggtgaaccaagatcctgccattgcactccagcccgggcaacaagagcgaaactccgtctaaaaaaaaaaaaagactaaacatgcaaaacatacgtaaaaaatgatgtccaatgtttatacaacttaacctttttttttttctgagacaaggtctcattctattgcccaggctggagtgcagtggcatgatcatagctcactgctcaagtgatcctgcctcagcttcccatcagagtagccaggactacaggcatgcaccaccattcctagcagtttttaaaaacttttttgaggctgggcacgctggctcatgtctataattccagcactttgagaggccgaggcaggtggatcacttgaggtcaggagttcgagaccagcctggccaacatcgtgaaaccccatctctactaaaaatacaaaaattagctgggtgtggtggcaggtgcctgtaattccagctactcaggaggcagagacagaaaaattgcttgaacccaggaagcggaggttgcagtgagcagagattgtgccactgcactccagcctgggtgacacattgagactccgtctcaaaaaaaagaaaaaaaaaaaattctttttcaggccatgtgcagtggctcacgcctgtaatcctagcactttgggaagccgaggcgggcggatcatctaaggccaggagttcgagaccagcctggccaacatggtgaaaccccatcgctaataaaaatacaaaaattagccaggcgtggtggtaggtgcctgtaatccctgttactcaggaggctgaggcaggagaatcacttgaacccaggaggcagaggttgcagtgagctgagatcaggctattgcacaccagcctgggggacaagaatgaggcttcgtctcaaaaaaaaaaaaaaaaaaaaaaacctttttgtagagacagggtcttgctatgttgcccaggctgaacttgaatgcctggcctcaagtgatcttcccatctaggcctctcaaagtgataaaattataggcaagaggcaccgagcctggccttaacctttgttttaaaaaaagagtaacaagggccgggcacagtggctcacacctgtaatcccagcactttgggaggctgagacgggcgaatcacgaggtcaggagatcgagaccatcctggctaacacagtgaaatcctgtctttactaaaaatacaaaaaaaaattagccgggcttggtggcgggtgcctgtagtcccagctactggggaggctgaggcaggagaatggcatgaacccaggaagcggagcttgcagtgagctgagatcgcaccactgcactccagcctgggtgacagagtgagactgtctcaaaaaaaaaaaagaagagtaacaagggccaggcacgatggctcacgcttgtaatcccaaacactttgggaggacaaagcaggaggatcacttgagtccaggagttcaagaccagcctgggcaacagggtgaaaccacatctctacaaaaaatacaaaaattagctgcgcgtgatggtgcacacctgtggtcccagctgctcgggaggctaaggtaggaggaccgcttgagcctgggaggcagaggctgcagtgaactgagatcatgtcagtgcactccagcctgggtgaaagagagagaccctgtctcaaaaaaaaaaaaaaaaaaaaaaaaagtaacaagtcttggcacagttgtttgtgcctgtaatcccggcactttgggaggctgatgcaggaggactgcttgagcccaagagttccggaccagcctgggtaacacagtgagacctcgaggctgacacaggaggatcgcctgagcccagaagttcaagaccagtctgggtagtacagtgagacccggctcaattaaaaaaaaaaaaaaaaaagtaataaaatgaatgaaaaccttgcaaataaaattaccttcactgaacaagtgaaataacaagagacttgatgtgtattattaagccttaaatatgttttgctataaatcagcaaaactatgagaaatctgatgagataacttaaggtaacacagaccagctctgtgaagctgatgcatgttggcttcaggcactccaagaagtacaccaaacaaatccatcctgagagctgcaaagacatgctttgtgtttcagtttttattgcagaacaaactacctcaaaacttactggtttcactcttaaacaataagcatttattctttttcatcagtctgtgggtttgctggggaagtcttctggtctgggccagcttagctgggcctggatggtctagaatgctcttgttcatatgtctggtagttgctggcaggctagctggtctaaggggccacactcatacatgtctggcagttggtcagatgtcagatggggtgatgactatgtgtctgtcatcatccattaggttagtaggagttatcctcgtggtagtggaagaggtcacagcagcaagagaaagcaaccccctgttgtaatcacttctcaagacacttcttgctttacatttgccagtgtcctacaggacaaagcaagtcacacggccaagcctagattcagtgaatggagaaacagactccacctctgcattggagaagctgaaaaacactgtggctattctgttcaacccactaccctttagaagctaaagtagagattaaatgatattccttgtaacatgaatgggcacgtatctcagggtttaatcatctaggtttcagggcattctacattttctgttacttatatcatatttctgtgatgggaggagcatgcttttctgtttcagctactgaggtcaactagtagggccactttcctaggaccttttctataccttgagacagagataaaactgaagaggtaggcaagaagctagatcttcttagggccctgtaggccacataaaggaatttaggacttgatcccaagagcaatgcgaagccatagagcattttaaggagaaagatccgatcacttgagctgtagtgaagacaataactctagaagttttgccaggaaggggaattagtgagataaggctttagtcaacagaatgtgggattgagggaaaggcttttttttccttcttcttttgaaagcaaaagatgagtgaaactagagtttgcttgaatactaatgaaaggatccaacattgcaagaggttaaagggagatccctaagaattgtgaagggaaacttgaacagctatggagtttggcttttttgtttttagacggagttttcgctcttgttgctcaggctggagtgcagtggcaccatcttggctcactgcaacctctgcctcctggcttcaagagatactcctgcctcagccttccgagtagctgggattacggccaactgccgccatgtctggctaatttttgtattttcagtagagacgagatttcaccatgttggccaggctggtctggaactcctgacctcaagtgatctgcccgcctcgacctcccaaagtgctgaggttacaggcatgagccattgcacccggcctggagtttggcttttaagaaaaaaacttcatacaataaaattgactttatttttgttatatacagtcctatggattttaacacatgtacagattgaagtaactactaccaaaatcaggattcaaaagagttccatcaccctaaaaccgtcctttttgctatctctttagtcattccctccacccccttagctcctggcaatcactgacttactctccaaactataatttcaatatttgtatgtgtgtcatttgagactgacttagtttacttggcataatcctttcattattatgtagttataatgcctacttgttgtgtatatcaatactttattctttttattgctaatattccattggtgttggcttctgctggtattccttaggtcagcaaatgataccattattctaacaattacttgggccaaaaaccttggcatcatccttcactctcttctctagcctatacaaccaatccatcagcaaatcttagtggttccactttcttatctttttatttagttattttttttgagacagcgtctctctctgttgcccaggctggagtgcagtggcatgatcatggctcactacagcctccatctcctgggctcaagccatcctcccatctcagccctgactagctgggactacaggcacacaccatcgcacctggctgatttttgtatttactgatagagacggagtttcaccatgttgcccaggctgttctcgaactcttaggcacgagcgatccacccgtctcagcctcccatagtgttgggattacaggtatgggccactgtgctcactggctcgctcagccagctccactttcaaaatacacgtggaatctaaccacttaccactacctccactgctgttacttagttcaggccaccatcatcttctgccaagattagtgcttctactcttaccccttaccctcatagtctattctcaacacaacagctagaatgatccctttagagatataaatctgatcaagtagctcttgtgttcagaactctccagggctttcagtggtgaccggcaaaattgttgccataattgagaaggccctgcatggtaaggccccagctaccttttttatctggtctcttagcactctccccatcactcactctgaatcaacatagtgatctccttgctattcccatagcacctcaagcaggctcctgcctcagggcatttgaatttgctgtctcctctgcctggaacactctccccctagatatctacatggcttacacccattaagtcaaggccagtttctgcttaagggctccttataaattcttctctgactaacatctaaaatagcagctacctgacaccactgtctaatccctaccctgctttgttttcttagcatatatccctgacattacatacttgttttctctcctcgaactagtaaagatccttgcgagcagggaatttgttttgtccattgctcagtaagcacctacatgagtgcctggtctggcatatagtgggagttgaatgaatatttttgattgaataaataggaggtaaggacaggatgggaaggcaagtaagtaggtttctcgatttcaggacattctacattttctgttacttacatgataaggaagtcaggggaagtggtaagggtataggtcagagatttgtagagatcgtggagagcaagttgactagaaaaatataatgaaatttctagtcacagttcacagtcctttttttttttgagacggagtcttgctctgtcaccccggctggagtgcagtggcgcgatctcagctcaatgcaaactccacctcccgggttcaagcaattcttctgcctcagcctccaaagtagctgggattacaagtgcttgccactgcgctcagctaatttttgtatttttaatagagacggggtttcacaatgttggccaggctggtctcgaactcctgacctcatgatccacccacctcagcctcccaagtgctgggattacaggtgtgagccgccgcacctgacccacagtccatttaaagttggtctttattaatgtagtgacgccaatctgttcagcaggacactttttctttttttgaggtggagctttgctcttgttgcccaggctggagtgcaatgatgcaatctcagctcactgcaacctctcctctcaggttcaagctctcctgcctcagcctctggagtagcagggattacaggtcttcaccaccacgcccggctaatttttgtatttttagtagacagggtttcaccatgttggtcaggctggtctcaaactcctgacctcaggtgatccacccgcctcggactcccaaagtgctgggattacaggcatgagccatcgtgctcggcctcaacaggacaatttttttgtttttgagatgaaatcttgctctgtcacccagactggagtgcagtggcgtgatctcggctaactgcaacctccgccgtccaggttcaagcgattcttctgcctcagcctccccagtagctgggactacaggcatgcgccaccacacccagctaatttttgtatttttagtagagacggggtttcaccatattggccaggctggtttctaactcctgacctcgtgatccgcccacctcggcctcccaaagtgttgggattacaggcatgagccaccacgcccagcaacaggacaactttctatgacaaggtacaagcaaggagaaacacataggtccatccagggtgagggatttcgttggggaaaaaggagtgttgtggtgggattaagattaagtaggggcaggactgtattaatgtaccactgaatctaaaatggataaggaaggaagtgaagaggggattaatgtataagagataaagtagaggctttcaaccgattagatgctctgctctgataaagtgaaagaacaggccgggtgcagtggcttacgcctgtaatcccagcactatgggaggccgaggcgagcggatcacctgagttcaggacttcgagaccagcctggccaacatggcgaaacctgtctctactaaaaatgcaaaaattagctggcttggtggcgcacacctgtaatcctagctactcgagaggctgaggcagtagaattgcttgaacccaggaggcggaggttgcagtgagctgaggttgcgccactgcactccagcctgggcgacagagcaagactccttctaaaaaaaaaaagtgaaataacagtaataacagttatgctgtaattctattttttttggggggggggaacagtgtctctgtcacccaggctggagtgcagtggcacaatcatggctcactgcaacctccgcctctcctgggctcaggtgatctcccacctcagccttccgagtagatgggaccacaggcatgcgccaaaacgcctcattaaactttgtattttttgtagagatggggtatcgccttgttgcccaggctgctctccaactactgggcccaagagattcgcctgcctcagccttccaaagtgctgaaattacaggcgtgagctactgcatcaggcctataattcaaaagtagtcaagctgagagaatagcaggctgtggttgaaaagagggttgttcaaattactgagtcgtgacgcgatagcgtttggagggacaaggtccaggttttaactgggattgggaggctgatataagggtcgctaaagacgaggcccgatgttgaatgggttggccacataggctctgaaattatcaaagatggtcagacgggagacagacaaggagctggatacacagatcggcagattatctccaaacggggtgaagtaggtgacagagtctaaggggaagggctgaagaagcaagtgtttttacaagaggtgacagcacctggcacataatcccgacctctgcaaactgagacctgagaatactaattcatgtgagaaagtttcaagggacgcaacattctcgggacagccaggtctctgtcccaggaaggagcggagaagtttagagacaagctgatctaaacacgagaacctctgaggaagaccggcttgaaggcaggagattgaggaggggaccgaagcgacggcaaaccctacactcctctgctctttagttactttcctcccagccaaccgcccaagccacaccaacctccgcaatagaaaacgctcggagaacacgatctcccgcccagctcttttcaactccccgcggaagtgctcacaccggaacccctctgtgtccgcactttgccattggccgaggcttccgcccgcttccattcgcttcctcccacaactcagtcgggctgcgcggtccgtaggagtcacttccgcctcgtcccaccccgccccccggtccctttctagcagcttccggcttcggtcccgccccgccccctgtggccccgccccgcccccgcccccgcccctggctggcggtccagccccgcggcgccgcttccggtgcgggccccgccccggctgtggcccccggctgcggaggagtccgagacgcagctgccgcgccggggcctgagctgccgcctcctccgccgcccgaaaacccggagtgccccgcacaggtaagtggcccgggtccgggctccctcaggcatggcgggagaggaggctgcgacaggtggaggggccgaggccaggagccgaggcaggtgtagagagagaggggaatgcgcgagtcgggggcgcggggaccgcgaaggaaagtgagagcgccgcgggagccccgagcgccctgtgcccattagggcatttgagataaagcgtttgagataaagcgatgagaagggtgaggggccctggagctgagtgggcgcgcagataggtggggcgggggccatcggaagagccagcggattggctgggagggttggtagaggtaaaaatgatagggctgaatggggggaggtgaataaagaatggggggaggcgtgcaggggtgaccgggaaggtgggctgtggggcttacaggggcccggggccaaaagaatccggcagcaaaagcaggggaatggtcagcaggccgggttcaaagctgcaggtagtccgttgtacccggcttggtggtccgggaactttaggggaaatgggggaggggcccgtgtgaagggatgaagaggtttagatttgagacataagttctccaaatgtaggcaggtggcattgtttggatcgctggctgcttagggactgcgggaaaatgggctctttgggggagggtgtgtgtattgagttgtagaactgagtcatctcagtcttactataagaggctgtgggagggacacctccccctctgctggggacagcattcagagaagatggtgccacaagacaagaagcagttgttcagtgactggcaggacttggttgagaagttattccgatcgtgattgattgactgtaatgactatgaggacatttaaaatgaacaccgaattatttgctttattctgtaattttctttgacccaaattgttttcattttaaatgaacacttttgccaactgaatttaatgtggatgtaaatcttgtcatgcttttttacactgtaagaagagctaaagcagaatgaaagtattgctgcaagcgtaactcacactttctgaagtgccaagagaggaagtaaaggcagtaagaggcaaattggaatgcgaatctttcacagaacacaaaaggcacaaacagggctataagataaacagaaaatgagaatttttaatctctactaattggcctagctttaaaaattgtacccttttttactctaacctggaaaaaatcttaaatccaagcagtttttattgctgaagatgtgattacttctccgtgaatttttgaagatactaaagacactttgttttttgtctttcgacccaatcctaaaacactggaacaatgcagatatcaagtcccaacatgtgcagtgcagcttctttcatgtgatgacaaaattgtacgccatgttgcaagtcctgttcacctaaaattgcccttgcatagtaatccattcagttatggagacttgctgaagaaacataactcaagtgaagtttgttgggggtgagggcctgcaggggagaggtgggggagtaaaaggagaagagggtgtgaaagtgatgtgtgtttggagactgattggtaagaatgcagataaacctgcccccagaatgcttttggcccgaaagacttttctttttgtgtttgtcagagaatatcataatagaaatgaatcagaaagaaaggggatgtgaagagatttacttcgctgtttataaaaaagaagcagcattaacttgttgttcagacaatgttgatatctgtttcaaattaattaactttaaaatctccagaggaattcccccgtttgcttttgagtgacgattgcaatttgagactcttgcctccttgcgtgtttctttcatgttgttgaaattggattctttttgaggctataatgtccagttagtatggctcagtccactcaacaagcaggctggcaatttgatcagggaaatttgaaaagcttagacccaagagcagcttgcttggtcttgctttttctatgagagtaaaactgtctgcctgatagttctgtgtctagcttagaggtgatatctttctcctgtgggcttgggaacatactctctcctttgcaggcaggtccttcttttcctttattattgttgtttgcataattatgcttctgctacagtgcaaacccagttaccttttcagtaattaatgttcagtaacattagttcagtaacagattaatgtttgataatgtagaggaagagagatcagaacacgttagcagactagatattggctggatgtacttcttttaaagcctgctactactactgaaattcattccctatttcccctcttagatcctgtttctcttcttcacaccttttcctacccacccacgaaacccccaccactcactcatcttaaaactcaggtttaggagcatatgtttagcgttcggaactcatggccctctactggagaaaaggaaacctttttatacctgcttaacatggttgttttttccccctccttctttgtggtttctgttaatcactaaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcaggtcagtctttctggtattgtaggtcatttggtcttcctgaaggccagagaggggtcatggactgacagggtcaggggctgtgccagtctgtgccttctcaccccacttcggtgaccaacagcctagacatgaatagactttggatttttttcttatttaatatttattttcttcattaaagcaatgaaatatatgttactctttttttttttttttttttgacatggagtctcactctgtcacccaagctggagtgcagtggcatgatctcggctcactgcaacctccatctcccaggttcaagcgattctcctgcctcagtctcctgagtagctgggactataggcgcgtgccactatgcctggcttattttttgcatttttagcagagacggggtttcaccgtgttagccaagatggtctcgatctcctgaccccgtgatctgcctgcctcggcctcccaaaatgttgggattacaggcatgagccaccgcccctggcctgtatgttactcttaatataggttttgccaagtttgatgtgaaagaatgtcaatacaatcttcttttttaaaggaaggatgaagttgcaacagtgttgtgaggaatatctaaaatgagatgtgtgactaattacagcttttctaataataatgtttctaacagtaatgtaaaagaaagttcttgcctaagacagtttcttagctccaggctaaccctctttaaggacagttggttgttttggagctaaacacagctgacaagaagcacttgcattgtatatattttccaacaaagagccttgtagacatgatttcatttcactcttacatcatccccttgacaacagggaagggtagacctcaaaatttcctttttagtcaaggaaagctgaagtgacttccaaatggctgagtatcagagtcagttagggagctttttaaaaaatacagattgctgagtcctaatgaattatcttggagggtggagcctagggaatctttgttttcaaccaagcctcttctctttgtgacccataatatagtttttcctcgcccaaaggatgggagtgatgataagttgttccagcttaagtgacttgttggtgcttagtaagggagttcatgggtaccctgcagaagcacacacacttcttgtgatccagtggtactgtttagaaatcatttgtgaaaagctgtgggttttcacagggcaactgagaagtcatataagaaaggtcctttggaacccaaaaaatcaaacatcttggatcaggaggtctgtacagtagatctgagttttacaacaatagtgtttgcagccagcagtgggattcaaatcccatcacttccaaatattgcccttgtgatcttttagtagggctctgatttgctctgagcctgtgtcttctcatctgtgaaataaaaagagtgccactgcctcccatggatgttgtaaggattaaccgagctagcacatgtgaaagcttgtccagtgccaggcacatggtaggtaatagtgcccgggggagctcttttatgtaaacagtgccatcctctcctgcatcacatagacatgcctctgaagtgggagatgtactgagatacacagaggttttcactcatcacccagggagatagtggcagagctaggactagaatcagagaatcccaacttccacgacagcagcaccctggccgccagcccagacccgcctcccactgattgctttggtttagcaaaacatctgtgagttgccggctgcccccgcactgctgtgtggttggcagagttccataccggccgctgagtcagctcatagcaggatcctgccctgacagcgctgggaaagttcaggcccgaggcggctgggctgcccccgccttggcagctggccagcgtctgcgtgtgtgcggtcgttcctagaaagtgcagccgcatgcgaggaacaagtggagctccagagcctgtctgtcttcaggaagtgtagcaggtgttgaggtcaagccattagaggtttaaaaaaagactcttcagaactggcgtgtgcatgtgcacacgtgtgcaccgtggcagggcacccagcatcatgttatctagatggtggcagccctatgactacgtagctcagtattcagggggctggctgttggcatttgaaactctttgcgttcactttatgtttctgaggcatattcactaattatagactgcttggcagagcacctgccaaaatgttttataaataccacagtagctgaggtataatccctcacccaaaatttaccttcccccaggatttggagatcaagaactgaactggggggctttgggtagcaatgacttaaaccgtcagatgtgcacgtccttttcccctttaatttttaacattgatttgatctgtgctctccttttctataaatcctgattttaaaggagtaaatcatatgcttggggattttaaaactttttttttagtatattttagaagggccaaaaataataatattcttggggagagcctatagaaaccattacagatcattagactagcttgttttgttgttcaaaatctttactttatgaaacttaatggagtgcaaaaatagaatatcccttgctccagcaacaattacaaagacctttacaattgacacagatctttcccccccgccttccccctcccccgccgacacagagcgcactctgttgcccaggctggagtgcagtggcgcgatctcggcttcctgcaacctccgcctcctgagttcaagtgattttcgtgcctcaccctccctagcagctgagattacaggcatatgctaccatgcctggctaatttatttttttatttttatttatttttttgtatttttagtagagacagggtttcgtcatgttggccaggctggtctcaaactcctgacctcaagtgatccgcccgtcctggcctcccaaagtgctgggattacaggcgtgagccaccgcgcctaccctgacacagatcttattgttaatgtgatacagtgtccatcttgttcttttgaacaacaaacttttacagaggcttctttgtgccagacctgtgctgtatgaaacaaggcatgtttctctctcagggagttcaggtctagcggtggcagtgtgggaacctcaagggggattcgaacttgggttacaataatttgattctgtcctgagtctactggagcccagccacccagtctgctatggcagagatattttaaaacagagttttgtttcaaacattcacatgccaaagtttaaaaagttaattttgtctacagcatagcatagcttggcaaaccaacaggaatactcagaagtattttgcaagattttggggtaagggaggacaggcatctgctaactgaaaagtgaaactgggaaagcttaagggttccagagattattctttgcatctgaaatcccttacttagaacatgtaaagtcaaaattatttcgtggattctctttgaagaaactcttagaaaatatttgcttctcaaggcctggattgttaaggtgtggtattattctctgacaccacagtgatgggaagatggataacgccattgagccaagtgttctaaaacccatcagattcctatgggcagagtaaataattgtaaaacaagaaaacagacaaagaactgagtgttccttttctcaaaggagatcatacagccaactaggggatgttgctggccttttgggggtggtgttctccccctctggtagaaggtggttcaagcagtacaggctgggtctgtcttgagcccattggtagagctaggttactagaagggtgtagacccccttcgatagaatagaaagaagaaagatggcttggcaggcatgtggggccagggtgcatgtgtccgattttctgcatactttggcagtcgctttggttactgcatgtggctgtgatccaaccacgggcttaacatactttcacagccaattcagttgaaagcactgggagccattgcacaataaatgttggccccctcctctacccttccccttctagcatgttttacaagattttgttttgtgactgccttctaggatggaagggtttaatttcagaatatttgcaattaaagaattcctaacgtcctaaagcttgctaatcacatgtgttaacaaggacagggtattaccaatttcaaacacctccaagccgcttggggcaccctcagctcatgacagcgtgggttctctctgaatttgttggagaagcacttctgcagtacagaagcaaaggaagctccatgacaaatgggaagaattgccatgttagatgggcactgggagagacaaagggaatgtgatttgagaagagggagtttcgtgtttgtttttgtttttttggggttttttttgcctattcttaaccatgagcaaaatcaatctcatcttaccgtgagagtcgacttcctgctgggcaattagtggagactactgtccatttcttctaatgccatgactgactgactggtgtccagaagccatccctctaattaaggtgtagtcccttgggataggcctacttttctttctttttttttctttttttttagacggtgtctcgctgtcactcaggctagagtgcagtggcatgatctcggctcactgcaggctccaccccccggggttcacgccattctcctgcctcagcctcctgagtagctgggactacaggtgcccgccaccacgcccggctaatttttttgtatttttagtagagacggggtttcaccgtgttagccaggatggtctcgatctcctgacctcgtgatccgtccgcctcggcctcccaaagtgctgggattacaggcgtgagccactgcgcccggccgggataggcctacttttcttggtagatactgcatgactatcattagctgggtgtggtggcacacgcctgtagtcccaactacttcggcaggctgaggcaggaaaatcacttgaacctgggaggcgaaggttgcagtgagtcgatatcatgccacttgcactccagtttggatgacagagtgagatggtgtaaaaaaaaaaaaaaagggaaaaagaaaagatacagcatgactatggaacatttgaggcttttttaaaaaactgtgcaaagtattgcccaaaaaagaaaatgttcgtaggctttcctcatgttctttatagagctaccttgcatgcccttgccttctgcagtcacaatggaatccatctagttgagtggttctcaattagaggtgacccctgccccttcccaggggacatttggcagtgtcaggagacatttttgattgccatgactggagtagggggcagtgtgctatgggcgtctagtgggtagaccagggatgctgctaaacatcctataacgcactggacagccccccaacagcaaagagttatctggtccaaaataacagtagtgccaaggttgagaaaccgtgctctagattgtgcaaccagaaagaacataagcttcgctatcatcagacagcaccagagactcttttcctttgtgtttcagtctcagtaactgaggagtttggcagccttgaattttcttgacttctgctttcaatatctgtaccgagctcatgtctttcctctagtcatctaggtgaacagactgtcacttgggaaaggtttggggcctagaacttgagatctcttacttgactctatcagtgattctttcagcccagcactccatgatatctttgatatctttggtgatatatgagagagcttggttgcccttgtagacattaaccccaaaaggttaaagtgtaaatacttggcagacttgttacctagtaacagatttaattattaaatcagcattggttttggagccagaggatgtggattaagaccctacttcccgccaggcgcagtggctcacacctgtaatcccagcactttgggaggcggaggcaggcggatcacgaggtcaggagatcaagaccatcttgactaacacagtgaaacatcatctccgtctctactaaaaatacaaaaaaaaaaaaagttagctgggcgtggtggcaggcgcctgcggtcccaagctactccggaggctgaggcaggagagtggcatgaacccgggaggcagaacttgcagtaagctgagatcacaccactgcactccagcctgggtgacagagtgagtgtccatctcaaaaaaaaaaaaggaaaagaaaaaagaccctgcttccactgcttgcttgctctagtactttggacaagcgttctaatctgcctctctgaacccatgcatcaatctattccagaggatgataatcctctcccgctatcctcaggaagtgattttaaggatattacaaaggtagaagaaaaatatgagtgtgaaagagctttgcagggttagggcgaattgtcatcaacacctaagtcctttttgaagctaccgtcgtccctcacatgcaggggattggttccaagacccccacatataccaaaatttgagcatactcaagtcctgcagtcagctctgtggaacccacatatattaaaagtcagtcttccatatacatgggtttcacatctcgtaaattttgtctttgatccaagttgggttgaaaatagtttacatataagtggacccaggcagttcaaatccacgttgaagggtcaatcataatttttcagtctttatgacctttgtagataagatgctccataaatcctacccactactctaaaacaactccttttcaggttttctagagccctgaccacactctggtgttctgaagttctctgaaacctttcaggattatgtgagcttaaaccatggcgcttctgaagctgtatctttccgtattagcatagggatatgtgtgtattgttctttaggtagaagtaagctttatagatactaagtccttataaatacacaatcactgacttgacttgggtccttaccctctcaccagaggctaatttctctacatgtgtcccagatcccatccccttccaggtttccagggacttgctccatcagtgaaccctccatttcctgactctttgggctcattctcttccaggccttttccacgtttacgcatcttctctctgtcagacttaaaaacaagcaaacaacaacaaaaacctttaatcttaaattttacctgagtcagttgttaacaaggaaatgagagaccacttttaaaaaatttcctcttgattgcacattattgccagctttttttctattcctaactatcccccacatccttgcaacaaagcttctcaaaggaattggttttactctttatttccatttgtcacctcctactcactcctcagcatactccagtctgatctctgtttcttccatgtccctgaagttccatgttgctaagcccagccttccctgacctcattgatttctcagcattattgaatacagagcactccctccttgaatattctcttcttttgctttctatagtccttcattctgcttatgcttattttcttttccttttcttttttctttctttcctttttttttttttttttttttctgagacggagtctcgctctgccgcccaggctagagtgctgtggcgtgatcttggctcactgcaatctccgcctcccgggttcaagcgattctcctgcctcagcctctcaagtagctgggacaacaggcgcatgccaccacgcccagctaattttttgtatttttaatagagatggggtttcattatgttagccaggatggtctcaatctcctgacctcgtgatccacccgccttggcctcccaaagtgctgggattacaggcatacaccaccacacccggctaattttgtatttttggtagaaacggggtttctccacgttggtcaggctggtctcgaactcccgacctcaggtaatccacacaccttggcctcccaaagtgctgggattacaggcatgagccaccacgcccagcctattctatggattttgacaaatgtgtaatgacatgtatccgccattgtagtatcacacagagtagtttcactgtcctaaaaattctctgtgcttcacctattcatctttccctcccccttaacccctggcagcccctgattcttttcctgtctatggttttgtctcctccagaatgttatatggtgggatcattaatgtagcctttttagattggctttctccacttagtaatgtgcatttaagcttcctctatatctttttatggcttagtagcttatttctttttgtgctgaataatattttgttttctggacataccacagtttatccattcacctcctgaaggacgtcttggttgcttcaaagttttggcaattatgaataaagctatcatacacatctgtatacaggtttttgtgtagatataagtttcagtttatctgggtaaataccaagaagcgtgattgctggattgtgtggtaagagtatttttagctttctaagaaactgcccaactgtgtctcaaagtgggtgtaccattttgcattcccgtcagcagtgaatgagcttctgttgctccacatcctcaccagcatttggtatcgttagtgctttggattttggccatgttcctttaactgaaatttttatttagctaattatagattcacagggagttgaaagaaagcaatgtcatgtacactttgtccagtttccctatggtaacagcatatacaggtatagtatgctgtcatacctggatattgatgttgacatcatccactgatcctacttagatttcttcttcagttttacatgtactcatttgtgtgtgttctgtttttaagccattttagttttacgttgaacacattttttgaaattcttgttacttaataaatgcattcaaggctatagagttttccctggatctcacttttgctgtaccccacaagttctgatgtgtagtggtttcattgttggctagtactaaacattttataatttcagttttaattgcttcttcaactcatgggttgttaaaagtattttttggttcccaaatatgtgggttttatctcttttccagtattattttatagcttgattacattgtagttgggaaacgagcatggtatcaattctctgaaatttaagatattctttatgttggccttatgtgtgattagtttctataaatgttccatgtgtgcttggagagaatgtatgttaatccatttcattataaggattagtgatacatttggatctatttctgccctcttttttttgttttgttttttaatttttatttatttatttatttatttatttattattttttgagacagagtttcgctcttgttgcccaggctggagtgcaatggcacaatctcggcgcactgcaacctccgcctcccgggttcaagagattctcctgcctcagcctcctgagtagctgggattacaggcatgcaccgccacacccagctaattttgtattttttttgttgttgtttattttttttgagacagagtctcgctctgtcgctcaggctagagtgcagtggcacgatcttggctcattacgagctccgcctcctgggttcatgccattctcctgcctcagcctcccaagtagctgggactacaggcgcctgccacaacgcctggctaattttttgtatttttagtagagaacggggtttctccatgttggtcaggctggtctcgatctcctgacctcaggtgatccacccaactcggcctcccaaagtgctgagattacaggcatgagccaccatgcccagccctgtttgtttttgagatggagcctctctctgtcacccaggctggagtgcagtggcatgatttctgctcactgtaacctctgcctcccgggctcaagcagccctcccgcctcagcctcccaagtacctgggattacaagcatgcgctaccacactcggctaatttttgtatttttagtagagacaggatttcaccatgttggcaaggctggtcttgaactcctgacttcaagtgatctacccgcctcagcctcccaaagtgctaggattacaagtgtgagccacagtgcctggtcatgccctcttattttggattttcaatttaactatacttttcttgttttctctttttctgtcttgtattgatttgatcgagttttatttatttagcctttatgtcctttgctggtctagaaattatacttttctgtttttattcttctattggttacttttagattgtaatttatattctttttacactaaaggcatatctcagagatattgcaggttcagttccagaccaccacaataaagcaatattgcaataaaataagtcatacattttttgtttcctgtataaaaattatgtttattctctggtctattaagtatacagtagctttcattatacctaaaaaaaaacaacaatgtacataccttaactaaaatgttttattgctcttgaatgttcccagcacaaagaaatggtagatgtttgtggtgatggagatgctaattaccctgatctgatcactatacataatatgtatgaaaacaactctgtgtacctcattaatatatataattattatttgtcaattaaaattaaagtaatactttattacaagaaaaacaataacaagtatctgagccttcagcgagttgtaatctttttgttgatagaaggtcctgccttgatgttgatggcttctgactgatctaggtgctgggtactgaagcttggagtggctgtggcaatttcatagaataagacaacagtgaagtttgctacgattgactcttttttttttcttttttgaagcagggtctcactctttcacccagggtggagtgcagtgacgcaatcacagctcactgcagcctcgacctgttgggctcatgtgattctcccacctcagccttttgagtagctggggccacgggcatgtgtcaccatgcccaactaatttttaaaaatcttttgtagaaacagggtctcactgtgttgcctaagctggtctcaaaactcctggttcaagcaatcctcctgcctcagcttcccaaagtgctgggattacaggcatgagccaccatgcctggccccagttgctattttgacctcctcccatgaatcatgaaatattcttgatgacacctagaacagtgaatcctttccagaaggtttccaatttgctttgcccggatccataagaggaatccctgtctatggcagctgtagccttacgagctgtatttctttttttttttttttttttttttgagacggaatctcaccttgttgcccaggctggagtgcagtggcacaatctccgctcactgcaagctccgcctcccaggttcatgccattctcctgcctcagcctcccgagtagctgagactacaggcgcccaccagcatgcccggctaattttttggtatttttagtagagacggggtttcaccgtgttagccgggatggtctcgatctcctgaccttgtgatccgcccgcctcagcctccgaaggtgctgggattacaggcttgagccaccgagcccggctatctgggctttcaacatgccttcctcactaagcttaataatttctagcttttgatttaaagtgagagacatacaactcttcctttcatttgaatacttagaggtcattgcaaggttactaattggcctaatttcagtatggttgtgtccaagagagtagggaggcccaagaagagggagaaagatggaggaacagctagggtggttggtggagcagtcagaatacatacaacatttatcagtgaagtttgatatcttatatgggtgtgattctaggctctccaaagcaattacaatggtaacatcaaagatgactgatcacagatcaccataacagatgtaataatttttttaagtgtgaaatactacgagaattaccagtatgtgacagagacacaaagtgagcacgtgctgttagaaattaggtgtgctgtgctttcaaacattggtaccttagaaattctagttttaacatctacctctccaatcctatttaccagtttatagtggccagtattttagttctaatttgttttaacccgtccccaaattagtttttttcccctcacagttattatttatttagacttacgaagtttatccatttcttttctcaccattacttgatcctactcattccctctgggctcactttccttttccttttttcttttttttgttttttgttttttttttttttttgagacggagtctcactctgttgcccaggctggagtgcagaggtgcaatctcggctcactgcaacctctgcctgccaggttcaagcgattcttctgcctcagcctcctgagtagctgggactacaggcgtgtgccaccatgcccagctaatttttgtatttttttagtagagacagggtttcaccatattggccaggctggtctcgaactcctgacctcgtgatccacccgcttcggcctcccaaagtgctaggattacagacgtgagccagcatgcacagcctcctttttctttatttactaactttttttagcagagacttatatgtaataaaagtcttggccaggcatgatggctcatacctataattccagcactttcggaggccaacgcaggcggattgcttgagcccaggagatcaagaccagcctgagcaacatgatgaaaccctgtctctaccgaaaaaaaaaaaaattagccagataggttggtacctgcctgtagtcccagctacttgggaggctgaggtgggaggatctcttgagcccaagagatggaggctgcagtgagctatgatggtgccatgcactccagcctggatgagagtgagaccctgtctcaaaaaaaaaaaattgtggtatgtttgaaactttcaaaaaatctttttattttgccctcacttttgtacagttgttcatagctttagattctacattgaccattatttttttcttcacccttaatgataagatttcattgtttcctaacaactgtttttgctgttgagaaatctagtgtcagtctgttaatctttttctagctttttatttaaagtgagagacatacaactcttcctttcgcttgaatacttagaggccattgcaaggttattattggcctaatttcaatatggttgtgtccaagggagtagggaggatctttttctctcttgtagcttttaagattttttctttttgactctgctattctgcactttaattacagtattctaggtttcgacttacttttttttttttttttttttttgagacggagtctcactctgtcgcccaggctggagtgcagtggcatgatctcagctcactgcaagcactgccttcagggttcatgccattctcccgcctcagcttcctgagtagctgggactacaggcgcccgccaccacgcctagctaattttttgtatttttagtagagacagggtttcactgtgttagcctggatggtctcgatctcctgacctcatgatccgcccacctcggcctcccaaagtgctgggattacaggcgtgagccacgcgcccggcctttcaacttacttttattccacttgggtctctgtctgctccttcaatctggtttgtgtcttttttttttttttttttttgggtactattttttcttaaccagtattctaatagaagtatttgaacctcctcattcagtctcctgtgcgtcttttcttttaaaatcttatgtatttatatcattctcctgcattctggattattttcacatttaattttctaatttctaattctgtcttcagctctatctgttctactttatggctctttaaaaaatggtttgtcgtaattattgtgtttgtttataaattttttggcatttaaaaatctgcctgtttttactttatggtttctattccttcagctctttgaacatctttgactttttaaaactttatattggaattgctaaaactcatttatggaaatttcatacatacaaaaaaaaaagaatagtaatgaaccatctgtgttctttaatcagctttcaacaagtatcaacagtctgccattctttttaaacatgcttattttaaagatgcttttagagtctattattatctctaattcttggggtgcaagttcttcctgtgtcatgttactgtcccttaagatggtttatttcctcttggtttgtttttgttttttttccagtgtaaattcattttgagtggggatttgtttctgtaggaatcccatgtgccttggatggtggaagcattcctaaggggagttttgtttttccctctgctggggctgcacaagtttagctcgttgcattggtttgggtagtgtgaatttgaagcctacatctgtgcctagtgagagcccctcaatatgagtcccctgccagatggcacggttccttgcagcttcgccgggctggtgggcagtgtttttaggcccagtttatggcgggccatgtagtctctcatggcctctggctttatgcagttgtttctgttctggttcctggcatgcaggggcctacagcctggactcccttctcttggggttgattcagtctccagctctcagttcagcactcggctcttaagaaccctattcgggtcatgttctcccttgagcccttcagctttgccacttgctcactgattgctaccattttgtttctgctgctgtggactctgctttctttctgggtttcaagctcagctatgtatgcaacgggtagagtgttaaatgttatccagcttttctatgtgaggttttctttggggaagaagcgagggagatggtggagttccttcacatcagactatcctcactcacagttttgtttgcttgttttcttgtttttgttttttaataactaagactttttgacctcttatgtgccaagtaccttatttcatttcattgtgtgaggcaggtcctaatattatcccctttatgtgtttgttttatttacagatgagggaaaaggtcaagtgggaagcttgtggtctcacagttgggaagctggctagtgaacccaggtggtctgacttctagctccatattccctcttgctcccttccagatagaacaggagaaaaataatctttccttagtggttttattactctgcaaatgacttttacttattttttctgattgtcaaggtaatgcaggctcattttagaaaacatggaaaatgtaaaaatttgtaaagaagaaaatacaatcactacagccacataacttagatttaatataactataaacatttgttgtacttgcgttttgaagaaaaatgcctactatagatacagttttaaattttatatacaggctgggtgccgtggctcacacctgtaactccagtactttggaaggccaaggcaggtggatcgcttgagcccaggagtttgagaccagcctaggcaacatggcgaaaccctgtctctactaaaaaaaaaaccacacacacaaaaattagccggagtggtggcacacacctgtaatcccagctactcaggaagctgaggcagaagaatcacttgaatctgggagatggagattgcagtgagccacgattgcaccactgcactccagcctgggcaacagagcaagactgtctcaaaaaaaaaaaaaatttatatacaattttgtgcttaacttttatcacctaacaggccttgagcaatttaaagtattactttaaaatattttagttttcaaagtatattacagaagtaataataactcaaataattttagaaatttggaaatgtatgaaataaaagtctgactcttcaggtgtaattgttaacagtttggtctacaccttcttggagctttttcttttcacaaatatattttgtctgttctacatattgttctaccacttgcttttgtactctgctctggcagtcctccatgagtgttcatgaagatctatttttcgtgtttttataattatttatttaaaatcacataagcggtatgaataggtgctcatgaaaattaaaacaatatggaaaaatacagagtaaaaattcgtagttaaaaaaataccatggtgtcctgttgcctgtcctgtgtccttacacctcacaagtaggagtgaatcagcttctaggactgtttctgtgtatttactgactgaagtgtgcagtcacagaacatgtgagtgtgaatgtacttgtgtatgtgtgtgtagtatgtgtaaccctatgccctggtatatgtatttctgtggtgggatagattattatagatgttgattaggtgtctatgtatatgttagcttttcaatatatactgttaattaccctcaaagatattactccgctttgctaccggtgatatattttcccaaacccttgtcaacattggttattatcagtccttttatttttgctgtcttttcatatgtttatgaaactcctgggctcaagcaatccttgtgcttcagcctcccaaagtgctgggattataggtgtgacccaccgtgcccagcccgtagtttgtctttcaacttgatgtgtggttctttaatcaagtaggggtttaaaattttgatatagctaaatttattgatttttctctttatggtttctgtcatacttgagaaggcctttccctaagattacaaaaaatattctctattcttaatactttatggttgtgtttttaatcgtagctctttactacatctagaatgaatgagaaggatgaatagaatgaataggaatcaagtgtgtttaaagagtattgctatttttgatggctgcataatgttttatcacatggatagcaccttcatgtgttgcccattcccttaatgtcagacatttagactgctttaaattttttactcttataaataaaattatactgtatttctagttatttccttaggatagagtcatagaccagaattacaagatcaggaggagactaagaaagtgaggcagttataagcagggacttaaagctgccctgcctgcaattgattcccaactccaccatttggtcactttgtaaccaagtcactggacttccttttgctttggttttctcatctgaagagtagggataataatagtacccacttcagagcactgtgctgaggattaaatgtcaatacatataaaatgctggaatagtgcctggcaggtagttagcacagatagtccctgacttaagatggttcaactcaactatttttcaaccttatggtggtacaaaagccatgcacactcagtagaaactacttcaagtacccatacaactattctgtttatcctcttccattgtagtattcagtaaattacaagatactcaacatgttattataaaataggctttgtattaaatgattttgcctaattgtaggctaatatatgtgttctgagcacgtttaaggtaggctaggttgcactccagccctggcgacagagcaagactctgtcttaaaaaaaaaaaaaaaaaaagcaggctaggttaagctatgatgtttagtaggctaggtgtattaaatgcatttccgacaacggtattttcttttcttttcttttcttttcttttttttgtgagttgaagtcttgccctgtcgcccaggctggagtgcaatagcacgatcttggctcactgcaacctccacctcccaggttcaagcaattctcctgcctccacctcccgagtagctgggattacaggcatccaccaccacacccagctaattttgtatttttagtagagactgggtttcaccatgttggccaggctagtctcgaactcctgtcctcaggtgatccgcccacctcggcctcccaaactgctgggattacaggcatgagccaccatgcccagtccaatattttcaacttctggtgagtatattgggttgttaacgccatcataagtatttttctgttttctgagacagggtctcactgtctcccggggggaatgcagtggtgtgattgctgctcactgcagcctggaactcccagtctcaaccaatcctctcaccacagcctcccaaagtgctgggattacaggcacgagccacctcacctggtccccatcataagttgaagagcacgtgtactcaattattagttgttgctgctgctgtttttattgtgataggcattttaaggcaagtgactttccagaaagtcatactattttatatttccagtatgggaatatgggagatcccattgtaccaacccttgttgtcactgaaaattattttttgaagctttgctaattttacatatgaatcatgggccccttttttaaaaatacaaattcttatgtttagctcttgggccttaaaatttacctgctatctttaggaaatgacttatattgccttctagaccccttttctagagttgtcgtttagaactagcagcccaccttcttttaagtgtgttctgattttccccccagattattcacttagcttgtgctgagtctcctaagtttattcccgttggcttgttcttcaggtatcaacattcatttgagcctcgaccacctgtcaggccctgtgcttgatgcaccagcctcacagaggagtcaatcactatccccatgtgagagagcctcagcctggtagaggtggccggtggcatagggacagttgtcatcagagaaggaatgtgtatatcatagtagcaccccaggatgggggtgtggacctggaggaagccttaggagaagctctgagaaatctgtgaatgcagctgacttttaaacacaaactgtgactgtgttctgcctgaggacacccaaacttgtggaatcccaaatttgaaaataaaggagggattttttaactttgtaaagtaacttatgatagtaatttttaaaaatgttgttcttcctatacatttaaaatgtgttgtttggggggaaaaaaaagttttatgaaacttttgggcaagtttccaacctcttaggtctgtttcctttctgtcaccagcgggtccattgaagtgttcttgtgctgggctctccaactctgactttgtgcaactctgtgtggagcctctgtggtgtggatggatgtcagcaaccattgtggaagttcaggtggtagctcaagggttggagtaagccgtagtgctgccaagtcagattctgcagagaaaaggagctaggacttacttacctctgtggctctcggacttggacttggctgggccagttcatgccttggtatcagggtgtcctcatcaccaacaatgtattttagtttttctgccacctttggtaggaacatctatttctgggaagtcttcttgatcattgcatggagtgattctgtgcttagtggaaaggtgggaccgctgccctctcttcctcccctgctctgcccgctttctacagcttaatcagagaagtgtcctttagctcttttccaagccactgagtttgaattgatctccgctgctagcaagaggtgggaaggctctttctggttcctgctaaagttacctgacagcggaaggtgtgcatctgataattataactctagtgtttccaaggcctgagcgatttagttaagagcactaatcctgatcttatcaagagggttttgtagtccaacagtgttgcttataacagtatctgttttacttcctggggctcccctcccctcttaggattctcctgtaatcctgcccattatgccttgtgcatgtctcattacctcctgaaatcagttaaaactggtatgagggcaaagagcattttttcttttcttcataccaagatctgagaattggatttttaacattacatcattaatcaggccagcagtagagtagtcacaaatgtggtatacgtaatgcctgcagagccatggatctggccaatgataagatagtttatttgttgcttattaaaaacaacaacagccacagtcagcccaaatgctttagttacattttgtattttggagcagttagttgccatccatgagcttgggatcagcccctttgaagtctaacgattttctttttctttttctttttgagacagggtatcactctgtcacctgggctggagtgcagtggttcaatcatgactcattgcagcctccatctttcaggctcaagcaatcctcctatctcagcctcccaagtagcttggactacaggcacatgccaccacacccagctaattttttaattttttggtagagatggggtttcaccatgttgccaggctggtctcaaactcctgggctcaagtgatccacctgcctcagcctcccaaagtgctgagattacagtcatgagccaccatgtctggcctgaagtctagtgattttctaatgattactttgaggttcaggtcctaggagtttgcttaaatccttgaccttgggattcataatctatttgatttatagagaatagacacattactgttctgtgtcttttttttttaaattaattattattttttatttttttgaaatagggtcttgccctgttacccaggctggagtgtagtggtacaattgtatctcactgcaacctcagcctcccaggctcaagcgctcctcccacctcatcctcccaagtagctgggactataggcatgtgccaccatgcccagctaatttttttatttttttaattttgtagagatggagtctccatatgtttcctaggctggtctcaaactcccgggcttaagcagtccttccacctcagcctcctaaagtgctgggattacaggtgtgagccaccgcaccctgttctgtgtcttcagagaactctcaagaatctctataaaagttgtcagtatgcacaatggcaatttaaggacagggcagtttctgagaggttccaaaatatcaggaacccaagtgaagacttgttagctcagcccctgggctttaaaccccaaggaagggttaacccttgccttggggaggaatgaggtatgggaactaaaattgctttggacatctgagctgtgctttaataagatattccaggtggtcaaggagtaatcctaaaatagcctagatacttaattgcttttaaagtcaggcgcttctgtctctggggaagtgcagctctaaggaatgcagagctggctcctaagatcttagaagcatggtctcgttgttttttttgttttttttttttttaatcccagtaaaaagaaaaggcccaaggtagccttcttggatcaggagacctttgttaaatctacctctttcttctcattggaagattggcagtaagccattggcttctcctgctgccaggtgccataacctggcttcttccagggctgtgagattggtgttgtcaccccacctcactaggcagtggtctgttttcattagtgcttaaaggcttcctgcttgatcccctgtccagcctctgtttgcatcagaacatacctttctcactataagaattcagattaatccttctctttctctttcatcccctcaatccagatccagttgattctccatttatggcactgatttctccctcattctgctactctccgtctcccccagtcccacattctcagcttgggctactgcacagccacctacccccagtgcaggctttccctctcagattttcaataccatttacaaaatctgtcagcattacaagtcattactgaggggcattaaaaatatttttgattaaatgaaaaatcatactactctcttacttgtaattgaaagactaaataggccaggcgcagtggctcacacctgtaatcccatcacttggggaggctgagacgggcagatcacctgaggtcaggagtttgagaccagcctggccaacatggtaaaacccgtctctactaaaaaaaaatacaaaaattagctgggcatggtggcgcgtgcctgtaatcccagctgctcaggaggctgaggcaccagaatcacttaaaccagggaggcggaggttgtagtgagcccagattacaccactgcactccagcccgggtgacagagtgagactctgtctcaaaaaaaaaaaaaaagagactaaataaattttgtgaaggtgtccgttctatgagaaattctctatgatttcagtgcagcctggttccaaatcttcattgtagggtggaaagcaaatgataagtcgtgacaaatggttcagattaatctagaaaataatataatttttaaaataaaaaaagagcataattgcattttgtaattgtttgtctctctctctctccattagacagtaagctccatgaggtgatcatctgtcttgttccttttccttcagaaccttttaccataactggtaaattctaggtgatcaagtgtttgtacatgaatgaatataatggaaaaaaaaggaaaagtgaaaatcccccagttccaatccgattaggtgtctatgtacatttgtatgtttctgttattttttttttcaacaaaaatgggccactaaagcagtctaaaacattgatttaatcatgtgctttcctgtccagaaaacatccactgcctccccactgttcacagttcagagtttaaatttccttctggtattcaaggcatctcacagcccctttcaactttaactattcagactttctgtccttatatcctccctgtcaaaacatgccttgtttataccccactccatgctcatttagactgcaaatctcccttcaacccattcttcaaggccagcttaacctccacctctaagccatccagccttttcttctacctcctgagtaccttgggttttcctatttgttgtcttgctattatatgctatatgtgttcagtttgtttttccaacttcatggtaagactcccagtggtgggaacaattttttttttttttagtggtattctcagcagcttgcacaatgctctacctggggtaggttctcaggaaatctgtgttgaataaacttgtcatcaggtctttgcttctcaggacagaaagggcccctagagaccatctcatccaccctgtctcatgttggattccacgccatgacatgccatacagatagtcatccagagacaggaagttgcccacctcctgggaagctcactccattaccaggcagttctacttgttttaaaaagtccttctgtagacctgaaatcttcctcagggtaacttctgcctatcacactagttgtgccctctggagctttagaagaaaggaggaaaaagcctagtttctcttcactcactacctttagattttcaaagatagtctgtttatttcccctgtgtgctgttgaaatgggttccagggttgagatgctggagaagcactattctaattttgagtagcagtcaggtcagaccttgattcattatttttgaaggcctgtgtgtgcatgtcacagtgtaagctgccatcttcctctggtccattcagaggtgtagccctcttctctttttctcctctcccctgatcctctgtcttctgggggaagatgggcccattctactggaatggtctattttggagggaggggtaaaaagttagcaattcttatttcagtaccgccagataactctcctgggcaagcattgtgtgagggctgcttttcgtttggctaaagtgcccaggtgaagccatgagataaagcaaagataaaagagtctcccattgataggagctgcccagtgccatgacatgggcatttcaggcatctctggacagaggattttattctcacttccttttcttcttttctcccttcctgatctccttatccagaacacttcgtgttattctttcaaactacaagtcagtatggtgtaacagcgagagccagacagacctaggtttacatcctggcactgtcactaagaagctctgagaccctgagcaggttatttgagctctttgagccattgttttcccatttctaaaataaccacttctacattatagaattaagtgagaaaatgcttgtaaggctcctggtacaatccttagtatgcagaaggcacacaaacactagcttcctgctaccttttctctttcccccaaccttcttttcctggggaaaattagctgaatgtaggtatagtagccaaagctagtcttgggtgtgtatttgggagcaaactatcagtttcctgtgagctcctggagagatcaaagatgttaaaagacagttctcaagtaggagaggctgagaaggctgtaaatggcagtaagtggccactctggctactgttgacttcccacacacgtttctgggctatataatactgctgcctgctgctgatggtgtaacaaagcctgttccctgggcaggttaaacttgcatgcagcaacccttcaactgaaatgctttcctcatcaacctcttttgatccctaaaatgttgagctgtctctttttgggtttgttttccccaccctccatctgcctctgctgttccctgctttcttccaccattacagtctcagtcagccacagtcagcatccgagaaaaaattatttctgggctgataattttctagtagtcacacccatactctattgataggccaagaaacctgctgcacacaaacttgaattgcataagtgagccatgttttacagcagttgatcagagttaagaaccaagaaaataactggttaagcctgtaacccacccaatgaaagggggaggggaagacggaggagctgtggggttggaggtcccacaggggagcccatctctgtcttttagcagatatatcggtgctccctcttcattattattattattattattatttttggtagagatggagtctccctgaccaacctggccaacatggcaaaaccccatctctaccaaaaatacaaaaattagccgggcgtactggcatgtacctgtagtcccagctactcaggaggctgacgcaggagaatcgcctgaacctaagaggcagaggtcgcagtgacctgagatcatgccactgcactccagcctacaagaaagagacagtcttcctatattgctcaggttggtcttaaagtgctggaattacaggcaagagccaccatgcccagctggtcagtgctttctatgtgctcagggctggagatacccagacgagtaactgaacacaggtggtagagcccagaggagaaaggtgttgaatctgcctggtgggcagaggcaggaggctctgctagactgcgaaaggcaggcagggctcaggaattactctcacctcagccagaagatcctgtgaagtgggaccaaagtttaactgccttaagacaaagaatggaatgcacgttggacatttttacatcagccccagctgaattgaccatccttgccttggagctggacgaaagaaaatacctcctctctgggcaactattttccccacattttctttaaatagagtaactgacagttcctatctgtggaatgggtccaacagtgggattactcaaagagttcggtgtctcatttctttcctgctctggcaagtcttcctgacctctgtggtcaccaagctggaggcattttaagctaagtgggtcacacttagtgggctctgtgcaaggcctcaccatctgactgtcagattctcttgcaggttggacaaagctggagaagccaagaggaccctaccagccccagcccccatcctgccaaggcattctccatgtgtggagccgagcgctcacacttgggtgtttattttcacacatagtcacatagtggtcacactagcgtgcttgttttcacactgctgtccttctgtggaaagccctgtctgactttttaggttgtggattccaccctttccacccaactgagtgttaaatagtttttgagtgagcattcagagtgcttggaagttactataattagcaaaaaaaaaaaaaaaaaaaaaaaaaaaaaaaaaaagtgttttcatctctcttggtgactgatagagaaagagtccttctgtgaatgagatcagcttcagagctctcgccagagaattgggaattgagctgccgcagtaaacagctgacataacagaagcggcaatgatcccccattaaatgtctttcaactgataggggctcctgggataattgactttccagcaggaattactggctcaaacaaaatcactgggcattagggcaacctactgcatcctttgaaagggggaatgtaactctgtctggttttgctgacctgacaggcataattcatcttgattattcattgtgctagttgccaccagatgacaccagatttctggtgactgtaattacaatgtgggatgagctttaacttttttttctttttaaacaatgttcctcccacttggctattggctcccctgtgctgaaggtgctgtaggaagggatccaacaatgtctgccttgagagatgatgagtgcatggtcagatagcatttaccaagcacttccatacacacatcttttactagataagcagggaaacaatttgatgtagtctgtttcattttaactgacagagtgtcacttcttagttatacttatgtcactgtgtgccagattgctgctatcggaaagtgggtcttcatctcagagcccactgtgaataggggaagcaaagttggccccaaaatataactgcataatgccttctgctttcagacaagctttattaaaggggcaggtggaagagagtggaattcaaccaagcttttatttcgttgacatggttttagaagaagattcctgagtagtccaaagaatgttctcccaagaaaccactgctccccagccccacatgtcctttcctcaccacatacacaccccagccagctgggtggcatggtacgcatgcacctgtggtcctgtgggagaaatgaatatgacaggttcagtgtgtccaggccactgggacctccactgaccagtgggtcggggtgaacaagagagttatactgtgagagttcataccctcactagcacaaagactttttgacccccctgtaaggtatgtgtatgttttttgaagaggtgcttaattggtgtgccaggcaatgtgctatgtgcctgatgacaaagataaataagatacctttcctttcaaggagcttaccatatggtgaggatgacagatacttcccaagtaatatgttaaaatctaagctagaagtgaacagagattgcttttagagggttgaagggaaggcttcctgctgaagagataactgattggaggaataagagttactggacttggctgggcgcagtggctcatgcctgtaatcccagcactttgggaggccaaggtgggcggatcacctgaggtcaggagttcgagaccagcctggccagcatggtgaaaccccatctctactaaaaataccaaacaaaaattagccgggcgtggttgcgcacacgtgtaatcccagctactcaggaggttgaggcaggagaatcacttgaacctgggaggcagaggttgcagtgagccgagatcgtgccattgcattccagcttgggcaacaagagcgaaactccatctcagaaaaagaaaaaaaaaaaagttactggactgattaaagataggaagcaagtttaaagaatatttgccatcccttcctatttagttgaatggtgttgcttcaacccaatcaattaagttgggcttagattttcactgtttctctaataaaaatgaactctcgccctagtggcacagagtctgtaccttggaaacaatctcaggccatggtggccctcatatcaccatgagttcttgccatgcggcttagggttttgaatggtgaggcttgactaagagaccaacttcaggatgtatgtcctgctcgctttgacccttatcacttacagtgttgtataggaaaccaggcaaggtgtcttcccagtctgcaggaaagtggtgcatctcagagtgatggcttctggcgatcagccgggaatgagccccttctaagcaacgtgggcctttgtgtcctcctcttccaggattatcaagtataaatgacacccacgacacctacccttctccaacaaatggagatgattcttccacccgattccctctttattttggaaccaaatcaaaagccaaaaaaaaaaaagatgtccctgtaagggtggcagaattagtcttctgagttgtcttttatagtatgagtgaggatagcacaattgctaagcatcttcatctttgccctaaatgattgccttgccctctgtcctaactctttctcttcctttgcccctctcaactttgtgttttgttcccttttagaatggtggtttggcctggagtgatgatgcagatggaggccggggaagagagatctctcgagattttgccaaggtctgtaatacttcctttgtgatacagataggggcagttctgcagtggcttgttacagctgattcccaagaaataaggaccaaggtagccagtgagttgcatttgtagtgattcagatggtcatagtatatctggtataagacttcagcaagatggaatttttcactgtgtgtttttcttgggggattgggattgcagctgtatgaactggacggtgatcctgaaaggaaagagttcctggatgacctcttcgtctttatgcagaagaggggtgagtgtgcatctactcatcattccaattcagggaatactgatagagtgcctactgtgtgctagtcactgttagacatcctggcccactaatcctcatccaggaggagaagaggcatttactgccagttggttctggatttagccaattaaccgatagccagattgaagaggacagagaaggtgttggcacaaagtagatggaatgatcgtccacttttggccctgcctgattttgtctcttcttccaattgactggtctctggagtcacttcaaattcaaatatgccttttttaagccttaaagctaccctggacttcacttaatctagcatgtgggccttcttgttggcatatctagtctcatggagaaaggtaagtgaaagaaaagaggcccctcaggatattttggaagggtctgaaatgatccatggaaagaaaaggccaacactttcttcttacccattggctttcgatgtttgtatttgctggcttggttagaacattcctgcagtttaatagtcaggtacataggcatctgcctttttttttttttgagatggagtctcgctctgttgcccaggctggagtgccatggtgtgatctcagctcactgcaacctctgcctcccgtgttcaggcaattctcatgcctcagcctcccaagtagctgggactacaggcgcgtaccaccacacctggctaatttttgtatttcttttttcagtagagttggggtttcaccatgttggccaggctggtctcaaaatccagacctcaagtgatccacctgccttgacctcccaaagtactgggattacaggcatgagccaccgcgcccagccggcatctgctttataatgcaccctcccaattctctttccttctctcctcactctgcacatccccaagagccatcttcactgtagactatggtgtgactgagtttagagctgagtgactcaacttcctggctttgtattcagtcatagcaatgggttcaccagccaggtcagccctcagaacacatggccagcaccccagcctctctaggagaaggccttcagcaacctgtgtggctccaccttcgtcaccctcaggacaaaaccataggagagagctactcccagtagcctgctcccagcatcctgttatagctgatcatgcatcccttggtgcctgtgtcaacaactttattgagacctaagaatgaaatcttcctctttatcctgggccaagctgtaatggcagcccccagcagctaaatattctaagttaacttctctctctctctatttccctccttcctccctactcctttacctttggcagccttattgccttcttggtgtagcctgcctgttactgttggtttgcgtaaaaaaggcaatcgaaagttttgaatcttggttttccccagtctctaagcccatcaaagcaatctgagcagccttaattagtttgctcctccagctgttacctggaactgcatgtgtcagtaaaaaacaatataatcctgaggctgggcgcggtggctcctgcctgtaatcccagcactttgggaggccaaggtgggtggatcaggatgtcaagaggtcgagaccatcctggccaacatggtgaaacccgtctctactaaaaatacaaaaattagctgggcatggtagcgcgtgcctgtagttccagctactcaggaggctgaggcaggagaattgcttgaactcgggagatggaggttgcagtgagccaagatttcaccactgccctccatcctggcgacagagcgagactccatctcaaaaaaaaaaaaaaaaaaagaatataatcctgaaagataatgtgactggcagcaatgaacctccccgtttgccctgagagagaaatccacttaatactttggtctccccttccaattaccttttaattatttacaagctccacaagcccagctggtgcaaacccaggagctgatcctgtctcaaaggggctgccatagcaatatagattttaatcagcagtggagctccactgctttattttccactttattgtttttctcccttccctgaaggatttttaaaggaaaatggaagtgagatcagccaagccgattgtgaagatcagtaattgtttactactatatgtccccactagactaggagctcctcaaggagggccactttgtcattctttcatgtccccagtgctagcacagggccaggcaggaaggtgctcaggacatgtttgctgtgtgagcagtcttgttggttttcctggctcagattgcaacatgcagggtattcaagctgccttgaggtttgggtgcatctgtgtccttcagccagctgccccgtaattgagagtcagcagtagagaacagtctttgctgcatatcctgctgttctgtggcaactgggactgccagattgccatctagtatatttctgagtgaacccaaagcaggagtgagtgactccctttgataatgtcactttatgattcttcaggtcctgagtaaatctttgtcctgtcttcagcacttacgtcaggtatttcactgtttgctggcattaccaacagaagggaaacggttctgtctgccacttgttactttaataaaaggtttctcagcctcagcactgttgactttgggatgggtagtccttgttgtggagactgtcctgtgcactgtaggattttgtttttaattttgagacagggtctcactctgttgcctcagctggagtgcagtggtgcgatcatagctcactacagcctcaaagtgctgagctgaagcctttctcctgtttcagcctcctgagtagctgggactataggtaggcaccaccatgcctggctaacttttttgttctgtagaaatgaggtctcactatgttgcccaggctggtattgaactcctgacctcaagtgatcctcccacctcggcttttcagagtgctgggattacaggtatgagccaccgcacctggttactgtaggacgtttagcagtatccatggcctctatccactagataccaatatcagcccctcagtcacaacaaccaaaaatgtctctagatgtcataaatgtcccctggagggcaaaattgtcccgttgagaccctctggcatggaaagatgagaaagagaataaagatgtaaaatatcctctgcaagaaaaactcttagctgagtgtggtggctcacgcctgtaatcccaccactgtgggaggctgaggtgggaggctcaggtgagtctcagtaacatagtgagaccttctctctacaaaaaatgaaaacaaaattagccaggcatagtgatgcatgcctgtagtcccaagctacttgggaggctgaggtgggcaaattgctcgagccggggacttgggggccgtcatggaggccaacattgcgccactgccctccagcctggccaaaaagtgagaccctgtctcaaaaaaaaaaaaactttttatgaaaatcatcttacctccagtcaggtacatgagagcaagccgtgttaggtagcattgtttcctgtgactgagtgccaaaggagtgagtgctggggcctcaccctggcctgcagtgcagagaaaggctctgagaagagctgtggctctagtgtatcagacccaaccatggaggtggaggaaaaaatgctgtgacacatgtggccctggtgtagctggaagaacccttgttgatggcccagagccaggggccatcctggatgggtcagctggcatgagactctgaagagccatgtttgcccaaaaagcgcttcagtctgtagatatagctgagttattgaaggcaaaatattggctttcaggaaacttgccgtggcagtgtatagttgggctagagaggagagactgaggcaggaagatagtgtagaggttgttattcccagcgatctcctttctagaaaactcttatctggtagtccgaactagagtgagtggttcaggagggttgggagtggggcatggtggctcatgcctataattccagcactttgggaggcctaggtgggaggatcacttgagaccatgagtttgagatcagcctgggcaacgtaacaagaccccatccctgtaatttaaaaaaaaaaaaaagaagatgtaatcccagctacccaggaggctgagtcaggagaatcacttgaacccgggaggcggaggttgcagtgagccaagatcgcaccattgcactccagcctgggtgacgagcgaaactccatctcagaaataaaaaagaagaagaaaattttaaaagaggggtgggagcagattgcacttttattttaattaattattttatttatttttgagacagggtctcactctattgcccaagctggagtgtagtggcgcaatcatggctcatcgcacccttgacctccccaggctcaggtgatcctcccacctcagcctcctgagaatctgggcctacaggtgtgcaccaccacactcagctaatttttctgtttttttgtgtgtgtgtgtgtggagacgaggcccttatgttgcccaggctggtagcaaattcctgggctcaagtgatccaactgcctgagcctcccaaagtgctgggattacaggcatgaaccaccacaccgtgctgggcctcagattacagttttaatcatgtgaggcttgctgtctttgttcctttttttgagacagagtcccagtctggagttcagtggtcgatctcagcttaccgcaaccttcccatcccgggttcaagtgattctcgtgcctcagcctcccaagtagctgagattacagccatgcaccaccatgcctggctaatttttatattttttagtaaaaacagtttcaccatgttggccaggctggtctcaaactcctggcctcgagtgatccgcctgcctccgactcccaaagtactggaattacagacatgagccaccgcacctggcctgtcttttttttgtttttttttgttttttttgttttaagcaaagtctccctctgtagcccaggctggagtgtagtggcaccatctcggctcactgcaacctccacctcctgggttcaagctattctcctgcctcagcctcccaagtagctgggattacaggcatgtaccattgcacctggctaattttttgtatttttagtagagacaggatttcaccatgttggccaggctggttttgagctcccaacctcaggtaatccgcccgcgtcggcctcctaaagtgttaggattacaggcatgagccaccgagcccggctgtctttgttcttaacagaatggtgagaacaagggcccttagacatttgtgacttgtcacttgtggagtgtctgggggacacaggaggcagatcttgctagttgggaccaaggaaaagcctcatagacctcagcagcaggtcagggacttggcctccatagctaatatgaaaggtaagcagtagatatcacaggagtcactggaaatagcctgagttagcctggacaacatagtgagaccctgtctctacaaaaaaaacatttttttttaattagctgagtgtggtggcatgcgcctgtggtctcagctactttggaggctgaggtgggaggatcacttgagcttggaaggtcaaggctacagtgagctgagttcatgccattgcactacaacctgggcaacagagtgagaccttgtctcaaaaaacaaaagaaagaaggaaagggaaagggaaatgcaaggaagaaagaaagaaagaaacgaaagaaaatagcctgagtttgaaaggcccggagacacccaggtgggctgtgagaggggccagcagctttgacacagcaggctgtgcccacagaggaagcagacagctctgagggatgcagcacacagcaggccgccccgaatgaccgcagctgcaggtgataaaatggctgtccagtgggagacagggacgggccataactgctgctttgtgctgtatctcttgcttgttaacatgtttgggtgaattgactgcaacagatgggcctttcagccctcagcaccttggtttctaggcaagaccggggtgacttgcaccttggcgaccccctcccctccctgagcagcagagcaacctgcgcataaagaagcctgagaagattggagtgggacgaggcgcagtgccctgtgggggtggaaagagctctggactggcagtgcaaagccagggctaacatcccttcgttctcctgatcttgagcacatcctccccactctggtggccacagtttccttatctattgaatgagagggttcaattagtgtcatcttggaagtttctattgtctgtattgtgtgtccatgattgtgtctatcgagctacccttgatgaacaaaaaataaaagaagaaaagcccctttagcagttttctatcaaagtaattgtatgaaacatcaccaggaatctccgagaccaaatgcttctctcctgtccttgctgtgtaatatatttcctcttttgctgactgaagccaaattcaactaagcaagttgccctcgattgtcccccaccaccctattcccgccagaatatttctctagaaaagactggttaggtttagaactctgatgcccctttgggctcacctgttgccgtgtgtgtgtgtgtgtgtgtgtgtgtgtgtgtgtgtgtgtgtgtgcgcgcgcgcgcacacgcaaaaaatacacacgtttcagctggacgcattggctcatgcctgtaatcccagcactttgggaggccaaggcaggtggatcacttgaggccaggggtttgagaccagcctggccaccatggtgaaaccccatctctactaaaaatacaagaattaaccaggcatggtggcacatgctggcaatcccagctactcgggaggctgaggcaggagaatcgcctgaacctgggaggcagaggttgcagtgagccaggattgcaccacagcctgagcaacagaatgagactgtcaaaaaaacaaataaaaaacaaaaaacgtgtttctttggcaaacataaagccaaaacagttgtaaataaaattgtctggctaatttaactccctgtgggtggtttctgaaataccattccctcatagattttccatttagtctttcagtgcccaaggggagggactaatttctaagtctaataagcaaaggctattataaacaatttcatttttccttcatcagtgaggaagaaaagcttgttttttgttccctaggaggtgaaacagaagtgtggtttcattaaagagtcaggatgatgatgacgataatggtgattttactgttacttgcatttttattataccatacacattacagaacccttgcaacccattatctgatctgctgctcccctcagctccagctctgtagagtagagagagcaaaggttatcacctgtaaccctgaagaagcagccccaaggttaagtgactcacctaaggccacagagcagacttagcacgcggtctcctaactcccaggccagtgtgctttgcttctcctgccttatctttgagaaacttgttccctagagctagcaaccccatcactcccctttggagaagcaggcaaacctcatgtcttcggcagcattcaccgcctccaagagggtggtggcctgcctccacaggccaccgttcagtagcgcttctgagcatctagctgatgaacacagggtagaacctgatgtgcaagatgggtcttcatctcagggtcagggctgtttctcagagaaatagggaagggcagatgtgacaactcagagtggcacagaggctgccatctgtcaaggcaggatggggtagggcttgggagacacaggaggcacccagaatgcccacaagcaaggctctcttttcctgcccctgccccatctgggcacaccaggctaaggaactgcctggtcacatggaagacaagttttgtcaagccctcacttgtagacctgccctcccgcccccatcagttctcttcaaggctgcaaactgaccttggttttcccaaatggattgctggatcttttttgatgtgtatatacaaagaatttactgtgggaaaagggcttggtctgcttcaaagtgcaacttgagtgtttttccttctgttgtgtgcttatctatccatctcaggcaaggaaatgttcatgacatatattgctttgccttttggtggaggcaatttcttgtatattctttgtatcttaccataaatggtctgtgccctggacacccttcctggcagacgaaaatatgttgtctttttcagacgatataggctttggggcttcattttctaactttatcccgaaatgaaagtctaaaatgcaaatcttttagtgtctggattagccctttgtctcaggccagatccttttctctctctaggtgacccagctgctgttaaaaaaatatactggtttttcccccatttttaatagtcattataatactctataaatacccagttatccacgatcataggaagggagtctggtttttgaaagtcacaattaatttgaatagcctgcttttgtcgttaaattcagcctcttccccttcaaaatcttttattggtatttctaacacatgggaaaattgagttatttgatagttttgcctcttttgtcccaaagtgaaccaatattcagtaaatcatctaagagttggtatggtgaaaagttgcagtgagtgtttggcctgcttacaccatggggaagttctgctgggttttgagagtctagtggcacaacagcattggaaactcagacagccgtgcactgctcaggccagaaggcccatgaggtgtgccccagcccagccagccttccactcctctcctggagatgccaggcagatctgcccagtggcaggcaaagcagggaagaccctgcagtccacctccttctgactcattggccagtttctccgaatgcagttgtcatagccataatctttttttttttttttgagacagagtctcactctgtcgcccaggctggagtgcagtggcgcgatttcggctcactgcaacctccgccgcccgggttcacgccattctcctgcctcagcctcccgagtagctgggattataggcgcctgccaccacgtctggctaatttttatatttttaatatagatggggtgtcaccatgctggacaggctggtctcaaactcccgacctcaggtgatctgcccaccttggcctcccaaaatgttggaattacaggcgtgagccaccgcgcccagccaccataatcttattgttaggcatagcagaatacaatattacatttaccgttgaacttcacctaaagagattagtccaagctggagtagcaaaaaaggtaatgagtttaaaattagcctccaaggttgtagaaccaccagctctcccatgcattacagctgggagtgtaaagggatacaactactttggaagtctgtttggcagtgttcgctaaagctaaacatacctggaccttgttacccagcagttgcactcctgggtgtattcccaacagaaatgagtgcttgtgttcactgaaagatacaggtaagcatattcatagcagctccattcattatagccaaaaactggaaagaattccaatgtccatcagtagtagaatggataaataaatgtagcatagtcacatatcggaacactacacagccgtagaaagttatgaactagccgggtacggtggctcacacctgtaatcccagcactttgggagggtgaggcaggtggatcacttgagctcagaagttcaagagcagcctgggcaacatggtgaaaccccatctctaccaaaaaaaaaaaaaaaaaaattagctggatgtggtggcacctgcctgtagtcccagctacttgggaggctgaggtgagagaagtgcttgagcctgggaggcagaggctgcagtaaggcgagatcatgtcactgcactctagcctgggctacagagtgagactccacctaaaaaaaaaaagttgtgaactactgctttacgcagctgggatgactctcagacctgatattgagcaaaagaagccagacacagaatatatactatgtgagtccatttatataaagttcaaaaaaatatatgtcagaatagcattttatttccagagtgggtagggtggagggatggatattgattggaaagaggcatgagagagttttctaggggtgctgtaaatgttctgtgttttggccagacatggtggctcacggcagtcatcccagcactttgggaggctgaggcaggcggatcatctgtggtgaggagtttgagaccagcctggccaaatggtgaaaccctgtctccactaaaaatgcaaaaattagccaggcatggtggcaagcgcctgtaatcccagccacttgggagccggaggcaggagaatcgcttgaacctgggaggtggagtttgcagcgagccaagatcacactactgcactccaacctgggcaacagagcgagactctgtctcaaaaaaaaaaaaaaagttctttattttgatctgagggatggttgtggaggtgtatttggaagtacacatctagtgagctgtatggttaaggttaatgcactataccatatgtaagttagacccactcagtgggcagttggaggtggaaggcttaaggattcttgtcagtctatactagcatattggcacatgcttgcctctggcctgtcttgtggaacagtgcaactacaagctgcacggcagactaccagacactgctgcctgatttcccagtgggagacctttttccttttcctttcccgtttctttttcctttccctttcctattaaaacttttgttagaggttcaggtggtacatgtgcaggttttttacatggatatactgcagggcactgaggtttggggtacgattgatcctgtcgcccaggttgtatgcatagtacccaataggtagtttttcagcccttgtcccctgtagtagttgccagtatctgttgtgatattctctatatgaacaagtcatggggggaaatcagcagtcatttctctgctggcttctggggagcagttctagagcagggcaagaatgaagatgcagaggaatgttcaggaagcctgcctgcctgcgcacattccctgcttaacacaggtcttaactcttccaggctctctggtcagctctcttgacagtcaggctatggaaatgattaatgatctttctcaaagcctggaaaaagcagcaagggtccctggcagggccacaccctgggtcctgggccctcacccctgcccagtgggcaggaaggcagccatatgagtctgtctggggtccctgcccctgtttgcttctggacttccctggaaccggcccattctctgcaatggggaggaagtggctttcccttcaacactcttaccatctctcatctttgtctccaaagccagaagaggccatctcttctgccctcacccctatccccagctacatcttggttgtctgagtggcaggaaggaaaacaaagtaccagggagcagcttttgtttggccacatctgcactggaagctcctgatcacagctgtggcctgctagtgccagcgcccagcggcattcccaccaacaagggttaaagccccaggagtcccgccagcttcactgggtccatggccctcataaaagccttttacatccgtccctcaggctgcaggctccctggctgaaatctgataaggggcctctttgttgcaactgtcagtctcctttattgaggagggaactggagaccagtggcacttcttggggtgcagataaggccctggattcctgtcagagagagcatgattaattaccctcaatcccagctcctgctttgatagcagtgactgacagtccacaggcttccccatcaggtgctcacccccttctgggaggcatgatgggggtggagatttggtctcctgtagggccaacaccagtgacccacaaagatctctcttcagtgggtgtttgcctccttcctggtgctctgtgggttgcttttgcatttcttgtggacagaggcctctctctctcaggtgaagagcttccttagaggaagatagaatacagcccagagagcaggccagagaccccttgctccctcccgcaaagactgggaaaggagccattgcttgtggacgtgaacttcacaaatctggccttaagccaggggcccttcacagagaaaatctcaaactatctgtatcaaggccacttgacaatattactctctaattcaggcaagttcctaaaaccatgtgattctccctttggtaataatcacaactgtcaatttttgtttatcgatttatatcttgctggtttgaaggtacatcagcagaatttttgttttaattttttattcatagactttagaactgaaaatcatctagtccaaattcctcacttcacatttgcggaaactgaggcctgagtctgtcgattgcctattggttcttgttcagcaggtaaacttagcttaaaggccttctctctttcttcatagtagaatctactttggacaagagaaatggctaccaggtccattaagcacaaagcaaactgctgagaccaacctgcagattctgcttctctcagttgttagaagaatcaaagacgcggcaggcttttgtgtctggattatctgatgggagaaagcgccactgtcatctagagagccctcggcatagcctccgctctgtttctgatggcaccaagggccagcctgcactgggagccactgacagtttcacagagggccagccacagggaataatgcgcccaatctccttatcagcttgatctccagaaccagggtgcctgatcagggcatgggggctcgtgtgaggagagttcactgtggagtgaggaaaacagcttcccaagtatgccctgggtggagctgggccacacagcagggtgcaggggccaccaccacggtttccagtgcacctcttacctgcggtttctctgtagtgtgatgacagttcccagaagagtacactttcccctctgggaagagatcacttattagttaggttacaaccttgacttcagacaccactgtgacccttccttgtctcctcaggttctgtatctgccattgttcccctggccctaagcagttctcagtctaatataatacagtcacgttgtgtgtgactataaagaggctaatttttaatgaaatttctacatctataacaatgttgtccttcaaagatgccatctcaaacagccaggcaattagtccaatgactactcaaaatgaatttgtaattcctctctggggagttgccttcagaggcagtttgaaccacactagaaaatctcagccgggtgcgtggctcacgcctgtcatcccaacactttgggaggctgaagtgggaggattgcttgagtccaggagtttgagaccagcctgggcaacatagtgagacctcgagaaacatttctgggtaggttaatttattaacactataaggcatggtaggcatggtaaaggaaagacaacccctgccttcatagagctgacagtcctcctgggatatcggatggacagatgtgaaacaattagagaaggacaatttgctaaacttataggggcatgatagaaattctgagagggaagaaacccacatgaactggggtagtgagaacatgcttcctggaaggagtggatatggaagaacactgtgaaggatttgaggggaggcacaaaagagcgtgttttgggggcaatagggagaaggcccagtgagttggagtacaagagagttgcttggatatgccaggaatacttcacatgtgatcttctaagggagtgttgaggaacatgggtcatgcgattggacatgtgagatgggctaggtaagcaataagagttttcataggtttttaaacaaggaggtgagtaatatggtaaaagtagtattttaataagattggctgcagtgttcaagttgatcgtatggctaagaggctgctgcaggcatctaactgtgggccagagagggcctggaccaggatggtggctgcaggccaaaaaggaagatgcctttgagaggtacctccaaggacgaatcatgaagccttctaacaccctgaaagtgggtgatagggagaggagaggagccagtgctgacacgaggttcctgccttcctgcctaacttccaagggtggtagtgttgctgggaaaaaatgaggtgtggggaaagggagctagtttaggggaatgaagatgagcccagcacaaacattctgacttggaagtaaacgggtcacacgtgtgaagatgccctaggagcttccggaaatgtgagcttaggagccctgtgtgaggggacctggggagtggtcctctcagacactccaggtaatgccttggaaggtgtggactcaaggccatgggtgtgtttgggcagataggcctccaaaaggaggtcgacgttagccctgtcctgctgggggcttttgtctttctggtagggggaaggtttactgtccagaacagcactgggagaagtcaaccagcacatgagctgtgtgtcttaggagtatgcccgtaatcctctgttattttacctatgaatttgtggatctaattccatgacccctttgtccttgaccctccaaggaccagcaggtcaagataaaggtcttcaaggtcactaaccccctccccacacttaggaaagaggcctaagccaggtgctgtggctcacgctgcagtccatgtgctttgggaggctgaggcaggaggattgcttgagcttaggagtttgagaccagcctgggcaacataggaagatcctgtctctacagaaaatgtttttaaattccctgagtgtggtggtgtgtgcctgtattcccagctacttaagaggctgagtgggaggatggctggaggttaagtctgcaataagtcatgattgcaccgctgcactccagtctgggcaacagagtgagaccctatcttttaaaaaaaaaaaaaaagaagaagaagaggcctggtcctgccgcagcagccccacatatccatgcccacagtgcttccttttcattctctggcttgaaccatcctgtaaaagagttggtgaggctgccattcagagctgagaaaactgctgtgcctttagggaaagaaggcggatggagcagaaacaaacagctcttccctgctcaggttggtttaaggtccaccaggcagcccagtgagacctcagcgagactggggcaatgggagggggcaaggcagaggagcagtagtctgtgtacagtaaaaggagtttgccatcaaaaggcaacaagtctcataccctgccctggacggtgacccttccctgtggaattctcccctctgacctccagatcattaatcccgaggctgccaaatgacagtcatccatcacgcctcctgatgagcatcccagccggctgtgaaaggacttgccccgccctcaccatatcccctggtgctcattagtagcccttcctcctcggtgccaggtttcctaatcaagtccctggctcctctcacttcccctcggggccattgggtggaagctgctctgaccctccccctttcagaggccagggagtgggtggagtgattggtgtggggagagaattgagtggcttttcattcctctggagacctgtgtgtccagcagctcctttgacatggcggggcacacgagagagaaataaaccatttctccatcaagcaggagaggagaaagcaggcatgtgcaaacaagcacactcttttttttttttttttttttttttttttaagacagtctcactgtcgcccaggctggagtgcagtggtgtgatctcggctcactgcaagctccgcctcccgggttcatgccattctcctgtctcagccttccgagtagctgggactacaggcgcctgccaccatgccaggctaattttttttgtatttttagtagagacggggtttcgccatgttagccaggatggtctcgatctcctgacctcgtgatctgcccgcttcggcctcccaaagtgctaggattacaggcgtgagccaccgcacccagccagcgagcacactcttataagcagcactgagcgctgccaggagggtgactaggcagggctccccttctaggaagtcagagaaaggcatcccagaggaagctgccgctgaatggagtctgaaagctgcagagataagtcgccagatcactaggaatagtctggaatcatactgccagcaaaacaaaaacaaaaacacacacacacgaactaaaaaacaagcacctttgaaatcatctagtctggccctcttatttacagacggcaaaacagaaccagagaggctaagtgctttgccaaaggcccacacagcctgtgcgttggacctgtcctgacagctagtctgagtgttcaggcttggggagtttgagttaaattacacttccaggttgatgagcattgtttccagctcggctaaaggtgggcatacacggaatctttcttctcagcctgatgatgatcccgctgtctctttctctcgttggacaaccacagggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtgagtggccagggcctgggagaaggaagctgaggctggagaaaggggatgttgtaacctagaggagaggaaggaaggaaattcctttgtatggttagcaagatgagtggattcccgaaacagtggggagctttctgagatgaatccctcactaaaccaagtagtgatgagaaccaccatttaccaagtgtctactctgtgctggtactttactatttcatttaaacctcacagtcaaccctgtaaagtaggtatgcccccatttcccacattacaaaaatgaagtctccatggttaaataatttggctaaggtcatataccagccagtaagtggtagagctgagattcagacctgggcttctgtctctaagacctgtgccccttccaggacattgtcttccaaacagcatctccaccccaagtggcccctcttacctgatattcagcttacccagcggcagaggacccagagaaaggcaggcaggaaggcccccttggattggtgacctggttttgtcagcatttgagttaattacatgggtgatggaagcggtgaaaccaatagtagcactgaagaatgagggccagagaggaatcttttcttctggaacactctggaagttgttctgtgaagagtatgcaatgaacaactgacatcagttaggtagcatgttgtagctacaaccagaatggcaaggttcttgggtagagaactgcttcttgggacctaagacacaaagaatgacagtgtctaggtcccatgcacaatgggaagaattgctcctatctgactagcccagctctgaatggttataagatcaagaagtcagaaagcccttgtaaaacatgggcctaatttttcccagggcttcaaaacaaatgtgaaaacgccaactaagatgttatttatttcccctaatgaatggtgcttcaaagtagagcctatttaggattgagtggcagtcagaggaggctggggcagagtgtccggccatcccagacttttctgccaagtataccaaggttgcaatcctttgccctagagtcctgcccaacagagactgcttccagagacccaccaacctcaactgggtggtctctggtgctgttttggattattctccctgcttgcttcctttcctccaggtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtcagcagggctcctgggggagaaggaagaaagggaggaagggatgccagttccctgtgttcaagactggggttttggggcaagagggtcaattgtggattggtccagctccagttcctttgcaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcaggggtgagccaggctcagggccgggccttcccttcctggaaaccccaagcccattcacgcctcctgggactggtggggcaggggtggtgaggcacatactcctgacctggaagaggcccctccaggttctgccttccaggcccctagaagagaggcactgagatcttagttcaccaagctgaggttgtttggtagaggggaccacatgttgcctcaggcagtgccctgttctctagtaagagggaaaagcagttattcacagaggaggagccagaggccttcagagagctgctgcgtttccccaccagccattaccccagcacctcactggatgtaggcaagagcagggcaccgtctgcaggtctgggaggaagacaccccatgttcctgaggctcagcgaggggccaagttgccccgggctggacagtgggactcaggaatatagacagaaggaggaaacacaagtttggcagcataattgacatcctttcccttcctcttcacattgttctggtgccccacattctcttcctcaagccacacgccccttttcccattcacacacattctttcccattctggtcctgatgctatctcaaagcaaacatgaatgagatgtgtgggaaggagccaggtgtgaagggagctatacatattcccaggctgcccctcctaccccattgcccttggggaccagaaggaaactgggaggtaacagctcatccagggccaggtaccctgctcctgcacaaagcaaagggctgttagaaaagacagctcaccgggaagaattctgagtctggggtgagccagccaaaggccgtgtgtgccagcacttgcaggcttccacaaacgccagctgcctgggtggtcatggaggggaggggctgagggcgtagactcctctctctgagggactcagagtcaaaggaaagaaagggcaggtgggtcctcaaagttggggctgggtctcattgatctctgatttcctgggcctggtgtatagtgtagttcagggtttgcccgtcacttggaaagtgccagtgcagagtggtggggccggagccggcctccttgcctactgtgattccttttctctgggagcagaggtagttgaggggatgaactgggtcagtggaaaaagccagcaacaggagattggcgagcctgggatctcctgccataccctacactcaggagaaggttacatagatgccttttaacagcgtgaggctttgaccaggggtggccaggcagcatcagagaggacaacaggagtgctgtggaaggcttgaccaggcccactgtctccctgtccccagcagaagacagagcagaggcctcggctgcagcactgaacctgaccacgagtagcattgggagcattaacatgtctgtggacatcgatggcaccacctatgcaggtgaggccctggagctctgggggaggcccacgtggccgcagctagccacagggcagctctgcggctggccctgcctcttaccctctgtctgaacacctcccacagtggcttcctttttcctggtctcagagttgcaaaggtcaagtggtcctctggactagtagactgtggattgttaacaggatgataggtccctcccactttggcagaaacccttcacctaacccttttagaccagtggttggctcgttaattgaagaagtcagtcagtgtcccacaatccccaggtcttctcatgcacagcctttctctgactgtaattcagctcttctcttccttttgcagactgagacacaggcaaaggaaccccagtataggagaatcagcttacattgttaagctccctgccccccagtcttttacagttatcttttcctaaacctaatttggcaacagtgttttgttggttggttgatttcgcacctttacagagtctttctaagggtttaacttagtattcatgactgggcacggtggctgatgcctgtaatccttgcactttgggaggctgaggcaagaggaccacttgagcccaggagtttgagaccagcctgagcaacatagcaaaatcccaaatctacaaaatacaaaaaaaaatagccaggcatggtggtgcacacctgtggtcccagctacttgggaggctgaggccaggaggatcacttgagcccaggaggtcgaggctgcagtaagccgtgattgtaccactgcattccagcctgagtgacaaagcaagaccttgtctcaattaaaaaaaaaaaaaacaaaacttaatattcataaaaacagcagtccttttcccattcccatttcattggtttacggacgagcttgggaacaagcccacctgactcttgttaagcacagcattgctgggcgcggtggctcacgcctgtaatcccagcattttgggaggccaaggcgggtggatcacgaagtcaggatatcgagaccatcctggctaacacagtgaaaccccgtctctactaaaaatacaaaaagttagccaggcgtgggggcgggtgcctgtagtcccagctactcgggaggctgaggcaggagaatggcgtgaacctgggaggcagagcttgcagtgagctgagatcgcgccactgcactccagcctgggcgacagagtgagactccgtctcaaaaaaaaaaagcacagtattatgagtgggggccaccaggcctggcccagggcatcacccacctgttttaccaagggcccaagggcatgcggagtgtcagccagcctggcaaggtgtctcgtggagacaggcgaaagccctacaactgcaccttctatcacaactgggagtgtttcctcagggcctactcccattctaagggccacactccctcagagcaccgccctgcaggcctcctgggagcatgctctggatctctgctgggccactcacttcagagagaggacagagtgtagaggagcagtggtgccaagtgggctcaccagtcatgctatgtctgcagactctgctcagaggtctctacctgtcacaggaggcccctggaggaggtggggcctggtgccctttgcctcttcattgtgctgtggtttgggagggttgggggttggaattaggtccatggagaaagcagggaagtaggaattcaaggcctggatcttgatatccttttgtcctctgtcaaggagaaaggagaaggtaactccttccctctcagaatgaggaagggtcagaagttgaaggctcctcaaacccctgacaagaagggagccagtcacccaccccacctggctctgtcacccaggctggagtgcattggtgcggtcatagctcactgcagcttcaacctcctgggctcaagtgatcctcctgcctcagccccctgagtagctgggactacccatgcccagctaattttaaaaaaaatttttatagagacaaggctcttgctgtattgcccagtctggtctcaaactcctggccttgagctattctcctgcctcaccctcccaaagtgctgggattatagttgtgagccaccacacctggccttggtgttcctctttgtgtaccctgggtacaccttgtctcagagcatttatgacattttagcaaaattactctgtcgacctatctgtccccctccccagcccatcagcacttcaaggcaggacagcatttggatcttctcccatcaccccctagcacagtgtctacagcggagtcaggcacaggctaggccagcggtgaatacttactgaaaggagctggccctccccttcgctcttcctctgcccacacttgcttctcttccacccaccaaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaactgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacacaagcaggtctctctcagttgctttgagtggcctttccactggacagtactggggagaggtgagctccttcagagtgaaaggggactgagtgaactactcctgaccccttgatttctcctgaaccttctccccttcacccacgccttcttcaaagggaaagctcactgagctcactctcagctaaccttgtgtgttagcaggtttctctggcgttaccccagaagctcctagaaaagcctgcccggcagcaagccacaggccccgccacgccattggccaggattgagtcacgtgccctccccagagccaatgggagcgagggggcagggtgaccgggaatgaccttagactgcccgccctgcgcggagggagatccactacaggctgcgcctctgcccctgcgaggggcacccctgggtctctgggaaacggaatggagggtcttatggaagagaaggtttggaaccaccgctggagggaaggggagaagaaagcaagcaggagtggcgcgaacaggaagggactagggatagaagccgggcttggacacagtgaggcacgaaccccgacagacacagagacagacaaggggtgctgatctcctcactgggcggggtgggcaggaaaaggaacaggagctggagctagagcgagggctgcgagcggcgagtggatacccggcctcagggaggagcttccaggagggcaggggtctcctttggagcagcaccggggacgtttgctcggcaagggctttttgtgcgaagtaaccgaagccagtcaggctaatggcggcagagagaaggatttattcttgcacccagggtgtgcggaggagcccaagggcatttggacctgtgttgacgtccggaagggcccggaacccaggaagctctgcccgcagagggtattcctctccctctgaagaccacctcaaagctcaactttatcacctccacgcatgagaccgccggcggctgaactaaaatctcaccatcccaattccagtttctgggaattgtcacctccattcgctctcattagaaatccagcttttttcacgaggtgaataacagggcagttgacagttcccaagttttctgtgtccaatcttcagccctggagggactcttctgctccaagtccagcgatcccgggagggggcccactggtccagtacggctcagtacccagccctggatccaccagctgacgctggaaggagtgggtcatgaagaactcagcacgaacgcagctgggtacgaattcccagagatgtcctgtccctccacggtaccaaggacccctcctttaagaaactgcttcactgaaggcgcagatggagggagggatcggcaacagagttcagaggggttccgggggcacatggctcagccggaggaagcaggctgaggaggggcgttcagaatggccagatgacctcgaggggaatgccaagcctcagcccactttgcctgtggctcctgaggatgttcatgctgtcaagctcagaacagctgagaaactacctttctggggcagattaggggaccagggggcttagttgctggtttgctgtgtgacctatgacaaactctgggcagtttgtctgtgaaatggggactctagtgtgatcggagacacaagtgaatgagaactcactttgaaatgtctaaagcccagtgcctaaggccttccttggcaagacagagagtccctggtgggcactgtccgatggcattagggcagtaattgggccaaccaagcctacaggcccgcagcaccccctatggtgttgggcagtgcctgcctagctctactcttagccacagggtcccctgggaaagtgccaggtggtctcatccaccaagagccatattggcaacattgtgccaacatgggcatttcaggcctgtgtcagggaggggacaaggagtggtttctgccagggaggcctcagactgcagttgcctatgacaggctccaggcttcaggcctcatagaaaccctggccttgggggctgaaggccagccaaacgggcctcccctcttcccaagtccttgcccagccgcggttgcctaaggccttttttttttttttttttttttttttgagacagagtctcactctcacccaggctgaagtgcagtggtgcgatctcgactcactgcaacctccacctcctgggttcaagcgattctcctgcctcagcctcctgagtagttgggattacaggcatgtgccaccacgcccagctaattttgaattttttagtggaaacagagtttccccatgttaaccaggctgttcttgaactcctggcctcaagtgatccacctgcctcagcctcctaaagtgctgggattgcaggtgtgagccaccatgcccaactcactgaggcctctcaattcagcttttctatgccaggacccttcagctcactgggcgggggtgcagggcctgacctcaatctcttgtgctgcagagtgaggctgtgaatctgcctcctgctggctctgggcacagtctctacactgcctgggcactgcccctggcttccaacttttctcagatgcccttctttgggctccagggccatggctgggatctgggggcagatgagacagaggctgataccatgggggtcagagaggcagggcagggggtagcttccgctctgtccagggatggggaggccagctcaggaatccatttagaaccagtaaaagcctgagctggaagggcctttctagccttctgtttcccctctacaacctgcagatgggaaggccacgggacagaaaggaactgggcagaggtcactccccaccccatctagagggtccacatatgctaccttcaggggctgcaaggtggaggtggctggaggctcctgtcctggtgctggagcccttggtgctcagacctgcagcagctcccactccctgaggacacaattctcagcctgaccatcagaactcttagggtctcctagaccccatcggcggctctgaccctcttttatgaaagcacccaaagagcacctgaggcaaaggacagcatcccccaccctattgagctcctcattgcaggagctcaaagatgatgacctcagtcagaatgaaatggtatttaagcacaagccagtagctgttgccatcctggggaatgtgctgtattgtctgtcactggcagcattgcattacatcaaactattgcctgaatatcacaagaagtgcaaacaaagccttatggattgaacattgcataaaataggccttgtgtgtggcgcagtggctcacgcctgtaatcccagcactttgggaggcccaggtgggtggaccacctgaggtcaggagttcaagaccagcctggccaacaaggagaaaccccatctctattaaaaatacaaaattagccaggtatggtggcgcatgcctgtaatcccagctacttgggaggctgaggcaggagagtcgcttgaacccaggaggcagaggttgtggtgagccgagatcacgccattgcactccagcctgggcaacaagagcaaaactccatctcaaaaaaaaaaaaaaaaaaggctttgggactaaagcccgtatgcagccgcccctgggcacatatacgtggttttatgactttggtactgactcagcctaactggaccccagatacaggagaaactgagaaggacggagaacataagcactgtccccggtgcactgtgtcccatgtcatcctcacatcaatcctgtgtcataggtactgtccgtgtttccattttacagaggatagtgaggcttagtgaaggcaggacttgctcatgctcgccaagctggggagtggtggagagtgaagtgtaagacttctcggttctactgccattctccttccatccattgctccaggcccaggggcccagatggtctgattccctgtgccccacagcccaccctcctgctgctgctttccctggcttcccctcttcagagagaagaaggcagaccaggagataggtcaggcctcaggccgctgctcagccccacccatcctaacccctgaggggatgagagggcagcctccacaacgtgtccctaaatgcccctgcccccctgccccctgccccaggttctcagagaagaggaagagctgtgggggctgaggagcatctctgggagggagggtggggtttctccccaaagagcccctcagatgcaggcacccctcaccccgcagtcactgcttctctaccagctccttttcagctgctgctgcagcctcagtttctcagggaggctctccaccagcttagaggtgggcggggggaagcagtgaacacgttccaggctgagccctcccagtgggcagcaagggcttgggaggaacttgagtgacggagtgtggggaaggaaaggtcaaggcctgcatgggcaccatgcggcaggcagcagggatcgggcatgggggagcctgtgggagccatgcaggccagtcggaagcacagtgcaggggggcagctgctgagcacctggtcctgggcagcctccagggcccactgctcagctctcagctctgagtctcaagcttccagcacattgcagaccttctcgagctcagtctgcatctcagccagctctgaacccacctcctgcaaagaagtctgtgatggaggagggtggggctggcgcgtatcttgatctgcaggctccccaagaacttcgctcccccttggattcagagctccagcctcacaggggccttcctagggactgttcttcgccccaaagaggccaccatggcggcatcaggtgcagtgctgacggaacagcaccaggggagggggcaagagggctcaccttcccctccaagctgtgcaggtgactgaagtccagaacacttgccctgaacccctgatccttcactccctcttttaccctgagtcccgcagcgctccccatacgggtagtactgcctagcccaggagcccctgagggcaggcctcacatcgccctccatctccacatcctttccagggtccctgcacagtttgcctgcacagggctgggcccgcaaagcctcgctccccaacgcacttgtttcatcacttcaattggtgagtccaccctgccaaggagtgaggcctagtcccctctcagggccacgctgaggttgtacgaggacagggcagccggggttacgggcctgggatgagtctaggctgagtccttggtgctcaatggagaacccccatcccaattcattggttccaacaagccaggcttcctactccaacccctgccccccggcccaggccctgccttcacttcacatggtccctgtctcagctcctccagctcctggaaacaagggcccagtgtggtcccagagggcccagtccacatggcaatgggagaccagagccaagttctctgcctgggaggtcccacctccatccagcctgatctcagggagggcaaccagggctgccccacaccagctctcacccctggatggggctgtcccagctccaccccagtctgcccttgagctcacccattggcctctggtggagtccacactgcagactccagctccttggcagacctgggctcccacagctcctgggggatgggaggcagaaacgctgctggggtgtggcagggacagcaggaccctgtccccttgcccccaccccgttctgtgttctgtgcatcattagctccaccaaggccactgggtaactcaaatgtggcacaggcccagttctatacagctggggagaccgacgcagggacagtgacccagtgagtaaactgaacagggtcataggatcactgagtgtcagagctccccagagtccccccagcaccacacccaatgtacagatggaacctgagccccagagtagtgaggggcttggccaaggccactggccagtttgtggcagagctgggactgccacagtcccatcagtgtttgtggaacccgtcgctttactggccagtgaggattcccagcggccccacccacaggctgtggggctggaggtgtgtgggtgggtcttggctggtgcccactcaggtaaatgcctgtgtagtacccaggagaagccacagtgggctgggtggggcaggggtgaggtgggacccacctttcatttgcagactccgggggctggcctggggtctctgctgcggtctgccctgtgggcagaggggaggtggcaaggactcaggagcacttgggctgctccagggtggctgccctcccttcaggctggcaggattgtccagattcttatgtccctgtccttgggtgggcaggctcaggccaccttgacctgggggcacccgaccctcacccctagcagctggtgctgagggttctggtgccagtggtggccaaagtcctgcttctgtccacaggcacccagctcaagctggagggcaaggccctttctgttcacggacagatgggccatagtagccctggaggccccacacccctgggcctgagctccccggtactcagggccagggtggggagcttgggacccattaaacaatcaggaagctgaggccccatgagaagagctgtggctgtggcacagcccgggcctccactttattgcacaaggcccctgacttcaggcttggggagggctctagggtacttaggaggggttctttgggggccctgactgtaggtggggccacctcacaccaccccaggcagcccagctcctgcccaccttttgcctctggatcccagcagccatctggtcattctccctctccagagcctgcatcctgctcctgtggctgactggggaggggccagctgcatccccatctaggggccctgctcccccatcctctcatgcctgcagaaaccttcaccctggctcttgggtttgggcaggtccagcctgcagaggggagcggatctcctcctgggccctggcctgccctccctggctggcatgtggactaggggcctgggggctcactggatggtgcccgcccagactcacggcagctcctcctgcgtgcactctggcctgtgcagctgtgtaagggtcctgcggttacatgatgggaaaagcaagagggagcatctggggccctgaagtcccaagtcacacccaaaccaaaccacccagccaggaagatagcaggaagcaaattggaggcgttctgggttgaactgtatccccagcaacaacaacaaaaagatatattgacatccccagtacctcctaatgagacagaatcattacagaggtaatcagactaaaatgaagtcaataggctgggctttcatccaaggtgactatacaaaggggaaatgtggacacgggcacacacagagggagacaccacgcggacatcctggaggaatgtcaaagcctgctggcaaagcaccagaagctggggacaaggcctagaacagaccctccctcacaggcctcaggaggaaccaaccctgccgacaccctgacctgaacttcagccttcagaaccaagagacaatgaatgcctgccattgaagctaccgtcttcagcactttgttatcacagccctagcaaactcacagagggtaagtgggatccagccccatgtggcagctctctggccccaaaaggaccctgacttcgaggagaactttctcctcaaagtgaccacacctgcagcagcaggaactgtgcaatcatagtggctaatgcttcatgactgaatgccatgtgttttcacgtgcttgtcaaatgtcatcctcttaggcactcattcagggaggataactgttattttcacttttacagataaggcccagagaggcagaggaactgcccaaggtcacacagctagtatattgtggagccaagatttaaacccacaatcttagccactaatctggggacagtgcagactactgaatccttggatggaagacagactgaggtagacacccagagagggttgggtggaggagcttgaggctggggatgggactggaggtggagcatgccagaggccctgggagcgctgggtgctgagcccgtgaaccccctggccagccggacgttgatgcaatatggctttgtccagaccctatccagctgctgccccatctccaagagcctcgccctgctggaagtgcactgctagtctggttcatcagccactctgcacaggacccctgcccaggacccagggtctgcattttaggccatccttgctggataggcccagagcccagggtccccacctgcctgtagaaggtgagtcctgggttggccttctaggggtccagggagggagtaaaaatggcctggacagtctctgaggggctggaaggccctgcatgtggggcccaaagtggcactggcttatgcatcacgtgcaggttaagtgcatccggctcacctagcacctcttcctgctaggagacaaatctgccgagggcccagccctctgtcactccactaccttctcactgacattgcccactgcaagtcctcagacttgaccaaagaatatagcccatccaggcgctgaggatatatcttctgaccctcaagggtctggtttgagaaatagacaaaaacaaacaaacaaaaaaaaaaaacaacaaaacaaaaaactgagattttcctctgtacaaatatatagtggcagactacactgcagacttaaggaacagccccctatgagcacagttgtgtacccatttgagatacactgatttagaccaactcaacctttatgaggcccaaagccagctaagctttctctccttttccttccatcgagatcagcagatcagcttcagtcaggtgccttgtggcagagcgtggatcccacatggggtccttagaatactacttccctatggctcccaggcacctcgttggtgtctgtatctctctctgtgtctgtgtgtgtgcatatctgggggtgtctgcagatgtctgatgtgtatcctgggggtgtgtgtgtgcatgcatgtctgtgtgtctgtctgtccatgcacacatacacttgcccaggagactaagggatgctgaccaggagaaggcagccaccaagctggaggtgaagtcaggtggacaggagctgggacatctaaaccctagatctggcccctgtcccatgtccatagtaaccccctcacccactctccttctcaagtggatcaggggctatttacaacactcctcccctgtctctctgggtatatgtatgtgcagtttcctcttgctgaaatgcccttcatttcctctctcctcctggaaaatgcctgtctatccttgtgtgagggttcagaggctcagaaaccccttctctgggagggactctcctatctgccaccccttaaccagctcccactgtgcctcttccctcatctggcacattaaattattacttgcaaaataggcacagtggttcatgcctgtagtctcagaactttgggaggccaaggtgggagaactgcttgagggtcagaagttcaagaccaccctgggcaatgtagtgagacccccatctctacaaaaaaaaaaaaaaaaaaaaaaacttagccaggcatggtgatgcgtgcctgcagtcccagctacctgaggcaggaggatcgcttgagtccaggagtttgaagctgcagtgagttatgattgcaccactgcacctcagtctgggtgacagagaccctgatgcaatcaatcaatcgattataaatcaatcaataataaataaataattgcttactcaattaccgggtgcccccaaaccataagctgttgaggacaaggagtgatctgatttgacattgcttctgcacacagaagagggccaggcatgtagcagatgctcaataaatgcatgctgaaaacatggatggagaatgatggggcatgatgaggaagaggcagaaaatgggaaggaagtataggatcaagatgggggcatcctaaggaggggtaagagactaattggtttgtatgggaaagactgggcagtggggaagacaatggggagaacggggttgagggggtggagaagaaggtgggagacagtgcccacctggggaggccaggtcccactctgcctctggagtctctgcagttcctcctctttaaatttcagggcaactgccagccggtgccagcgtgccttccaatattcagccatctcctcatgaagcctgggatgtgattcttgtgcctctagctctttcctgaggggcactggtacctccaggacctggagtgtactggaagaaatggtgcagtccaggtacagcatggaccccagatcacccccaccccactccctttcagtgattattgtcttatgaactaggagggggagtggggcagagatgcctctttcatggctccctgcacacacagaacccctttgtactgggcacttctactcccaaggaccctgacttgcacccagcagctaaggtcatctcacccccacctcccacctgcccctgggccagcaggaggggcttggccatatgtaggcgagacaggacttcttgaagctgaaagatttcccaccccataaaagagccagaatgtgacaaccaggagcgctgatacctggggaagggagactggctctggtcgtgtgattccgggtttagggctctgggccattccccctcagccagctggtgacagagactggcccaccgcctgctgagagggccatctcacctacagtgagaacagagcccccaccccagcctggcttggacactctgaggatgggcccaagcagccacctaccaggactcttggcccggggccacacccagtgctgctagcagccccaccttctcctgaagtagccaggtgtgctctgcctccagggcctgcaatggccccccaacaccatctgctctccctgcagatgctgcagctgctccaagcaggcccctagttgctggtggctctggcccagctcttctgagtctcttgttcacctggggagatccccaccccaccgagttgtggctcagcctccaccagggttgtggagctccagcctttacccatgcagcccctcctcagaggccccgaactccacttcctctgggtctcagcccttccaggaggcctctctgaccaccccagcccgcagaggcttctctacactccaggctacgactctggaccagtgcctggctgcacactagcaggggggccagttatgtgaagatgaggatggtgctctctggagtgtcactgtgtggacgccctgctagaatctctctctcctggtcattctcctttcctctgtgcccctagagccccttgccctacattggaatcccccaggaatggggcccaggctcccttgcctctgccccctggtacagatgggcatggcctggatcagctaatgcccagattccctttcctgtggggctgcccctgccagctgtcttgaccaacctcagtgagtatcagcaactgctcctgcagacggactgtgtcctgagcctgggcaggggtctcagctgctggcatggagactctgggtcccgaagctcctgggccctgcctccatcccagctctgctcttggatctgcaggcctggcaccagcatctcctgtagatacacttggtccagaatcctggggtctccttccagcttccagaccacactggggtggtcttggcagaccgttgatgcctcagggcatgttgtggcagggtcctggccccaactcaagttatgactctgaacaagctctcctctgctctctggtctcagttttcccatctgaaccaggagggaagtcactgaatgatcccagggtattcccaaatgttggaagaggatccctctcttggctggactaagcccctgcgctgccttccttctctagataatgcttcaataatgaggaccagagaataaagtgtggggcagagtcaaaggtacagcagggccagtgcgcagggcctgccatgcacccacttgggggatccccaggctgggctctgggccaacaggctgttgggtcatttggtccaaatgccgctaggccttttccacttctgtctgcagcagcaggatcctgtgggtagaagggatggtctgcctgttccctgccaccccacccctcccccacagcccagccccactcacttgtcttctatgttctggtctggcctcctccactcagcctgtccctgggatccctgcatctggtgcctctcctgctccaggcaggccagggagcactccacctgctaggaggaggctgagtgggagggctgaaggcagcacagagcctcagataggtagggctagcttccctgcctcccaccaggcagggcagtgtctgcagcctttgataacgcaggcggactggcagccagcagcccagctgacagcccaacatggacccatgccctggcttatatacaagggactgtgccctggggccctgaggggctgcttttggctgttatctatcacgacaggctccagctgtgcatctctacctccagctgggcccgagatacaccgcctctccagctgctctccagctgctgacagcttcagggtggaggccagcaggactgctgtggcatgctaaagggcaggcagacatgaggttgtcaactgggtcccaagggtcccccaggcctggtagggagcagtggctccaggtgggccagctgtgagctaagacacagagtcactgaaggcttgcgtaactgggccatcacacggtgtccctttcctaccctcacatgaggcagagatcctggtaaccttcccaagaaccctcagcttgcacagccatctccccctctctggggctcgcctgtttcactcggggagattgggcttctaaggaagctcttcagtctatggagctaaaaccagcccctccctccctcagattctccctggggggccacagggaccctggcccttccttcacctccagcagtgtccctagccacccccagcatatgcctctcaggcaacaccctgcacccttccaggggcaccattcagagacatctctgttcaacaccgcagccttgctggggactccatttccctttctcctctgggtgccccagaccccggaaagcctccctgagaatatggcaccagatgtggacaccagctctgggcattctggagcttcagcctgctaaggggatcttgctagctcaggggacctcctttcagctacagaaagcccaggaagaaggaatgggggaggacagggcctcactttctgctttagggaccagccaagtcccagcttgtgctcccgcctctgcagcaccagggcttgctccgacagggcctccggcactgcccgaagacggcttgccagctcggccctctgctgcctgctttctgccagctgctcccacaggtccttctctgcccgcctccagtcccgctcgggggccctgttggagcacatgccagggaaagaggagccagacttcagcccaggccccagggggctgccatgcccaactttcctatgctcacctgcacccttcagtggggcttggtgggcagacacggtccaatgccccgaggaaataggagttccagagacagcgggcagggctgggcatcaagtccatgggctctgcctcagtgggacctgagaacaggacagatcctggagctggggtagtcttggcttcccaaagcaccaggctctgaggcctcttctcagactcagaattgaggccctttggctgagcacgcactaaaacccttcaaccctgatcctctggcccgaaagtctcctggtgattggaacttcactaaacaccagcctcaactccactaaacagttctcagttcccagtggtttccatgagctgtgggtgctgccaggggtggccacttgctgaacacaaaccccattatcctcacagcagctggtctggggaggcgcagcaggcactcctgaggggaaattggtgcccaagtccggcagggagtcccgtgaggagctgcaatccccacccaacactgtctgcaccagagccacgttcccccttccagtgtggaagtctggaaatggcaggggagcatttgggggccaccacagtttagctatgatgtgggggtcagagcccttaagtcaagtcactgctcaggtacctctctggcttccatagcttcagctgtaatatggaggccctgacggacctctcacccaccagcttggtgaggaaggtcagagggtagacaggggctattctgccagtgttgccatccctacacccctcaccatcaccctcctcacctctagggtctgggcccaagtccactgcctcccaactcccaaccctgggcacgaggcaccctgccctggctctgaaagggcacaggagttgtcttcacctaagcagtggttacacctagcacctctaccacccccaccctgacctccccactcctcacattcccaggccttctccactcaggatggcaccatcgcccaccaggccttctccccactggacagcttgactctcctctccccttactccaggcccaggctcctgcagccccctccaaaattgtctcccctccaaaatgtcactgccacacaaggcttctctaagacagaccatgaggactggccgctgcccccacctcccatactgggtacagctcccacaatgccactctacctgggtgctctgtcttgccagttagaagtgacaggctttccatggcagccccctgcccttagtgagaagctgagctgtgcccagcttggtccgggaggggctcatggtccacagaatggagtgcacatgcaggccagattgtcctgagcaggggggcaggccagggcagccccaggaaggctttccagggaggtgaccctggggccaaggctcagaggtgaattaactgcctccagagaaggcaaagtcagatgaggcagacagaggagacagtaaggacaatagaacaaggagggcatcagagcagctgggcctggcgggcagtgaactgagccctaagcttggtggaagtggaggtggggggcaaaagggagaccaaaaggggtgagaggagctgtggggtttgggaggatgcagggcagcggcacctccccagtgcccttgagatatgctacagacctcaactccacagaggctgaggacccagacaggagcttgggcctgaggggcagtggaggtggagcaagcctcctctgaggtggggatgggagtggaggagttacccaaacctcacctgggggcagatctttctccaagtttctgaaaggtgtgaaagtcacaaaagaatgaagctctaagggtagaatctcaggcaggatggcctccaggctgcaaagtgtggagagggagacagctgggagatggcttctgttccacctcagaaaaagagagttgcttcgtggctgggaggtagggactcctggattctcagtggtgggcagttttgtgggaaggtgactaacttaccccatcagagcctatagctcagggcagggctggggacagaagcttctctgagaacatccatcccggggacagaagcttctctgagaacatccatccctcagggctagtatcctggagccatggaaactcaggcaacactaagtggtgggaggaggagacaccagagaggcctcctactccacctcatctgagctgatgaaaccccgagatggaacctggctagtgtggtcgaggccatgggtaccaggcaggaatggcatctcagatggcctgggatttttcaaaatcttcagcttttgagataggaccttagggggcaggacctcagcagccaatctgggtcacccactgtacactgaagcggctcctaactttcttttttgagacggagttttgctctcttgcgcaggctgcagtgaagtggcgcgatctcggctcactgcaatctctgcctcccgggtttaagtgattctcccacctcagcctcccgagcatctgggactacaggcgcgtgccaccacgtctagctaatttttgtatttttagtagagacggggtttcgccatgttggccagactggtctcgaattcctgacctcaggtgatcatccacctcagcctcccaaagtactgggattagaggggtgaaccaccgcgcttggccgattttttgtttattttttgagacagggtctccttctgtcgaccaggctggagtgcagtggtgtgatcatagctcactgcaatctcaacctcctgggatcaagcgatcctcctgcctcagtcccctgcaaggagctggaactacaggcatgcgccacccagtccggctaatttttgtaattttttggaaggggacccagttttgaattagcttctgttgtttacttcggatagccatggtggagctggcagagatttaggggatactaaacacccctacaaatcacgccttgaaaccccccgtttcagggagagccgctggcgaaggacttgatgcgcagccgcagctcggaagcggggggctcccctgcgacacctccccgcttcaggggcgggcccagacccgcggggaggggcatgggcggggccgcggctggctggcggccgccggggcggtgctggggaaacccttggcgcccccgcggagcggtcccaaggagggggcggtgcctggagggatggtccgccccgactgcgggtttctagccctcgcgtggcgtggggacaattaggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacggtaagtgtgggctggggtccgcggcggcgacagcggcggcggcggccgggggtgagtcggcggggcaggcgcgctggtgccattcggtctcggcctactccctttctttctcctcttcggcccatatcgggccgcgacctctcacccctgacccgctgcttctgccccggagggcggtcactgcagaccctgacctcgaccccacggtgttgaaggcggagcctgaacggcctctggggccgctcaagggtccagtttgggctctgtgcctgcccgcggaatggggtcggggtccgacgtagaagagccagagaagcccttcagacccctcccctacccctggcttcaggcttagtccgcagatgactcctcccttggcggcctggagtttgattctggcccagtccggctttccctctgtccccgggtctcccctcggcgccactggtggcggttacaggggatgggactctgagaccccctgggacctggggcggcaggaagggacgcgaacgagggcgcaggctcccctgtgtgttttgttgtggtggtagagccactccagcccggaggatgggctaggccaagctgacagttcaaatcccctggctgctcctccgtcccgcccgggagtctctagctttagttccgggtgtgggtgccctgatgtggagctggggtggaaattgcctgaaccaggcccccatcagaggcggagttggcggccttccagcttcccttcttgatgcccttgaaaaggaggagcgtttcaccgttggtggtggaggcttgcgaggtggcaggtttgaggttgcagtggtagggcagtccagccaaaaataaccatgggtgctggggtggctggaatccgggagggcagccgctgacctggctggctgcacttctagtcagcccagttctctggccaggaacagcaaatgagaagccgacaaggcctgtgctcaaagttgacatccttggcttggttttcttcatatcacctttttcctcattgtgcagagcagagcttcccaaagcataattgtggcctttagctgctttttaaacaagctgtttgctgaggttttcgagaatcagagataattgagaaatgggccctagagccctggctgggaggatgatatctgctatttccaatattttacttgcctagaatgtgttaaaggaaggatactcttctctgttattgctttgtgtgtggtaccttataactctcatgcttgtcatctcttttgccaggctgagagatgttatctccattttccaggcatgctaaccaaggcctagagtgacttgtctaaggtcatgaggctggtatgtgacagcactaggatttagtttagttttctgccagagctcttgcctcccagtttccttggaagggacttataaaatgtctgtaaggcatttaacacagccctgaagtgttacctggaactttcagatgttcatgaaaagctgccactagtacctctgtgggcacaaagctgtgctaggcatttcacttataggagagagatatttaatcctcacagaaccttgtaagagattactattcccttgttgcaagatgaagctgacggtcagagtagtgtaataatttgttcaaaggcacacagctagaagtggcaagccatgattcagattgacatctatatgactctgaaattttgttttccattgatgtgaatatgtatggacataagaatcttctaggtcccaggaggtagtctttggcgtggtgtgactgtgactgtgtcctccagctctggtgtttgtctgcccagtgaggatgggcaggaccatacttgccttgtggcacgacatgtgccctggccaatagagcatcttctgggtcaattagtggggtgtgagttcctgctttcattccatagcttgggcacctgacccagagtaattgcaggaaaacagtgaaatattagtcagctgattaccaaaacaacaaatctaagcttttggggaggtgatttcacaaaatatttatctccaaagacttcccaggtacacgggggaagacaagttagtggggagatggagggctttcttagggacacggagaggctcccaggggtttggtcacataggcctcactgtcctgctcaagcatggggagctgttctatgctgcttttctcctgacagaccctgctggtgagatggggcagcctcagtgggtttgtacaaaatgtgcttggccaggcaagctcaggactgaccatgactggaggttggctgtggccaagtgtgagtgttgggaagaaggctggctccatggaggcagtcagggattgacgtatgggtggagcaggttgctggcctcacatggccagctttctccgctggtggcagatccagcctggcaatttcatttggtggatataagtcctcactgaacagggatagtgaggtggggctcttttacctgccagatggctaaccctctggctatcctgggataggcggagggtaggatactagagccagagagctagaagaagggacagtaacggtactgttggataaaggcaaggcacctggcagggcactgtgggggtctaaaagggtgctaaatgggcctctggaaagaaagttagatgcgctgggtccacgtccccttgggttgaccctcaggagggctatggaatgtttgtgaggcctgtgtgcctctttctccaagggctgctcttctagtctcttgtggctcctcatgctcacttgtggtccttactcccttgagtggggtccagttcagggccctagccagacagcgttcagcttctcaaacttgagggctttgagccctcgcctcctgtgtacagccctttgcctggcctttggctttacagagcattcacttcacgggaccgcccccccgggcgggagggaatagagtgcaggaggctcccctttctcctgcctttgatctccctgtggtagtgttcaccgtccccacccagggttactgcctcagcccctggccctggctcacccagttccctgagcacccaggccaccaggctagtgatgctctgctgggagctgtttgtttgttcactggcagagaaagttgtttcctattgtctgctgtttgaccagtgtgacctcagagttcttcttcacttcataaacctctgggaggggccgccttcaaacagaacaatgggcctcttcaggagcaaccgggaagccccagcagccccatggctggaggtggctggctgtgtgtttagcagggctctctgttcctcgtggcctagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaaggtgagagggaactagataggagggaaagactccttctgtcagctgggctcagctgtggcagctccagactccttgagatgactccatccctgcccagctgtccctggatccctgccctgtcctctttgggctcctccactaacctcacctgcatgccttggcctcagcagtagctaccatccttgccgcccactctttctctgtcttggagtgccttttcttctccccacacattcccccattttctaggccagcatctttccgcttaacctcctaagccttccttggtgaggattaggaacataacctcacccctggaaagtttgctccctgggcctatcttagctcccaggtcaaacttagagttgcagcaggccacagggaactctggaagggtatagaacccttggaggcactctaccatactccccttcccctgtacccctcctcctacagctggaggatgctgtcgttggacagggctctggagggcgggcttagtacctttgcaccctcccctctctgcccacttcccaccagtgtggatgcttttagcacaggctgtccccctttagccctttacagtggccttaccacaggtctcttgcttgctaacagcaaggacccagctgaccagcgtccccatcccccttttggcagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcggtgagtggtagccagagtgtgctggctggggcttaaaggcctcatctcttcctagccttctctcaggctggctggtccgggtgagtactgccagccctgtgcacgtgcactggtgtgcgtgcatgtgtgtgtgtatgtgttgtctggtccaggtgtagggctgatcacagggtcctggcctctgtgtcttctggctctttccagtggcaactgtaggaactctggctccgatgctggctggcccctggcctgtctatgtctacacagtgctccagacaaaggccacgtggtgcaagtggctggggacacttcttaggacacttcttagggatcctagtagagtggctggtatggtggtctgcagctatatggcctggtccttcccacccagagactgcctcctcgtgtaactgagtgctctgatgtggactgcacccacctctgcgtctcatctgcacaccccttcccaaaggcccccagtctggagtgcctcacaggaccggaggatttgcctgtcagccagctcagactgggaacttcccttctgatctccagccaggccctctccagccgagcctctttacgaggggcagtcgcggtgaggaggggcaggtgcctgtgtgatggggcatgtgaagaaatggcagaaaggctgccgccccaggcctcgtccagttgcaggccacatgcccagagcagggcctggccagtattcctagcatggagggttgtaaggtctctggagcccacattgcgctcagtcccctggggaagcaaagccagttgtgtatttccgaggttacgtgcggtcttctcttctcccccatccctcttccctgcctccctcctgccggccttgaggcccctgaggagcagtggagaggccaggtgtcttctctgcccagcgctttctgtgacttctttgagtggctacaggttgagggttgactgtgcgggcgattgcagcgtggccctttcacctctttgcacactgccacatgctgccacaggatggcagtgcaggtctggctctgtttctctgtttggtgccctctatcgatcgtcgtgaggcttgggatgggcctagattgtgagcagcatgggtgccaaggccagggcaggagctggcatggggcctgtgtgggccattgtggtaggaagcctggcagtcgactggcccagaggatcccaggctgctttccttcttgaggctggtggcaggagggctgctgacggaaggctgtttctggtagtgatggtgaaatctggccaaggatgccgtctggaggcaggtagcagcttggctgtgagtggcagctgtcaggcatgtgcaagtctgcgtgggcgaacagaggcaggcaaggacaggctgggcattctgcagctgaagccggagcagccgctgaccagtctggatggttggacccaggcggggccagctgccttcttgcgccgccgttctcactgcatcttccgctctggcccaaagccacatgggagggtctgggagggagagactcggaggaggaggaggagggagtcggggcgatggctctcctcacagcgtggccctcagcagcagaggcaggtcatcttcctgagcgtttgtggcgctcctcttaaagataatgtccgagttttctttacatacctgtagctgtttttacttttctgtttttgaagtcagtttgtgtcttgacgtgtcccttgcaatatccctatcgttatatatgctgtgtgccttatgaaatgctgggatctggaaaatccaaccaaccaacccaccggctcctcaccgtctccacctctgcctttgactgacacctcaatctgtcaatcggaaccgcctaccatgcgattggtcggatggcgtttcggggggcggtgcatgcagagaagccaacagagcagtaagcgcagcagccggagtgtggaagatgacaaggagggtcacctggtgtgccggatcggcgattggctccaagagcgatgtacagccacctttcgtaaaactttacctctctactttctaccccccttgttagacgagacctctcctgcctggaggggcctctagtgcgcgtggtgccttagcggggccaccagtaattgcctgaatgacacagacactagcaacttccatttttaagagtgtagcagtgagagagaaaccttttttgtttttgagaatttgaatgctgtgaacttgcaggagctgccaaccccctgccctccagattctcatgcccaatttcttttctctcctagatgagattgtggggaacctgggtgaaggcacctttggcaaggtggtggagtgcttggaccatgccaggtgagcgagctgcggcagtacagctggctccggatgtgatcttcctgggaagagctggcctgaggttcttgagggtggcagctatcagagcttaacttttttctttttgaagggtggcatcaaagtagggttccgacctgtccatgttggggttttgctgaccccctgtaataagggagaaattcttgggtcctgcagttatgtggcatccctacccaagaattgttggtcagtgaaaggttctgctccaatctcttcacttctccagggctgtggtggtggatatcagaacagggccaaggccccggctcccctgtggcttggagctgcttcctgtgataacttttaggttcttggcttagcaaggggctaggagtaccaataagcccagcccaagcataagtcccattccctgagggtctgcctgagaggctgtgcagatctcagtcgagagaaacatgaccctgggctttctcaccaagcaggctgctgccttcttcagtgtgactagggtagtgtgtggtctccgctgagtgtgcctgggagagtggggtatacctgtgtgtgtcatgctgcacctcactctctcccaagcccaacagtacaatagttttttccccttaccattccacaagactagaacatttgcttcctctcctataggtctgggttggggaggccacctccagggagccagttgccaccctgccataggctctctagttggtttggcacttcagctacaaagtgcttgtgtcctcattggagccacatgccacccatatgtggccctctcgctatttcagagatgaataaacatgctcagggtttgcctgcatcatactccagttaacagcagagctggccaccactgcgctgtagtgctcctacattaaatggggtgttcaggtcattcagacccaggcgtccagcctttcctgtggccacgagatagactgagaggaagtgtccatttgctccaagttcctatgtaaatgcctgtacgactcagcgtggcccaagaggttagggttgggaccagtgggtggagggacatgcacaaccacaccgtggccaggtggagacatggcagactcaacagccgggatgcatgtaggcattctgggctgctcctctctcaggagctggagggaaaatgagcctctggagtcactagggggcaggtggagggtccagggaaactttacgggactcaaagggagccagggccagtgggggttgtcatgcagaggcagaattcagctcagcgaaaggcagggtcttattctaagagcagtgcaactctgacaggggctgccttggaagtgatgagctccctgtgctgaggactggaatgccacggagggaccctgttttaggaggaggccggagtgcatggcctttcccctgaggtcccttcctgccctgagaatctgggaaaataggtagggagaaaaaagcaggggattctctagaaggtccctttatcctgggcctgtgagccttaggcaccacagtcagcctccctgaggcctcagaggacacgcccttccaggctaggactgtctcgttccccactgggcatctgaattctagctgtcctttcctgacagggcctggcagttgagcctcagcaggtttccttctctgctggctccctgcagatggcctcctggggtgaggttgggggtgggaggcacagagcagggactgttaaaaccttctttggacacttaagaagggttcctggcattttgtggtcactgataaacactgtggcaggtaggtgcggctggagaggggtgtggtaaagggagtggccctgggcctcacagtgagaggtacccttgctggtacccctacctcttgccagatctttactcgatcctggaacccccatccctgtttgctcagacttgcagacaagctcaggaaggtcaagaggcgccgcaggagggttctcggtgggacagcctggccagggttggggctgcctggcctataggttaggtcactgtgtgagctcttggactggcactggttaagcaggattggcctctactctcccacactcctttgggagctggcagtggctgagaacataaaagcctaaggatggcaaggatgctaagagcattaactcacagatctcagggagcttgctgttgggtgggcaaaggtctggtgttgcatggggcaggctgggcatccagtatctgctctcttcagtgccggctgctcctggagtggtgtttgttgggagttgctgggttggggtggagggttggggaaggactgggcagctgctgatgagaacctctgtttccttcccgggtaccagagggaagtctcaggttgccctgaagatcatccgcaacgtgggcaagtaccgggaggctgcccggctagaaatcaacgtgctcaaaaaaatcaaggagaaggacaaagaaaacaagttgtgagtatctgcaaggagtgggagggaagccttcagtggggctgctggacccccaggggcttagtagtgtgccttcacccatccgcactgtgccttctccccacactcagaaccaggggagtgtggcaaaggtcttgctggaagcctttagactgcagtccagtcttcaccccagctgtctctgtgtcctgaggaaggcctcccagccctgcgttttgtgaattggggagctcactgggttatgctgggcataaaacaagataaaaacatgaagttggggctctcacatagtaggagatacccaaaggagggcctttctgtggcagacacactgagcactctcctccacgcactgtgctgagcctgggcagatgggtgaatccagcacagaccctcacgaagctcagcagagtgagcaagtggagaaaagcagcaccagtcctgcggagtgcactagcactttccatctctccctcagcaactctgaggcagggctgcttccatatcataagtagggaagctcggagggcttggaccagaaccgtggacatctcccctaccccccgcaggaagcttagtccttgcccagagctcatctgggtattgggtgatggctggtggggagaggtgctcttgctctgatttctcttgcactgtgtgtatctgcattctggtgtgtgacccggtggcctaggagagagttgggaactgtcttcatctgagagagggggtgaggcaggcccccagcacacagcctgagccctgcccatcctcctcctccagcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatgtaagtgtccaccctcaaaagaagcatgggcagccacatgcctgcagccaagtcatctggttacttgttgtccccattcattccagcacgttactaaccattctcctgggcctgagggacaccagatcccctttggcggaaaggcctgtctttgggtgggaatctcagtgtgaggatggaaaggctagggctccctccagggacctcctggaccagcctctctacccccaggcactcaggaagaaaacagaaacgaactgctctggaattggcctaaccaccaaccctgcctccctgcttcatgcatgggataaaaaggtagaagcctgacctgacagatagcaccacaggtcctgcccacatggagaccctcggtctaaccctgacttgtcatctccctgccagcctggaaaagcattatttggcagtgccagggctcagcgcagtaggatttgcaatggttgcagcagtacagaaaggctccttggtgaagttggtaggcgttgagctagaatcgctcaaggtcaccccgcatcgctcccctaccctgagcactgctactgtgataggctgcaggccactggggtgggaagccccacatggatgagaagacaggtgtcttcctcctcccacaggatctgcaagatgggacagggacaaggattccaagcaaggggaacagcttggtgaggcctggagcctgttaacgggctgagaattggctccagtggagtagactgccactggggagtggtgggccacatagttgtgagggtcttgagtgccagatgggatccttgagctgaaaagtgactactagcaagaagccactgtcagaaggggctggaggggaaaggcttgcctgcttatgactagcaatgagaggcggggctgtcttcctgggtatgcgacctgtgcactcagtcgcacaggaccctgtgcttgatttaatgtccttttgccaccaccttaatattcttagtaacttgaacaggggacctgcattttcattttgcaaagggccctgcaaattatgtagctggtgcagggaagagggaaccacctcgaggctgttgctgtagctctgctgagagacaggtgaggaggcctggtctctgcagaggagaggtggagggaggtttttcgaatggcaaatttctttcctacccccctgctaaagtatcagaaccctccaaggcctcaagtacagagaacccttgagagggaggccagcacagaggcaggctgtagtccagctccctgctgaggtgggggtgtgaggacctctggcagttgctggcattggaagaggggtctggcctagagctggcaggagagccagcttctcagtgcctacttccccttctttccctgctaccttagttctgcatgagaatcagctgacccatacagacttgaaaccagagaacatcctgtttgtgaattctgagtttgaaaccctctacaatgagcacaaggtattggtgggggtaagggtgaggccctgtttcaggggtgggttacccgctggtgcagactcctgacctggcaggcctgccttgcctttcagagctgtgaggagaagtcagtgaagaacaccagcatccgagtggctgactttggcagtgccacatttgaccatgagcaccacaccaccattgtggccacccgtcactatcgcccgcctgaggtgatccttggtgagtgactgtatggcctgtgaccttgtcatactggactgttgttgggagggtatgagcagaggcagtggcatgcctgtcattctctgccacccagggcaggcagagtttctcagaccaaggggccagtgtcatgagacacaggtgactgacctggctttatctgtcagccttactgagagagggcctcgtactgggatttgggcaagagtcctgccagccggtgtggtggctgccttgtgacttccaggctggaagcataaggccggatctcacagcctctccccatcttggcttgcagagctgggctgggcacagccctgtgacgtctggagcattggctgcattctctttgagtactaccggggcttcacactcttccaggtacagccaccctgcattggtcccctaccctgagtactgctactgtgataggctgcaggccactggggtgggaagccccacatggatgagaagacaggtgtcttcctcctcccactaatcatcatgtgagattcagaccctttaaggatgtagatgctaaagggaaggcagaggtcagggtagctggaacactcagaggagtcttatgctaggccatcgaggatggaggatggggtaggaggtgacctgaccttctagataaggggcacagatgactaaaggcatcgggatgggctgggacagggcatgttctgggcagggagtgaagagctaaccagagagaaatgtagtcacagcccagtccacctccacccacaagggctgaggagcctaggcacaggctggcaggagaagctggggctgccgcttcattggtaggtttgcatgtcctggggcagtgagggcacttgcccatctttcttgttcctttttctccttgaaggggccagagctagtactgacccccttgcactgtccctaatcttccacagacccacgaaaaccgagagcacctggtgatgatggagaagatcctagggcccatcccatcacacatgatccaccgtaccaggtaaggaccccagtagccccctcagggttggtatagaggcctttctcttcttggctgtgggtcagcagggtactggatgtggtgagtctttgctggacagtccatggttccgcaggctcctaaaagccttccctgtgtgcccctgcagacctgttgccctggttctgctgctgtcttgggagctgctcttccccacctcccaccagaggcttgtccccttactactcccacacttgactccacccccttaattttcaggaagcagaaatatttctacaaagggggcctagtttgggatgagaacagctctgacggccggtatgtgaaggagaactgcaaacctctgaaggtcagtttctggctacccccagctgaactcatgccaaggagagaccccaggcactgggcagacatacagcagagacaggccaggccgctaaaggctgcctccttgatccagctctatgggaggcggcacccaagactgctgggtgctggcaatggggcttcttgcaaactgccccagaggggcccttagccctaccccttccccatagggtggctatgaatgtaattggggaacaccagaagagccagatgtcagaagccctgctgcttcctgtccctctctctcctcgaaattttgggaagaactaggcaggactgaggtgagggggagggaagacctagacatggccaggaagcctctgtcaactgcatttggtgctcggacaagtgaatttcgcagaggtgatctctacccacctgtcaggactttgcatgtgggggcagaggcatcaacccagcaagacacctagtagcctggcaagttccgagcaaaacgttaaacaggcatgaaaggaaaggagctgctcattgtccaggagggcggaagtagagtcctccaaggaggcatcactgcctcctcgatccagtccagcaaggcgtcccagaggcaaggggacctgctgtggcttcccacgaccctgccgtcacactgaggcaccttgtgtccctgagcagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttcagcttgtggagagctaagtgtgaactgggccaggcacagaagagctaggcaggggtaagaccagaattggggacatcctctgggcccaggctgctgagcagtcctagatggcacctctgccctgctggcttctgtacctctcagccccagagaacctaagggaatcagcccaccgtggctagccaggtggggtctggttttccacagcctgccagtcccattactggccaggactttaggctgtatgtgcccaacaactatggcctgctgagggcaggagacgagtggggcgggttcctaggctgggacagacagcacctcatgacagcctacagagcaagtcacacggcacaggactcagtcagtcattcagctttatttcagtgctggtttttggttccctaagagctgcatgagtgctaggcttcaccacgtgactgggggccccttgggaactgggtactatgggcaggatgcccctgaaaagaactgaagacagaggaatcatacttctctttaatacctctggggaaggcccaggctaaggatgagggcagggaccagtcccagtgccccctggggagagaagagggagaagcttgggcacaaactcccagtggccctgcaaggctatcatccctggatcttgctggagtggacagtcttctgggccagggttgttctagcttgtttctcactgtacctaatcagggggcctaactgcattaacaggcagccagaacctacctaccaaaaagcctgtaacctagactgctcctcagattttggccaagagagggccccggcttgggagctgcttggccctgagagtgagcagaggctcagagaatacacagcacaagggttacagtccctggcctcttcccatcgctggagacaatttaagactgaagggaagatgagaggaggggccagccctctaccctggctcatctgcttctggctatgttcctacaagggaagtgataacagcctgaaacccgtggtaccagggcctaccctatgtccacaatccttggtgagcccttctgtccacccatccacccgctcagccagcctgggcagacacagagcagaagcagcctgaagccctgaagcaggcttaaacacaagtccttgacaggaatccctgccaggattccaggcatagatcctgttctaccagcctccagggcctagagcttggcaccttaggatttgagcatcagtgtgttcctatggttggaacccacaccagctagctcatccagaactagcctcattttgccatctttgagacagggtgctggccccaagcctactcatctagactggacaaatgtaaaaggttcaaagcccagatgatgtaagagctggggtggagctcaagcacgggagcccatctgcctgctctgggatgacagctgcaaaggaccgtttcaggggaagggcagaggggatgaaagagtaggtggggcatgtatgtgcgggcaaagggctggaggagtggtggcctaggacagaagcaccaggaagcctcttctggttcagcaccaggctcccccagggatatccccatctgaggggtctggccccagactaggcaaaggctcaacctgctcagctttgagggtgggggcgggcactgctggcaagatgggcactgtggttctacagtaatataaccttatactacctgtgctgaagacgacagaacaacataaaatcccaatacagtaacaccatcctaatgccgcccccttccctacctctgagtgatggagggaaaaggagggagagatccttggaaaaatcagcataaaacttggatcagctcaggagtaagggtcaaaaccccccaaatcaacttgtggggctaggggaaggcctggtctgtcacagccctggacatgaatggagagtgcaggtctgccctctggtggacagctgccgtgcagctggttctacagaggaagggctgtctgcgtggggaaagcaggggagacacaaagccacaagctctgaaatagagcaggtacaggcccccagacaggacctggcccactcttcaatgtgtgtgcccaggcccagtggctgtaaacctgaaacacagtcttgagagctgcctacggctgtaaacaaaggcccacctggccgtgcagggggctgagggtagagatgcctggagttgctgcacgctcagcctgccacccagcccggaacccagtgggaaagacttccctggctaagagcaagtgacaggtcagttttaagtaagttctgttctctcacagaagaaacaaacccaaaagagaaaaaactttaacaaggtccatgaagcttcatatccttaaggcgtttgttatcaggagcagcaggggacagcagagtcctgcctgcgcaggaaccctctaagcagagtgcagtgggataacaaacttgcagccaaagggcgagtggtagttgatgcccacctcctggaagacctgctggggaatgccaatgtcgcacaaatagatacggcctgcgtgctcccccagtggcagaggcaggcccagtgccagtgaccatttggcatcaatgccctgttcgacttcatgcacaggagggtctatgctgagtactggtgcccggttctggttggcccaggccacagctgccttgtaccagggttgatcgcgcaggaagacgttctcagggcaatccaggcagttgatgaccaggtccacagggctagtgggcagatctgcaggtggaaagagtgccatctgaaagtccctatgagcagagagcagcccaggctgggactagggcccaggtcaccccaagggtgtctttgttttccagacaccactcgaatgcctctccaaaggctggccttcttaaagctgggccagggcacaggccctaggagttgcaagctggctgggctgagtgctagagaccaagtgcatgtcagcccagcagaccactgccctcctggagttctcaggatgaaccattgtcgtcctgagtgtgcagagcttctcagggcacaaagccctcacctcctctgccttctcaggcatgcctctgtatatccaactaatgccctgggcaccttatgacctctgggaaggcagagtccactgtcaaggtggccatcacagggaaaccccactcaggtccagcaaaaacaggagctgactgctatctgctgacccaagaagggtgagcaggtgagagcatgcttattctattccagctggcctactcattctactctagcaagcctgtcccctctcgtactcattatctcacaggaatgggtcctccactcagcccaaccttaattaagaattaagagggaacctattactattctcccaggctcctctgctctaaccaggcttctgggacagtattagaaaaggatgtctcaacaagtatgtagatcctgtactggcctaagaagttaaactgagaatagcataaatcagaccaaacttaatggtcgttgagacttgtgtcctggagcagctgggataggaaaacttttgggcagcaagaggaagaactgcctggaagggggcatcatgttaaaaattacaaggggaacccacaccaggcccccttcccagctctcagcctagagtattagcatttctcagctagagactcacaacttccttgcttagaatgtgccaccggggggagtccctgtgggtgatgaggctctcaagagtgagagtggcatcctatcttctgtgtgcccacaggagcctggcccgagacttagcaggtgaagtttctggtccaggctttgcccttgactcactatgtgacctctggtggagtcccttctctgggccatatttgctctctccaattcttctccctgctgttctcatttaaacccattccagtcagactctgtccctaccactccacttaagaccactcatcaagctcaccaggagcctccacagagatgctaaatccagtggtcgattctgtcttcctttgaccttaacctagaacggggcttgctgacacactgaccacatgctcctttcttcacttggctttcagctaccatactctcctggttttcttcctccctcactgaccattcctgtcccatctccttggttaggctctttactccctgacttctaaataaagagctcagttttccaacttctgtatctactctcttcctatgtgacagcatatccaggctcctcatggcttaaatattccctatggcttgtaactctaggctgaatcctttcacttcagattcatataactcgttccctatcaacatttccacctgcatatccaataggtgtctcaagctgagcttctgctgttcctccccaaaccttctctatcaagttttcccatctcagtgatcgcacctcagttactgaggccaaaaactttggagccattgccaactcttctctttctcccaccccccatacatccagtctgtggattctatctccaaaactgatttagaaactaactaccttcaccacctctggcactaccactcttgtcttagccaccataatctctctctcccatgatcacaacagcatcttgacacttctctgtactcctctgtgtagtctactctcaaacagcacccagaatgatcatctggaacctaaatttgattatatcatttctctacttattccttcaatgactgcccatctcaccagagtaaaagcccaaatccttgtggtcatccccaaggcccatcatgacctgaccctgaaatgtccaagtctcctactctccacccagtcctccaacatgcctcctttccctgctttgtttttatccacatcacttactacaactacacaagtatgttacatgtctttttgttcctcctaaccagaatataagctccacagaagaatggatttaaaaaaatctgttgccatatccctagcatcaggaagagtgcctgttcaacgaatatttgtggaatggaccaatgggtccccagctcttcatgtgagtagttggagagggagaagcataaggggatgggaagtagtatattactgttctaagactccttagaggcgaagcaccatccttacacacgtagtgcctttccacctgtcgccactgggtggcatgacgagaccatcaaactgctaaggagggaggaggccttcagcccagccctgcctaagtgctcacctttgaggctagacacttgttggccttgggtcttgctgaagagcgacagctcattggtgatagattccaacatcttgacaaaattgggcaggaaaaggatgacctggacatcatggttggctaggtgccttccacagctgataccctgagcccccttcacatgaggtccacacagtagagccactgtaggcctctggtgaacatttttgggattcaacctggaaaagaaggtgaagaagcagtatcagctacatacttgccaatcccttgcaccctataccagacaattgcctgtagcacctattggtctcagatctcttacccactgctcaccaagtcccaggctccagagggggacaaaatccactgcaggccaggtctatagggtggcactcctgttgtcccaaaccccaacctcacatcattgctgggtcctcccactaagtggttcacccagatcttgctccacacaacactgttgccacaacaccgctttgctgacccatgaacacttaatagttcctctgcagccttgtctgctcttcttccccaacgtgtctgcttcactccagcagggctggtctcatcctctcctgcacttgtaaggctctttcctgcttatgctcaaactacatcccctgcccagaaagcctttcactttccaaactctgaaccgccttttcttggagatccagttcaagacttacctctgctgggattactctggctcatgcctttacctctcctcaactcctaataagctcacagcaagtaccatagctctccattctcctcagtcagttgccaatggttctctttactgagcttagtagcttactgaagttaatgaaagcaatgctgcaggcattaacagtatctatttcataggatgctgtgcagattatcggatgcccagcacttagcagtgcctaacacaaagaaggtaaggtactcagtcagtgctgaccatggcggaggcagcaggccaagggttacctggcctcctaggctagcagctgccttggatgaagttgtcacttccagttttctgctattcaaagctgagactcctctagactcagagaagccacaaataaggagataaagaggattagccccagagctgtgcccaactcataggcagcacagttggctcacggggcagcaatgtagggaggagatggacggcaaggccataggtccctgcctagtggcagagcaatgatagtcacttaccggtttcccaaagggaggaagatgacaagatgttgtcaagctaagaggagcttcataactgcccccattcccaaacacattttggagaatttaacaatctactctatattccagacaccaaaccattcgccttcccatttctgcatttagaggaaatatgatgagaattgctcccttcagaggatgctgcagagttgtggaatctgactcactttgttctctaaaagggttcttcctctcagggagaacctctcccacccccaatcaaaagaagcagagcatggcattcacacacccagcggcaaggtgtagagtatatgggcactggaaatggacctatgtggattagaggcctggctggactgtgtaccagcagtatcatgtgggcaagtccctcagctctctgagccacagtgtgcttatccaaaaacacagggctattatttagctttgaggtgaagttatgaggaccacattaaattatgttgtgaaagcactgtggaacactgcatggcacctgacatacattaaacttcaagattactaaccacgggtctgatttctcaacatcagcaactgctacaaaggacaggagatggacctttggatagttcagacactaagagaaaagactggcacaaggacagccagccccaagaagctggctagagaggagtgtgatttggtaaggacattcagctcctgctccaaaactaatgtttctgggaagccacttaatggtctcaaagtgcccccaacagtggctctgggaggaggtgcaggagacaccagacacacgggcctgatgctctttcagagggcacctcacactaccccctcctgtaggcatttccctggctcttccctggcacaggagagcccaaggatctaacagctaggaagcaggcctaaatcaaagaaaaaggaaaaactaacactccaacccccaactcaaataggatgagggaggtggaaatcttacatctggcttggagtaagcctgcttgaattaagatcacttcagaatcaggagatgccttccatccaaacacattatcaggcccagagaatgaaaataggctggagtgaggagctacaggatttatctgcaatatcagttttctggcaagcactcccaaacaccatggctggaagcacaagccaaggaccaggttccattttgcaaatagggaaggggccctgtgggaagcaacatcctatcatgtgaggctttggatctgtgagtgctgctcagggaaaggaggctttccttgccccagtgaacccagatctgccctgctctttggaagtggcctccccactccagacaccactctcccacaaggttgcctacatcctcctctttaccgaaaaatccaacaggcacttgtcaactctaattttgattgatctctcagcactaccattgccggccgttccttttttcttcaaagactatttccttggttcttacacgctaccctcttggtttcttacctctcctgccttcttcttcatccttctaactgtgccttacatgccgacgttccccagaatcccaccctaggccctttctgttcacaccttctccttatatgatctcatctactcttacaccatctacaagctgacaactcctaaatctctagcatcagctaagacccttttctgaacttcagatcttttttttttttttttttttttttgagatggagtcttgctcttgttgcccaggctggagtgcagtggtgtgatctcagctcactgcaacctcctcctcccagattcaagcatttctcttgcctcagcctcctgagtagctgggactacaggcacctgccaccatgcctggctaatttttatatttttagtagagacagggtttcgccatgttggccaggctggttttgacctcctgacctcaagtgatctgcccgccttggcctcccgaagtatagggattacaggtgtgagtcactgcgcctggcctaagtttcagatccttatagctaagagactatttggatatctcacaggtattccaaactcaacacatccaaaacaaaacccaccatctctcccaaacctgctcttcttcccatgtttcctatcacagtgaatgtaaccaccatccaatcagatgtccaggctagaaaacttgaagttcactgatttctgacattatactttccattacctctaaaatccattcaattaccttgccctgctgaatttaccttaaaaacaacaacaacaacaacaacaacaacaacacccatctgtccacttctctttctaagagacaaaaaaaaaaaaaagagacagacaaagtctcactacgttgcccaggctggcctcgaactcctgggctcaagcagtcctcccactgcagcctctggagtaactgggattataggcatgcctcaccaaacctggtttgtccacttttctgatccctgcttccctagttgggccaccatcacttgggccctggctcagttttctaagttttgcagttttctacctgatctcactgccttcagtcttgcctccattgaattgactgtcctcattgtagctaaaaatcatctttttaaaacacaagactaactatgtcatagctctactgaaatgtcttcagcagctccctaccactcagctgtactgaggccctactttccagccacatagtgacttacggattgccaacaaccatgtgccatggtctctcgattctctctgcccttggcacatgctactccctgtacttagaataccttcttcttggccaggtgcaatggctcacacctgtaatcccagcactttgggaggcagaggcacgcagattacctgaggccaagagtttgggaccagcctggacaacatggcgaaaccctgtctctaccagaaacacaaaaaattagctgtgcatggtggcacatgcctgcagtctcagctacttcatgaggctgaggtgggagaattgctcaagctcaggaggtggaagttgcagtgagctgagattgtgccactgtgctccagcctgggtgacagagtgagaacctgtctcaaaaaaaaaaaaaaaaagaatgccttcttctttcttgcttgcccctgttaatcaccacttgttcgtcagggctcagcttggatgccactgctccagaagggtgactggtttctccagcctggggcaataatatggcttactggagaattttgtttcctctactacagcactatactttctagagacctcattgggctactagaggaaaggcacagtattttattcttcgtgtccccggtgtctagcagaaggtctggcacctggtatcagtctgtctacaaataaaataaggcactgcccttgatatatgagcataaggggcaggtgggaaggtgccaaactccagctcccctactcagttgtcagtgtggttctggaagctctcaggtatggagactgatttgcatcccagccacgtaaagtaaatgatgagtgccaaaggccaggtctccgaaggttcctagaaggaaggcttctgatagttagcaggagtctcaggcccgatggctgctatcaggagagagtcaaaaggcagcttgccagaagaataatgaggacatctaggagatgggtctgaggaggggcaaagaaacctcacagcatccaggaaagtgacttcagagagacactcccatcagatgagcagaaactgcctaatgaactcgtatgtgtgtatgggaggcactgtggtggtggccaggcagagcatccttactccacattgagtccctgccagtttatagacatttacctgttaggtcctccgaggagggtcagtgccatctgactggcacacacacctgtcatctccagtctccgctcaagggtcagcccatgcttctcagccacggacaacagctttttatgcagctcataggaaatacttgggacaaccaggccagagtctgcagttcaaaaggagaagagaaagggaaagtgactacagaaaccaagtccaaaccgggtatactctatccaagattctgcaaatgccaacattttaccatggatcacccctggcccatcctcttcatcttccgggactaaggcacgctctgcagctctgcagagctcaagtagtgactggtgaaccaagtaacaacttgttccaggtcaccacagagtggggacaaacttaagctcccttagcaatttagctttagaccacaaaggccaaatctaccaggatatatttagtgctatcgagaccagcacacagcctgtaacagcaacctatcaggcacatgagaagagaacatgattttcccaaagtgggggaaatgccatcttgggcagcggggcttcctcacaagcaggccccttgtccttcctgagaagtggaacagacactagctaaccctaatggccctctggtccctgctgttctcctcaactgtagggcaggaggacttgttccatctgcttccctcttcctcttccttctctcttctatttaccccttcctttttgattaagaaacttagctagcaaagttgttttctcaaataatttatcattttctccccatctgagttgggtgtaacccagtactcacgaaacagggaagcagtacaagttaagtaagctatggctggctttaaaaaagggtaacttttataaaagttggggagaattagtcactgaaagtacactgtggaaaatacttggtttttcaaggctcaaagccaacatctacagcagctggtgtatgtgaagaagtctatagtattattatatgcaccagtgtcaacataccaggaaagaaacagcaaacccaaaaatttggatctgcaatggacagctcttaccttgacaaccaaggtattgctccctccaagaagccaatgccatcttacaaatgccaaagccactgggctaaccagcagaccctttcccaaagagccccacttggcttcaccggccagtggaccaaccaacgcagattccaatcagcaagccactgtgggactgcacgtcactcactttgtccagctagatcaggtacctttttagatcctgtgtcctcaattatactggactgtcaactgcctgaggtaaggaaattaatcttttacttcttcagccttcgccttctcaacttgttccagctacacttatcaacggagttgagttcttatcaggtcctcagacatataaatgatgcaaacctagtgccatttctggtctggcctaactctaaggtagaagagttagggaataaaagttaataaaagttttcagtacatttatctccttccattgttccagagccttgtctagaaaaatctgttttcttcactggtcctgtcgggagaaatctcttgaggttatctatcaggtccagtcctacctgcatattcctaaagccacagagaatgaggctatagcttcatgttttaacaacaggaaaccaagcacaaagactgaaactataggacccaggtctgtatcctctcagggaaggcagaataacaatgtcatgtaatgatgatgataaaaaaggtctaacgtatcaaataaacactaacactatcctgttggctaactgagcccctctacctgcccaagtcctattcctgggctggggagaggcaacaaacagtgccattaggagcactgagtctctcctcccacctctttctgaaatgtcagtcattggtatctcaggtgccagtgctggaggctgcagactgaccttgcatgtcaacagctgattaaaacagccatttttatggcctgcttcagacacgcacatattatcagaactaattaggctgaacaattttcaaaagtcctaagccacgaacaactcaaacctgtcagacaagtcatgcacctgactacttcaaacaccctctttacctgcagagtcacgcaaggcagagctttcactcgtctatgcatttcttcacctatttatcaggactctttctgttagatttgaaatgggtcagggcagtgagtcttgggcctgctactccacaaatcaagcattctttctaggtctggctcttgtgctacgtgtacaggcaggcagcccctcccctgccccctcattctgagggctctctgggagcaggcagaagcattttctgctagctgtgccctcacagtccttaagagtacaaaacttaatggtacaggagaggagacatcaccccccaccggctggctagatgctgctgctggaagctgtgagtctcttaccacctcctcactgatctttgttgggggaaggggcactgttggtgaatcagcatatttttgcagcctagagaaagacaaagccaagagcctttctgctcagagtctggcagttatggggtctagaactctactctgactgttcctctgaaaggaacgtacaaacaccacaaaatgttccttttaaacatttatacacgtaagtccaacaagttggactggcttatcagaaacagaccaagggaataaaataaattccaaaggaaaggaaccaagaacatagcgtgtaaattgcaaacaacaacactgccactgccaaagcctgaacatgggccaagtctaattatgtttgagttggaaggtagatctttattgttcgggaatcaaggcagtaaaatcagttggtagggtttctttgagcattaatatgtattttacagctgctggtgaaacaagaaagggagagataattataaccagatcgtgacaagcagagaacttcttaggatctgattgaccttagggtatcaaggaagacaacaagtacactcagtacaggccaggaaagaaaactcctccttgcacacctgatttccactgcatgaggctgaggctgtctcttcggaccatgggacgcagtggtccagcagtgcccgtgccggctgcagtctgccccttgtcaggtcatcactttggcactgctcattccagcacacagcatttcaggcctttccctcccttatggacacatatatgcgtccccactccccctgacacagacacccttcagtagtaccatgtccaaggttcctctctccttcagacctgcccagtctttctgttgtgtaacaaagatcccacaacaaagtgttatctcagatctaactcaatcctctcactgattggccctttaattggaaaggctgcatgtgtcccaagtcttatcaataaggagcacagctcatttacaggcatgggatttctccaggactatgacttctgattctcttctgtggcagtcaacaaaactgagtgctgatgtcacactggttcctttagggatataaatccactggtaaatttataccccctgaccagcaatgtacagagtccctggagatctacactaaagctaccacaaactggtagtaatgcaatttagtgtcaagtgttctctgaaggaaggatttgttataagaaacctaactacacattcacgatactctttattatgacccacaagacctgctgtgatctggcctgtctacctcactacctttacctggtacccaacatgtaccccagaccccttggccaccttctggttcctaaattctccaagttccttctggcctcaagagacagttcgcttcacatgctttctccatcccaacactttattctctcttctggggctctattctctcttccaatgctacccctacacagcgggctcctcatctgtcaggtgtcagcacgctgcttacttcccttcattgcattcaatacatctgactccactcttaagtggtagttgaacaatgagaacacatggacacagggaggggaacatcacacaccggggcctgtcagggtgtgggggagggatagcattaggagaaatacctaatgtagatgacgggttgttgggtgcagcaaaccaccatggcacgtgtgtatacctatgtaacaaacctgcacattctgcacatgtatctcagaacttaaagtgtacatatatatatatatatatataaataaatctgactccccacctcttcccttccccacttacaactagaccagccccatgtccacagtggacctcattccttcatactaaagctccactggaacaagctttgaactttaagaggcaaagaactgctcaacaaaaacctactaattatgaagggaaaaattatctttacgaggaagaaatctggtggtcaacaccttaccaagtggtcaaacagccccagtgatgggacaaggggatacaatgtactccctgatgtgacgtactccctgatgtgacgtactccctgatgtgacgccttgagaaagacacagccctaccaaaatcctagaaaacatgtttaacatgaatcagatcaaaaggaaacaaacaatacatcaaaactaagacattctgcaaatcaattggcctagattcttcactaatatcagtatcacaaaggacaacaaaagttgtaggaactgttctagtttaaaggaaacagaagagatatgacagctgaatgtaatgtgcaatggatgattaaaaatacagctataaaggatattactgggataattgggaagttttgcatacggagtatattagatagtatttttgtaataatttaaattttgctgagagcaatcttgtagtgtggttgtgtagagcaatatatatcacactgaatttatgtgctgtggaagtatttagggatgaaatctaatgatgagtacaactaaatctcaaatggttcagaaatatgtgtgtgtgctcgtatgtattttacataaaacaaatatgtcacaatgttaactggtgaatctaaatgaagggtatatggttgttcattatactattctagcaatttttctgtaagtttgaaatttttttcaataaaaaaagttgggggggggggggtgccaggcaggtggctcatgcccggccaaagagtaatcccagcactttgggaagccaagggtgggcagattacttgagctcaggagttcgagatcatcctgggcaacatggtgaaaccctatctctactaaaaatacaaaaaaaaaaaaaaaattagctgtgggtggcagcgcatatctgtggtaccagctactagggaggctgaggtcaggggagcccaggaggcagaggctgcagtgagctgagattgtgccactgcactctatctagcctgggcgatagagagagacctgtctcaaaaaagagttgggaaggaaaaagggaaacaaagttaagtgcttccaaatatgatttaaaaatgtttatagagtaacagtacatcaagcaagtcagtggtgaagtggggaacagccggggaaacagagaaaataaaacgagtagaaatacagagaccgttcccagtctttttgttgttgttgttgttttgttttttttttttttttttgagacagagttcagagtttcactcttgttatccaggctggagtgcaatggtatgatctcggctcactgcaacctccgcctcccgggttcaagtgattctcctgcctcagcctccccagtagctggaattacagacgtgcaccaccacgcccagctaatttttgtattattagtagagacaggatttcaccatattggccaggctgggcttgaactcctgaccccaggtgatccacccgcctcgacctcccaaagtgttgggattacgggcgtgagccactgtgtccggccccccagtcttataatctaactagaaacaaaaaaatacataggtgcaaacttcagaaaataacacaacagccttaaactgtgttatcctgagcacgagtgcaaagtatcaatttcaaatcaggagctacaggtaggagatgtcaggtctcaatttgaactatgccttgaaagacaggcaggactgtagtcacaatgaatagaagagggactccaggtaggagtggagaaccatgaacttctcagaggccagaatgcatgtgacatgtgcagatgaatatgtccctgcctgaagcccagagggtggtatgaaggctcagtgtagagcagtgggcagggccaaggtcagaaggttttaaaagctgagctgttttatgcaggataaagttgacaggggtagaaagtaagaacagaaagaccaaggagaattgatttcaagggacatagggaagctataggatagcataaggaactaaaaggtcatgaaaatttcaaatgaaattttgaaggaaggagagactctggggccagaatgaatactactgaggataaagaaaaatctgttgccaaggctgctacagaacacagtgtctgcatattaaattagaaaaaatgacctccctagtcctttccagacctttttttttttttttttttaagaaaggagtctcgttctgtcgcccaggctggagtgcagtggtgcgatctcggcttactgcaaactccacctcctgggttcaagtgattctcctgcctcagcctcctaagtagctggaactacaggcatgtgccaccacggatagctaatttttatatttttagtagagacagggtttcaacatgttggtcaggctggtctcaaactcctgacctcaagtgatccatctgcctcagcctgattgctaaatttcaagagaatggtatatacatagaaatcaaactcctttctcactctgtctaggcacttgtggctctggaatggcaagagggcacatattagcaaagcagtcacattagcagggaccagtgcatttctggaatgaccaatgggcagtttcataaaaactcaggtgtcaggctttaatgcactaggctccagatcctctagcccttggtttgagcttaaactcttggaaaacatgtaagaagcacaatggttcattactggggtaggagtccagccaagacacctatcttaacagtactgctctaaaacctcatgagatcaccaatgatcataaccaagcccttcaggcctatgacaaccatccacccgattatccaggcccaggaactctgaaggattccaaggtaaagaaagggactgatacattcttccacacctggcactgaaggatctgctagagcctgaggttccccaactcaaccaagtcactggcagggaagtctgcctgctggagacacaaatttagaaactaggctcattagctgtgttcagtgaaaagttgtgacacttcgcagaggagcacaggtttatccagtgcaggtgttctgtccagaacaccacccagaatttatttcctgatgtctcccagaataacatccttgtggcacctgatctaatccatacacataccgttggggaatgaagttggggagggggttatggggagacaaggcaggaccctgcatgggttgggtctatgggtgagaaggcaatgagatgctgaccagctccatggtggtagacacttgattctctcaatgggaagaattatctgcaagagtacaacagctgccaaaggagacctcactacctccaggtaaaattcttcagtggcacttctaaactccaagatttatttcttcctgaattccttttgaacacacatgcaaaaaaatcaaaacagatttcttgactacctatttttgaggagataaaaacactgctggtcttgaaagccttagattacttctagagggactcttggtgacaagaagcagaggaaggcagctacggctcagaggcaggaatggaatgccagctgtgaaagagacaactgctagcctggaattttctgaaagccaaacttgtcctaagagctagatacatccccaccaaggctcaaagacttagccggccagcgtgagaagagtagagtcacaaagccacaggaacaaatcatttgtggcttcaccagctgcctcccttcctagcagaaaccagaactgccttttccaaaagaaatgagtattggtaaaaggtgctggagctcagaccagagcacctcactcaagcttaactggatcctttttaaggaaataaataggaactctagttcgggtcatcctcacacacttcctgttccctaaatctcagcgcacagtgtggaagtggatcatccttcaggcaaagctgcagagatgcctgcaccaagagcaccctactgcctcccatctgggcttttacatacttgaggacagaagagggctgcacagtagaaaacaaatggtggaggttaaagaagtctacccagaaggaaaggctcatgaatagagaatttattacaacagagggaaggaagaattctagtcattttttttaaacgttgagataggatcttgctatgttgcccaggctggtcttgaattcctggcctcaagcaatcccccaacctgtgcctcccgagtagctgggaccacaggcacataccatcacaccctggctaattttttttttttttttttttttgagacagagtctcactctgtcgcccaggctggagtgcagtggcacaatctcagctcactgcaagctccgcctcccaggttcacgccattctcctgcctcagcctcccaagtagctgggactacaggcacctgccaccacgcccggctaattttttttttgttatttttagtagagacggggtttcaccgtgttagcaccctggctaattttttatttttatttttttgtagagatggggtctcattatgttgcttaggccaggctcaagcgagccagcctcctgcctcagcctcccaaagtggtgggattacaggtgtgagccactgcagccaactacacttctgttattagtatatttacatatttggttcagttatactcagaggcccctaaggtgatgaactatgacttacccagagtatttaaaacagtgtctggcacatagtaggtattctataaatgctgatgctttgaaataatcttactgaggtggcctttgcaaattcacatttgaagtcaaatatttactgaataataattacagattgggtattgtgctagctacttttccacataatctcatttaatccacagtattagcccactttatagataaggaaaccagcttagtagcctctctttggctatataacttttaactcctcattaaagctcttaataaccaataactcccacatctccctatccctcattgtagcaactcttgcctttgctttctctgggctcaggcacaaagcattgcaggagggaaaaaaagggggggggggtcacaaaaccatgtaggcttggcccactataaattcgtgcaatctcatgataacttgacttgctgccattcttcctgcctcacaggttcaatacctccaaatcctcctgttcactcaaccctgttttcaatcatcatagcctatcaaattgccctctgttgcttccctcatatctttgtgttcctttccattcaatggtctaaatccctagtatgtaaactacatcatgagcatgactggtcctgctctggtctcttctctcccctctcgttccacctggaatcctaccacaagaccagtcttcctaaaagagatttggatcatgtcattttcctatccaaaagccttcagttgttccctatgactacaggacaaggatagcactggcacacaaggccctctatgctctggtccaaagctatattttagttccttctactccccagcacaaactctctgccctggccaagccagctaatgaccagtctcccacacagccctttactcatactattcacctgcacctgcctagcctacccatgaatatcttcctctttctctctgcctggtgaaatcctgcccatgtttcaaggcttccatcatgaagccttccttgatgcagcctacaggacctctcctgcctctcaacacctagtgcacttaatgtccacactttcactggactctgggcatatatggaatctttccatctcctattacattttcataacttaaaggcaaggactatcttagagtcagttacacataataaacataataaacacagtgttttgactgacccaaactgtcttaaagtatttcctttagaataccatgagtgttaggccaggcgcggtggctcatgcctgtaatcccagcactttggaaggacaaggtgggcagatcacctgagatcaggaattcgagaccagcctggccaatatggtgaaaccccatctctactaaaaatacaaaaatttgccaggtgtggtggtgtgtgcctgtaatcccagctacatgggaggctaaggcaggagaatcacttgaactcagtaggtggaggttgcagtgagctgatactgcactactgcactccagcctgggtgccagagtaagactctgtctcaaaaaataataataaaatttaaaaaaaaattaaaaaaagaatcttatgagtgttgaataaagattcttctctgaagccttaccactttactaagcagtattctttggggagttctcaccactgaacacagagtgctcacacacatctagtgttttatatttaaacttaacacatgcacgtagaatcagtcttcaaagaatttcaaattacaagtctggatccagaaagaccctggccaatccagagtgtgatcactggacaccattatttagcagggcaggcccaagctagagaaatgtctgatgatccgtgactgcgggagacagaagccctgccaaagaacctgaaaggaatttccagagagaaaaaattggggttaaacaaagagctaaatttagttgcttcctgaatgtgttttcccaatcaatagacctaaaacaacactgttccccatcacaacacacacagctggcaaagagtactgccaagaggagtatgagcaattagtgaataatagcttatgtactgttggttgacaccacttagcatgaagtcaatatatagggcaccagcagcaagctgtcagaatcctaaatcccaagccatcaccaaatgggtaataaatatgttgttcttttgctaccatggggattagtacaaaagtacttggtattctaggacatgaatgccacaaggccagactgcgggagctctccaagttacttctgtaaactgctggtccattcctgagagactgcagtactaaagaaaagactacagagatgtccctcaacttacaatgagtgttatcccaataaacccatcataaattgaaaatatctaagttgaaaatgcatttaatacacctaacctaccaaacaaacatcatagttcagcctagcctaccttaaacctgctcagaacacttacactagcctacagttgggcaaaatcatctggcaaaacagtacactgtagaatactggttgtttactctcatgactgcacggctgactgctttgactcctgctgctgcccagcattagagaatatcatacctgcatatcgctagctcaggaaaagatctaaattaataatttcaactacagtttctactgactattgctttcacatcatcctagaatcaaaaaatgataagtctaaccattgtaagttggaggatcatctgtagtctatttgccattaaactgcccttctcttcttatatttttccttttttttttttttgagacagagtctcgctctgtcacccaggctggagtgcagtgctgcgatctccgctcactgcaagctccgcctcccaggttcacgccattctcccgcctcagcctcccaagtagctgggactacaggcgcccaccaccatgcccggctcatttttttgtatttttagtagagacggggtttcaccgtgttagccaggatggtctccatctcctgacctcgtgatccacacgcctcagccccccaaagtgctgggattacaggcatgagccactgcgcctggccttttcctcatttttattcacatttagaagagaaaaggagatgtgatgggtaaggtttttgtgttttttttttgagacagggtctgactctgtcacccaggctggagtacagtggcatgactttggctcattgcagccgcaacctcatgggctcagacgctcctacttcagcctcctgagtagctgggactacaggcacatgccaccgtgcccagctaatgttttctattgtttgtagagacagggtctcactttgttgcccaggctggtcttgaactcctgagttcaagcaatcctcccaccttggcctcccgaagtgctgggattacaggcatgagtcactgcacctggccaatggaaaaccctttaccagctgggcgtggtggctgacgcctgtaatcccagcactttgggaggccaaggcaggcagatcacttgaggccaggagtttgagaccagcctggccaacacggtgaaacctcgtctctactaaacatacaaaaattagccaggcatggtggcaggtgcctgtaatcccagctactcaggaggctgaggcaggagaatcgcttgaacctgggaggtagaggttgcggtgcgctgagagctgagatcacgccactgcactgcagcctggatgacaaaacaagactctgtctccaaaaaaaaaaaaaaaacctttacctctctgggcctcatgtcctcatctgtaaaatgaaaaaatcatactaggtgatcaactaacctaacactaacattttatgcttttagactgtttccctatatattctagtttgccttttttgatccaaacatttggatagcagatccaatggagaaagtgtccccagctctgcactgactgcccctcagtgaaaacctgcttgaggattgtgccttggaactcgaacacagagaaaacccccctgtagaagaagttgctcagtaagataactgcctgcttgctctatttccagcacagacgctgcttggcaaaagggcttcctttccactccttgtcactgttaagaacaaagagaaaaaccagatggcatgaagctgctgggcttctttccccctcattgtcatgaaccagtggagtgcaactggtcactacataccacaagacgccacacccaagtttctggctaaggaccagcacatgtggtttgtggtatgtttattgataggaaaataattttatatgacagaacttttcacttcagtcattaaaaacaaaagaagtgtgaagatcaagttggggagccagagtgtgtagcagaaaaaaatttctacctctgcttttgtccatgttagtaaatattttctcatgctctgttagttctgagaattctccctgattctcactgttattctcactcttagccacttgactccagggcagatcataatcttcccaagttaaaaaaatcctgcagtgtagggctgggcgcggtggctcacacctgtaatcccagcgctttgggaggccaaagcaggtggatcacgaggtcaggagttcaagaccagcctggccaacatagtgaaaccccatctctactaaaaatacaaaaaaattagccaggcatggtggtgtgtacctgtagtcccagctactcaggaggctgaggcaggagaatcgcttgaacccaggaggtggaggttggcagtgagcagagattgcgccattgcactccagcttgggcaacagagtgagacttcgtctcaaaaaaaaaaaaaaaaaatcctgcagtgtaaatagttccagggaaatcacacgctgcataaaccaacagcctcagcagcagcacttggactacagatatagagagctagcagcaggagcagcttcttttacaaagagggcagtaaaaaaggaagcagtcagaggtagatagttggctgatctggaggagtaccagacttaacagatgataactgcctttgaaaggcttaaaacctagcaatttaaattaaacccgattctgagctaggctgtttgcctttacacaggtgttaaaaatcgaaggacttcggcaagttacagtgtcactgtcactgccacttaaggaaaccaccttaataaacaggcatgcctaccagaatctgccagcaaaagactgacacagttcagcagcttgttttttttttagcagtctttcttagcctgacagttggcctatttttttttttcacatggaaagcacatgcaagctactatactcagcgaaaccaaatacaacagagtcctactattatctataaaaaaaaagccatgtctggctttcctccaaatgcaattagctgcgtccacagttctccttatagcagctaccagcattcaagatttatattccttatattccaaacttcaaaccaaaataaaaatattatactcaattccttctctacttactaaaatgattatgacttcccctttagctcttaggatcattcaataacaatggttttcaaaccatattccaagaggcccagttagtaatgtggtttgaggggaagggatgggacacggatgtgatgaattacctctctcacactgctttaatctgttttatatgccataggtttgaagaaaaggttctaatgctaaaaaaagaaacaataatcactgaggtaatagaactagattatcatctacaatgacctacataaggcactacactgttacatgaaattagccaactttcaatgtcctgggctaacaggagataagaacagcatagtaaagaaatgtaatttattaaaactctatttttagccaatgattccaatcatccatcttcaactgtttttttgcaacaacaaataattagtaaaacagagttgaagtctggtgaaatgtatgggcagtaatagagaagccaaagtgaaaatagatctgaatatttgaatctacatagcaggccctttgcctttagttgttactcacagcatactaaataagtggcaggccatatcctaccagatacaggatatacacagacatctacagaaattacccctccaccatggcagaatgctgttattggctgcaatccccaagagacaataataccgggccagccaccaagccacttaaattaattcctagtgtgagattctgactcagaagccaggtctttctgtttcaagcataatagaaaggcaacagcaaccagcaggatgtgggacctgatgcaactcacccgtgcagaactccttgctcacgttgtggggcactatgatccgtcgatagacaatgggctcggactccaagatgttctcatcatggcggtaccgagtgggcctttcatttgggatgccccgggaacgggtaccacttctcctttcataggtatcaatctcctcaaacacagctgccttgtcaaaaagagccaggttcccttcaaaatcaaaatctgtgtctgggatctcctcaatatcatccccgaagcactcgtcatctttattcttcatctggccattctttaaaccacttttcttgggagttgcctgatttgggtgcctgctactagatgaccctggagaaaaaatagggactaaagtcagtgtatccacagaaagcgctcagtgaacgtggaaaatacattagtcttttgtggagagtgttacaggaaccaatgtgaaaatggtaaaggtaactattgcaaactcatattaagtagcacaaacaacaaatctcatgtgcaataataggtttcaaacatcacccaatctgggcacagtggctcacgcctataatcccacattgggaggctgaggcaggaggatcgcttgtgcctaggagttcaaggctgcagtgagtgatgatcacgacactgcaccccagcctgggcaaagagcaagaatctgtctcaaaacacacacacacacacacacacacacacacacacaaacaacaacaaatattacccaagtaacttgttaatgaatatgaaataagcagtactcctggaaatcttaaccagttatccccttcataaggaaactggtaatgacaaaagtttttctgacaacttactattagcaaacaagaggaagagtaagaatatagcatggtggttttgacataatgacagaggcaggaggcagagaaattctagaggcgggtccctggcgaagccccacctttgaagctgaaaaggctgagactgtggcccaaagtgagaacttatatccctgttttcccactagaatgttgtcttttcttaaaccacccatggctctgcccccaccctatcctgtgcctataaagaccccagactcagtcagcagagatgagaaacagctggatgttggagactatggctggatgtcagagagaagtggcttgacttcagagggatagcttgactgtgtaactatggagaagaatttggctggagacagccagacttaaggggaaaattacctacccaccactgactgtccccttttcagctccccttcccacataaataaaaataaaatcacccacatttaccatcctttaattcattcatgtgacctcatttttcctggacactggacaaaagctcagaagccatgagtgcagatacaaaagactgtcacactgatcctttgccctcactggcagagggcagctgcaggcccactgagctgttaacacttaagccatctgtggatggcagagctaaaagagcaccataacacatcctctggggcttcaggagttgtagacaccccacctagatgctgccatatggcctgcacagagttcgctcctgctggtgcccagaagcgctcattctggctcctgcaccggctcacatgtgcactccctcccacaatgggtagaacacagtgggtctgagtgagtggagtttgatcccactggcactgaaacagacagccaggttccagtgcttgtgcactccagttcctgccttgttctctcgcacactcccttctgcaaggagttgagagcagtgcgtggagtaaacggggcacccctgtcatgagtcctgtgaataggtcagggaagggaaatatcctgcttcagtttgagtctgagtgtctggcagttgtttaagagagaaatacccccagagtaaaagaaggcctggtcttatagcctgaagcttgtaggaaaatactattcagctagtccttaaatctatgcttacccagcaagcaatcttctgatttttaatttggtcttaggctagatcccagcagcagggaatccctggtttgctcaaaaaattctacattctgagccaggtatacacctaccactacaaattgctattctgacttacaaacctttctttagacctttcggttaacgtgatctcttttctcagaattttatctcttgtgggtaagcagtttctgaaacaccaaataatgacagggtccatactgaactgatcctgtagaggccacactaatgcacatccacaacagagtagccagccacaccctgtctctgacaccttatttggctactacacatcagtcaacaactactctagcagccaaggcagaaggtctcacagaattctccaaaccacccacccccagagaatcaagctctggtctccatctgactaccctgaaaacgtgaatcaggtgactggtatgccagactgaacctctatcacagtctaaataaatggaatgtacttccttctgaaagactgggctcttcaattactgaaaacactcaagtcacggttagaatgatcccaagcaaagcccctcacatatactaaaccaactatgctgccctaactcttctcattgcaacctccttcaacccaaaggaccaagagtttggagagctaggatctagttctctcaccaaaatattatataatcttataccatcatctaacttctcagggtcttaacttcctgtatatagaatgctcactgtggttatctccagtagagtttctagcattaacaaattaatatcagcaagatcaattacaataattattctgaaaggtatacactatgcaaatacaatttatgcccaagtattcctaatgccttgtactggtgtggaaaaagtggtgatggcagtgaagatgcaatttacgtctctgaaaaaaaaaaaaaaaaaaaaaaaaaaaaaaccaaggccaggcgcgggggctcatgcctgtaatcccagcactttgggaggccgaggcaggcagatcatgaggtcaggagatcgagaccatcctggctaacacggtgaaaccttgtctctactaaaaatacaaaaaattagccaggcatggtggcatgcgcctgtagtcccagctactcaggaggctgaggcaggagaattgcttgaacccaggaggcggaggttgcagtgagctgagatgcaccactgcactccagcctgggtgacagagtgagactctgtccctaaaaaacaaaacaaaaacaaaacactaaggctgaccaaaattatgaaggtaaggcagagtggttgagacaccacagccagctagatgatgaaccactatgaagctagccacagtttgggttaagttctagttccaataatttgatgaagcactctgtgagagcacacttatgccatagctaggtgctaggatgataaaatacaaccaagacatgctgctcaacaaggagagagaagaaatatgttgggcacagtggctcaggcctgtaatcccagcactttgggaggccgaggtgggtgtatcacctgaggtcaggagttcaagaccagcctgatcaacatggtgaaatgccatctctactaaatacaaaaaattagccaggtgtggtggcgcatgcctgtaatcccagctacacgggaggctggggaaagaattgcttgaacccaggaaacggaggttacagtgagccaagattgtgccattccactccagcctgggcaacaagagcaaaacttcgactcaaaaaaataaataaataaaaaatagaaatatatatatatatatatatatataggcaaataatgaaaatatgatgtgattagagttagaaagaagtttatataaagtgccatagaaatatggatgagatgggctgggtacagtggctcatgcccaaatctcagcactttgggaggccaaggtgggcagatcacttgagcccaggagtttgagaccagcttgggcaacatagtgggacccctgtctttataaaaaaataaaaaaccacatgagaacacatcctggctaaaaaataaaataaaagagggctgggagcggtggctcatgcctgtaatcccagcactttgggaggctgaggtgggcggatcatgaggtcaggagatcgagaccatcctggccaacatggtgaaaccccgtctctactaaaaatacaaaaattagctgggcatggtggcgcgcacatgtagtcccagctacttggaaagctgaagcaggagaatcgcttgaacccaggaggcagagattgcagtgagccgagatcacgccactgcactccagcctggtgacagagcgagactctgtctcaaaagaaaaaaaaataaaataaaataaagagaaagaaatatggatgagactactcaggaggctgagatgggaggatcacttgagcccaggaggtcatggctgcagtgagccacagtccacaccacttgcactccggcctgagcaatatatatatgtatatgaccagcctgaccaacatggcaaaaccccgtctctactaaaaatacaaaaactagccaggcatggtggtgtgcacctgtaatcccagctacttgggaggctgaggtaggagaatcgctggaacccaggaggtggaggttgcagtgagctgagatcaagattgcgccactgcactccagccttggggacagagtgagactccgtctccaaaaatatatatatatatatatatgtgtgtgtgtgtgtgtgtatatgaaaatatatgcatatataatgatatttatatatatgaaaatatatacatatattttacatatgtgggtgaaaaagcagagctggatcaggaagacagaatgggtatgaaaatacaaggtcaggataacaccattagcaatatacacagacaagggaagaacaaaagaataaggattatcaacgtactgcctcaatattaaatcaaaacatcctattagaaataggtctcttgcccagtggtcactcttcagtgggtatgtgtttccccaggggtggacagaacgattcaccaggatgtaggaagaagatacggaatattctatttatttttattttaactaaaaacagtagaaattaaactttatgaattttaatgtattgatgaaaaccaggacccttatgaagttccatgccagccaattgctgcccatatttgagatatctgaggaaaatgtgacattccataacaagaagtctatccatgcaagtggttatacatcaattttttaaaattgcagtaaaatatacattacataaaatttaccattttaaccatttttaagtgtacagttcagtggcattaagtgcattcacactatacaaccatgccaatttttaactaaagcatacgaaaatgagtatgtggcttaaaaagatacttgtaaagaaactatatgttaaataacgataatactaatgtaatcataagtaaacaagaaaatggcagaacactttccctattcctcttacaggccttctttagctagaatgaggttgtcaaaaattaattaaatctatgaagatggtctcccaaattataaagtatcaagaaggtcattccaaacatgaatccacattaactattatgaattaacttcaccctaagtatatactctacatcaaaactctgcaaactatagctcatgggccaaatccaacccactgcctgtttctgtaaataaagttttattggcgcacagtcatggtctaggcaaagtgaaaagaacacagaggataatgtctagaaaatgtacacacggccaggggtggtgactcacacctgtaatcccaatactttgggaggccgaggtgggcagattacctgaggtcagaagttcgagaccagcactgggcgtggtggaatacacctgtaatcccagctactcaggaggctgaggcacgagaatcgcttgaacccgggaggtggagcttgcagtgagccaagatcgcgccactgcactccagcctgggcgacagggcgagactctgtctcaaaaaaaaaaaaagaaaaagaaaaagaaaaagaaaaaatgtacacacaatgcaaaaatgaaaaacaattcagtacagcacaatggtcaaataaataattcaaaggtaataggaaaggagtattcctttttaaaaataatgtttgttaacagatgttcataccaaatatgcagaaaattctaaatattcacataatattttgattttcttttagtaaaaaatttgcatccatcttataaagttttgtatcctgctttctcgcttaggagcatcctcgagtttcatgaaaaaattcttcaaatactgtatcttactttttatggccacataaatcatagatcataccatattgatatacagcacatggatcatacctactgattaacttttaagttatttctcatttttgctattacagactcggcccaaacacactatctttgactacccttgctaaaaaaatcactcccatctgaccacttacaacagtgtgcgttaccactgacctagcacttatgctacattacctactttgttctgtagttaatctgtgttcttgctctaacttcccaaggagtttataagccaacagagggcaggaatgatgtcattcatacctgtcacccaacactatgcccagttcagcgtaagtacacaaaactctgctgaattaagaaataaaaacagcaatatatatatatatatattttttttttaaaaagcaaacactagccaatcaaaagttagaagtctaaaaagaggttataaaaaaagggcaacttgagattaactacaagaaaaagcaataaaaatcatgccaactttgttacatgactgaaaaggccaggaagataaagttgttgacaataatataatataaaagagttacgaagcaagggcttcagtggaaaaacttcagtcatgtccaatatgaactgaaaatgaactatcctggaactattacaatgactgatgaaaataagcagttgatcagtgaaggagaagacagggttaaggaagcaaaatgggaaatcactcccattcagataaaacccaaagctcctgaaaccaggtgaccaagaataaagctcagaggaaacaggatacagacactgctaaagaggaacaggtagaggcacaaaaacagttataggagaaaacaggaaagaatctagaatccaaagacccaaatactctgaaggcaggtcagacttgccaaatgacactggtagaaggccagttatcctggaactaaagtttgaaaagcatgagctggcctggcgcagtggctcaacacctgtaatcccagcactgtgggaggccaaggcgggtggatcacctgagctcaggagttcgagaccaacctggccaacatggtgaaaccctgtctctgctaaaaatacaaaaattagccaggtgtggtggcaggcacctgtaatcccagctactccagaggctgaggcaggagaattcgcttgaagccaggaggtggaggttgcagtgagccgagatggcgccactgcactccagcctgggtgacagagcaagactccgtctcaaaaaataaataaataaataaaaaataaaatgtaaagaaaaagaaaaagaaaagcataagttgcttctctaaccactagcccagtatttgttagccctaagcagtgcgctaaccactgaacaccaatatgaatgttcaaaagcacaagctgagcatccctaatccaaacatccaaaatccaaaaatttctgagcgccaacgtgatgttcaaagaaaatgctgattggagcattttggatttctggattagggatgctcaactggtatgtattccagaaatactccaaaatcctttttaaaaaatccaaaatctgaaacacttctggtcccaagcgttttgcgttaagagatacgcaacttttatttgggaggagagagtgcagcatagaaagaaaacttttgttcagtttcaaaaaaaaaaaaaaaaaagctaataaatagtacccacttcatatcatgccacatgatgaggagctattgaaatgcaaagtagaaaagtaaagaaaacaaacatgactagctgtaaagttcgttcacagcatgttgacaaagtgccccactataaagactaacagggtccacagtgggagacgccttaattctgccttaatgatgctgggcactggtcatcattttctggctcaactgtaggactctacaaacataacttacaacaaaacccagagatgttgtatgaagaaggtttcaggtgttttcctgtactcctctaaatgcagagttgattcattcatttgagacatagacactaaggactagctatgttctaaacactgtcaggaaagcagagtgtgaaaaatatttcccaagaggaaatactgacatcacaggtcagtaagagaaagataagagaacataaaataaatgcaaggcaggctaatgtgctcagttgtctcttattcttccctttcctcatactttaatacaaatattaggaagtcctgagtgaacaagctgtctcagtacttggcttactcatcccaaagggcctggctctgcattaaactggcctttggccactgcgagagaaaagcacttcccttggaaaagacaaacagtcttcccagatttctttacctttcaattacaagggccatgcaagtactgcaggctggctgccttcctgtgccgtttttctgccaccctttggcacagaggccctttggccaggacaacttgtaacaaacccattgttgtgtaaccctcagtgccacttatttattggtttttgtcacacacacactgtaagtgggaactttgtcctgcacttatcacactaaagggtacctgaatgttaaactacaaatgttttactgccagattaaacaggcatcatgagaaggtgcctgagaatatatgggaccttcttctcaactctcaaattctaggccctgggttttcaagcctattagatatatgaagcacatccaaggaagtttaaaagtcaagaaaacctcagtagaaccatgaaaacctggcaaaattcacttcctgcctcaggtggtgggatgactgttaaaatgaacagaccgttaaagcccaaccatactgcaacaagataatatcgaccatctttccatttaaaaggttcaattccatccctcatttctctccacctccagtaacaaagagaaaaagggaaatcagcactaaacagaggcactgtcatgcctataggaccacctctctctaaatataaatgagttaaaggccagctatctactttgtttgttttgagatgcagtttcactcttgttgcccaagctggagtgcaatggcacgatctcggctcactgcagcctccacctcccgggttcaagcaattctccctgcctcagcctcccaagtagttgggattacaggcatgcaccaccaggcccagctaattttttgtatttttagtagagacagggtttcgtcatgttggccagtctggtctcgaactcctggcctcaggtgatctgcccacctcagtctcccaaagtgctgggattagagacatcagccatcatgcccagcctcagctatctactttcatgttctacaggcaaaagagccttaacttaactgttaaatttttattcaactgcatgttacaatgactattcaagctcatagactaagatttcagagagggatgcctttcatctgcccctcatggtcaccattttcagctgtgacatgggatttgataaatatgaattatacccatacacagagctgcaccctaaacaaggcttggtttccctctgctccctgggactgatgttatgtctatttgacaaacattctgaatggtcacagaaaaactattctttacatgattctttaaacccactcccacccgaaaagagattaaaatctgcttgtgctaaatcatcagtgttggattagctaactattataaaccaacaaattcctcaactccttattgcaatcctgaaagaacacttaaaagccagaactgaagacagattatatttctttctttcctttttttttttttttttgagacagagttttgctttgttgcccaggctggagggcagtggcacaatctcagctcactgcaacctccgactcccaggttcaggcaattcttgtgcctcagtctcctgagtagctggcattacaggcacccaccaccacacccagctgattttttgtatttgtgtacagacggggtttcaccatgttgcctaggctggtctcaaactcctgagctcaggcaacctgcccgtcccagcctccgaaagtgttaagattacaggcataagccaccacacccggccgacagattatatttctatagcttcatcaatctactagtctcaatatcaatgtacataaactggagaaaattctaaggcagacctttttacttacagggctcaatgagtggaaaaataattataactctaccttctatcagaaacctattctgagccacgtcttattgccattcccaggccacaaacattttccaaactaatctggattctacataagtttcttgaaaaatagtaacattttactgccctatgatctctttacctcatttatgtacagttaacaatctagaaaaaggaaactgacaaaacagcaaaagcagaataaccaaaacctggaagccaccaagatgtcctgcaataggtgaatgggtaaacaaattgatatatccacacaatggaacattatccgtcaattaaagaaatgacctatcaagtcacaaaacgacatgaatgaatcttaaatgcatcttgctaagtgaaagaagccagtctgaaaagggctacatactgtatgattttaattatgtgatattctggaaaaatgcaaaactgcagggatggtataataaaaagatcagtagttgccagggggaagtgggggaagttgaacaggtaaggcacaagagattgtttaggacaatgaaactattctgtttaatactgtaatgacagatacatgatgctatgtatttgtcaaaacccacagaattttacagcacaaagagtgagccttagtgtttgcaaatttttaaaaatcatttaggaggttagaagatcccaggatggaatgcagaatgtgataaaacaaattaattgtattatgaatatatgaaacaagtcaatgaaggaaatgggagacctaaataactctagaaatgaatggagtcagatgaaaggcaaaagaaacagtacgtaagcaccacattctgtttgatagtctcccacaggaatggcgatacaagttaataattctgataccactatacatgtatactggaattgaataattatgtaaagaatgaatgacaataggagacaggtttctcactgttggagtgagaagtaacagacaagcaaaaggagaaggctagaaggatccatgtggtaatggattaaagttggagacatcagtatgaactcatacttagtatagtacaatatacatagttacatatagaaatatttaaatatgtatatatatgctggttaaatatacacacatatattttcttttctgtgaactctgcagagaagtatacacattttcttgctgtcagctataagggtgacacccaggagcaatgagcatccctagtgaagaagaaagaaaggagaaggggggaggagggagggggagagggagggggtggagggaggaggagggaggaggaggaggaggagaagcagcagcagcagcagtagtagtagtagtagtggtagtagtaagcatctttcagtgtgagaaagtacctaagtactaaaaaaaaaaaaaaataaaatccacaatgattggagtatgtcaaagggacatgagatccaagtgaaagattggagactagccaaaactgaaataatttgagtaccaaaataaagtaatattgaattataagccaaagtataaaataaatacccatgagtacatgctgatataaataaatgactgaataaataaacaaatgggggagaagagaggaatctctggcataaaagaattccaagtaatgtctgaagatgctgtgtcctcaaggagaggggacataacttctcactccctgggtgtgggctgcacatagtgatttccttccaaagagtacatatgtaaaggggaagaaagagtcactttacagaggagaaactagatatatcctactttagccaggtgatcaaggtgaacatcaaaagttataaaccatggtgataatatatacacttgacacaaggtgatgaaaatggtactttacctctgttgtcttccacccccaaacatataaccccagtctaatcatgatttaaacatcaagtaccaactgagagacattctacaaaatacctgaccagtattcatcaaaatgtctaggtcatcaaaaacaaggaaggtctgagaaactgtaagagccaagcagagaaatgactaccaaatatgatgtgatatgctggacaggatcctgaaacaagggcatccgggtaaaaactaaggcaatctgaataaaatatggactttgtttaatgataatgcatcaacattggttcaataattataacaagtataccatacaaatgtaagacgttaataacggggaaaaatgtgtagaaaaaaataatatgaattgctaataagggtcatcttcaagtgcacggaagattataaactgcctatttgaacttctaacaaatcaacaatttctgctaaaagaaaaaagattttcagacagggcaacatagtgagaccttgtctctactaaaagtaaaaagactagccaggtatggtggcacacacctgtagtcccagctactcaggaggctgaggtgggaggatcatttgagcctgggagttcaaggctgtagtgagctgtgatcgtatcactgcattccaacctgagtgacaaagcaagaccctgtctcaaaaatgaatgaaagaaagaaagaaagaaagaaagaaagaaagaaaaaggttaaagtctaaatggaaagaatcattttctatccaagcattctacagtttttctaaggatacagaagtcacaactgaatttcagtctcatatttgcaaacatcgtcatttcagatagttgtttcatatgcaccaaaggaaactaccttgaaactgtatattacatacattaaaacatttttttaggccaggtgcagtggctcacgtctgtaatcccagcacttggggaggccgaggcaggcagatcaactgaggtcatgagttcgaaatcagcttgggcaacatggcattatcccatctctactaaaaatacaaaaattagccgggcgcagtggcttatgcctgtaatctcagcactttgggaggccgagagtttgagaccagcctgaccaacatggagccccgtttctactaaaaatacaaaattagccagacgtggtggcacatgcctgtaatcccagctactcgggaggctgaggcaggagaatcttttgaacccaggaggcggaagttgcggtgagccaagatcacgccattgcactccagcctgggcaataagagcgaaactctgtctcaaaaaaaaaaaaaaaaaaattagccgggcatggcagcaagtgcctgtagtaccagcttctagggaggctgaggcaggagaatcacctgaacatgggaggtggaggttgcagtgagccaagatcacaccactgcactccagcccgggcaacagagcaaggctccatctcaaaaaaaaaaaaaaattagttttaatttagttgtttattcacttgaatcaggcatctccaaaacttaaaatgttggcccctgacacaggtgtcacaccacaagctactaatagaattcacccagcacactaaaaccttactacattgccaccaggaccacagtgtgaggagcaacaatggtagcaagaagtatccggaattttatgtaataaactttctgagtggggtctagagagacctagctcactctaaattgtgccttttagaaggtattgccatagcatgactctagcttataattttaaatgagttaatgaatactcatttaaaatttcttttggttgttcattttgagacagtctcacactgtcacccaggctgaagtgcagtggcatgatcttggctaatcacaacctccgcctccctggctcaagccatccttccacctcagcctcctgagtagctgggaccacaggtgcacgctgccacgcccagctaattttttttttttttttttttttttttttgtagggatggggttttgccatgttgctcaggctggtctcgaactcctgggctcaagcgatccacctgccccagcctcctgaagtagtgagattacaggtgtgagccacttgcacccagcctctcacttaaaatttctaatacattctgctaccatctgtgagtacaaaaccatctaagtaaaataagaatagtttggcatttggaagtaattttttaaaacaacattcatattaatttaaggagcataacagattccagtgaatgttatgattcgctattgtaacattattctagtaaatatgttggagaagaacagttctagtgaattaactatggttttggaaggcagctatgctcaccatcataccaccaacacaactatggttttattttatattatttattttatttttgagacagagtctcgctctatcgcccaggctggagtggcacaatatcagctcactgcaacctctgcctcctgggttcaagggattctcctgcctcagcctccaaagtagctgggattacaggcatgcacctccacgtccggataatttttgtatttttagcagagacgaggtttcaacatgttggccaggctggcctcaaacgcctgacctcaggtgatctgcccgcctcagcctcccaaagtgctaggattacaggtgtgagccaccgtgcctggtcacaactatggttttataatcagcaaatggcatttaataatgtgttagtatcaaacaaaactgggcagcaacagagaccaatgcacattcttcttggtgtgtcagtaggaacaaatacagcaaattaaaaattgtctgctagaaaatcaaagatcacagagatgtttggatcagtcccctcctctcttctgaggatgagactcaaatcacaggaagaaaagttactcaagaatcctctggaacagcccaagtgcaggttcaactcaaacactactaccaacatcagtaacaggatttaagtttttttttttttctttttcagaaacagaatctcactattttgcccagactagccttgaactcctgggctcaaacaatcctcctgcctcaacctctcaagtagctgggactatagatgcgtgccaccacgcccagtagttcctggatttaaaacatcactgttagtaaactctgggcagacttttcctgaaggaagtggtaagagagggcaggaagctcacaggcatccctaacagcttatttcctttcccttaacatcttgaggaatgaggcctggaggaagagaaccatgttgtatttctgtgacgctcagccagcatccattttattggaataacaaaggatttgtttaaagagcagcagtgcttatggcttatagccctgaaacaccagattgagaagaaatatcaacttgaccctacttacaggagttgtgccgacgacggaaacttttggactgactcaaggattccatgtgcctgtcgacatagctctttgagcactgttgctgctgcggggaaacggcaacatcctggctcttcacatctgtcctcttagggatattctgaggggcactgctggaagaggctggcttcttgacaaacttgcctgtgccattctgattgatgcccacttggcagccagcaccagaggggcctaattctgtttgatgaaggtctccaaaatgttggttgtctccaggtcctggtatctccagaatttttaactccgtaatgtcacctgccctgaaatacacaaaaaagccaagtctcaaaattataatagtggtaagaatgatgaaactgagatcattagcaaacagctacccctttgcaggactgcattttattgagttatcagaggctaggaaagggggctgtgtgcttaaggacaggggtcagccaccaactatccaactgacacaatgctagcctttaaaaagaggctattggccgggcacggtggctcacgcctgtaatcccagcactttgggaggccgaggcgggcggatcacgaggtcaggagatcgagaccatcccggctaaaacggtgaaaccccgtctctactaaaaatacaaaaaaaaaaaaaattagccgggcatagtggcgggcacctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaagagaggctattgctaacaacaaaactgtattaatcttacattcccacaatgtttaatggcttttgttcattcattcactccctcgctcattcaacaggagtatataaaatacttactatgtggtaagccctgcactatgaactattttgatctggtatatagagatgaaaaccactacgtgcccacaggaactcagtctggtcagtggaaaagacaagtacatattcaatcaaaagtgttaaatggactgggcaccatggctcatgcctataatcccagcattttgggaggccgaggcaggcgaatcacttgaggccaggagttcgagaccagcctggtcaacatggcaaaaccctgtctcaactaaatagaaatgattagtcgggtgtggtggtacgcacctgcaatcctagctacccaggaggctgaggcatgagaatcgtttcaccctgggaggcaaaggttacagtgagcagagatcgcaccactgcactccagcctgggcaacaaagtgagactctgtctcaaaaaaaaaaaatttttttttttaagtgttaaatgttatgacagaggtgtgcataggagactagagagcctaaaagcaaaatatttaagtcagtctggtggagatgaatgcaatacttaagctaaatctggccagggcagggggaatgagtggctaagcaaagaacagcagggagaaaggcatctcaggtaggggctcagagactgaggaaatgtagaaaatatggcccacgtgaggaactgcaagtgttatggtgatactaaagggacggatgttgtggaaggccatcaggaagtaaggttgcagaggtaaccaaggaccacatcatgatcacaatggattttcctggtggctatagggaaggagaagaaaaaagaggcagtggtaccagttagaagaccaagcaagaaataagaggggatgaaccaagcaagcggtaatacaaagggagaagggatcaagagacatttcgaatccatacgattttggcaactaactgaacacgaggattaaagagaaagaagagtttattatgactcctaagtttctaacataggggaaaggtgttattagtcataaataatgggtatgcccttggaaaaacaaatctacaggaaaacataacgagattagctccgaaaatcttgcatttaagatatcttgtgggatgtccaatggaaatgaccagcagacaaggtgtctgtctcataatgggactaaattaaagatttgaggtcttggctggggcatggtggctcacacctgtaatcccagcactttgggaggccgagaagggcagattacaaggtcaggagatcgagaccatcctggctaacacggtgaaaccccgtctctactaaaaatataaaaacaaaattagtcgggcatggtggcgggcacctgcagtcccagctactcgggaggctgaggcaggagaatggcatgaacccgggagatggagtttgcagtgagccaagatcgtgccactgcactccggcctgggtgacagagtgagactccatcaaaaaaaaaaaaaaaaaaaagatttgaggtctcattaacatatagagtacacaagagtttgtctagagaataaaagctgagaaaagaaccaaagatagaaccctgagtaattcaatcttaacaggtgagtagaagaaaaggaacataaaaaacaacaaaaaaagtaaaggaatggaggaatatgtggaatacatgcaaagaaaaaccaaagaggtgacagggaaactaaaggacagtactgtactttaaaagatagggagcattttatttttatttatttttttacagacagggtcttgctctattacccaggctggagtgcagtggtgctatcatagctcactgcagtctccaactcctaggctcaagtgatcttcctgtctgagccccaggagtagctgcgattacaggcacatgccaccacacccagctaatttttaaaatttttcttttgtaaagacgaggtctcactatgttgactagccagttttgaaatcctagcctcaagtgatactgctgccttggcctcccaaagtgctggaattacaggtataagccactgcacccatcagggagcattcaaatgagattgggattgagatactgtcagtgaatttggccattaggttatttgtaaccttggcaaaaactaattcagcaagatgacaaagttagaaaaaaagataatggtagggtacggaggttctagagaatgaagccacaaaagatagagaaagcagattatttggctctgacaaggattatgggttaaagggaagggaaatgacacaacaatacctagtggcaaatgcaagatctaagggagagggttgtttttaataaaggggaggccaaggaatgaatatcggaatgcaaagaggaaataaacagtataggccgggcatggtggttcacacctgaaatcccagcacttcgggaggccacaacgggcagattacttgaggccagtagttcgagaccagcctggccaacacagtgaaaccccatctctactaaaaatacaaaaagcggccatatgccaagagaatactagcaatcagacctaggttcaagctccacagaccaccaggttggattcagaagagtcagtcaggacactcacctgaaggtgacttctggaacaagacacttcactccattatggaaaggccgggtgagagaaatggtctggctgacctgatccacagctgacactcttccctgatagacacccaagctatctccacaattgatggacacaatacttcccagccaatctgtagccatgtttcacacgtgagaccactgtgaagagaaggaactattcagtgtgccttggtgaaaagacaaacttttaattaaattcagcaaatatatcaggctctgtaccaagtgttggttaataaaacatattctatcacattgttaactgaggtaataaatcttaaaaaaattaaaattttttttcaggagtatgaatattaaaaaataatattatttaatacatataaagatcttataattgctttaaagcgcatacattggataaagatatttattacacatcaaatcacacaaactataatctgtttatattgtattttaataaatctgctgtcaaaatgttttcaaagagagtatgttgctgagaaataatatattaaaaaaacaaattactgataatgccactcttgctgatgatgataataataataataattaataataatagtaaattctggatagttgttttttttttttttgagacggagtttcactattgttgcccaggctggagtgcaatggtgcgaggcgggcagatcacgaggtcacgagatcaagaccatcctggctaacacggtgaaaccccgtctctactaaaatatacaaaaaattagccaggcgtggtggcgggtgcctgtagtcccagctacccgggaagctgaggcaggagaatggcgtcaacccaggaggcggaggttgcagtgagccgagatcacaccactgcactccagcctgggcgacagagagagactctgcctcaaaaaaaaaaaaaagaaatttttttaaagccaattgaaggtactatagaacactaaacctaacgactacagaatatatatccttttcaagtctacatagaatgttcacgcatatatgctgggccttaaacaagtatgaataaatttaaaaagactgagatcacataaaatatattctctacccacaacagaattaaatttgaaattgataaaaatagatatttagaatattcccaaatatttggaaattaagcaagacatttccaaataacctatgggtaaaagaagaaatcaaaagggcagtcagaaaatagttctaactcaacgataatgaaaacacaacatcaacttttgtatgacatgcttaatatagtgcgtaaaagggggaatttataactttaagtgcttgttaggaaagaaaggtctaaaatcaattgtctaagcttccatcttaagtattagtaaaaaaagaacagattaacctgatgttaatagaaaggaaatcaagagcagaaaccaatgaaacaagaaacaactaagaaaaataaaacaaaaattagctctttgaaaatattaataaagttggtaaacacctaataaagaaaaaagataaaacacatattattaatatcagaaatgaacaaagagacatcatagacattaaaaaataaccttatgccagcaaatttgacaactagacaaaatggggaacttcttagacaaaagttatcaaaactgacacaagaaattaaaaatctgagtagctgcatgtctattttaaaaactgaatttatcaagagaataagacaagacacaaattaggagaaaatatttgtgaaagacatatttgataaaggtctgttatccataacataccaagaactcttaaaactcaacaataagaaaatgaacaacctgatgaaacaatgagcaagagacccaaaaggatacttcaccaaagaagacatggacacggcaggcaagcatatgaaaagatgctctacatcatatcatcagggaattaatggaaattaaaacaacaataagatgccactacacacctgtcagaatggccgaaatccaaaacactgacaacaccaaatgctgacgaggatgtggagcaacaaaaaccgtcattcattgctgacaggaatgcaaaatgatgcagccactttgagtatgcatttttctttttttttttgagatggagtcttactctgccgcccaggctggagtgcggtggcacaatctcagctcactgcaacctccacctcccgggttcaagcaattctcctgcctcagcctcctgagtagctgggattacaggcatgcaccaccacacctggctaatttttgtatttttagtagagacggggtttcaccatgttggtcaggctagtcttgaactcctgacctcatgatccacccgcctcacctcccaaagtgctgggattacaggcgtgagccaccatgcccagccttttttttttttttttttttggagactgagtctcactctatctttatcgcccaggctagagtgcagtggtacaatctcagctcattgcagcctctgcctcttcaatcaattctcctgcctcagccttccaagtagttgggactacagacacgtgccaccacacccagctaatttttgttgttgttttttttctcagtagaggggtttcaccatgttgcccaggctggtctcgaactcctgacctcaggtgatctgtctgcctcggcctcctaagtgctaggtttataggcatgagccactgtgcctagcttgcatatgcatattaataaggtagtttctcacaaaactaaatataccatctgatccagcaatcactctccttggtatttacccagatgaactgaaaacttacatccaccataaatctgcacgtggatgtttacagcagctttattcaaaattgctcaaattcggaagcaatcaagacatccttcagtaggtgaatggatgaatgaactatggcacacccagacagtggaatactattcagcacaaaaaagaaatgagctatcaagccatgaaaagacatggaggaaactgaaaagcacattactaagtgaaagaagccaatgtgaaaaggatacatacatactatatgattccagctacaaggttttctggaaaaggcaaaactatggagacagtaaaaggagcagtgggtgccagtggttagtggggtgggggtgggaggtgaacaagagaatttttagggcagtgaaactattctgtttgatactataatggtagatatgtgtcacttcaaaacccatagaatgtacaacaccaagagtgaaccctaatgttaactatggactctggatgacaacgaagtgtcagtgtaggttcatcaattgtaacaaacacgaccgtggtgtggaatgttgacagcagagagggcttactgggggacaacagtgagatatatgggaaccctctgtattttcggctcaatttttccctgaaactaaaactgctctaaaaaataaagtctatttaatagaaaaaaccaaattgattatgtaatttaaaaccttcctacaaagaaaaatccaggcctagatggctttactggctttttctttttaactaagtctgaactagacagctttactcgttaattttatccaacattttaggaaaaaaataatgtcaatctcatacaaacttttagaaaacacaggggaatgaggctggatgcaatggctcatgcctgtaatcccagcactttgggagactgaggcaggtggatcacttgagatcagcagtttgtgaccagcctggccaacatggtgaaaccctgcctctactaaaaatacaaaaattagccaggcatggtggcacgtgcctgtaatcccagctactcaagaggctgaggcagaagaatcgcttgaaatggggaggtggaggttgcagtgagctgagatcacaccattgcactacagcttgggcgacagagcgagactccgtctcagaaaaaaaaaaaaaaaaaggctgggcacagtggttcacacctgtaatcccagcactttgggaggctgaggagggtagatcacttgagttcaggagttcaagaccagcctggccaacatggtgaaaccccatctctactaaaaatacaaaaaaaaaaattagccaggtgtggtggtacacacctgtaatcccagctactcgagaggcagaggcaggagaatggcttgaacccaggaggggaggttgcagttagccaagatcgcgccactgcactccagcccaggtgacaaagcaagactctgtctcaaaaataaaaattaaaaaaaagaaagaagcatttcccaatttgttcaatgtagctagtataactctgacgtgaaagcctccccacaaaggctttataagaaaaagatcaacatcctgcacaaatatagaccaaaaatcctcaacaagatattaacaaatcaaatccagcaataaattttaaaagtctaatatatcacatatatttaggtccctactcctagaatgcaaaattggtttgatattttaaaaatcgatcaattttaaatcattttaacagaatgagaaaatcataaacgttatcacatcagtaaatacagaaatattatcttgataccaagacctgacaacaataagacaaaaacaaaactacagaatactatcccccatgaatgtaaacataaaattccttatcaaaatatcacccaacaattcaacaataatgatccaggctcagtggctcacacctgtaatcccagcactttgagaggccaaggtgggaggatagcttgaggccaggagtttgaaaccagcctgggcaacacagtgagaccttatttctaccaaaaaaaaaaaaaaaaaaaaaaaaacaggtgtagtggtgcataccagtaatctcagctacttgggagcctgaggcaggaagggagcttgggcccatgagtcagtggatggagtgagctatgatcacaccactgcactccagcctgggcaacaaagcaagacaccatctctaaaataaaagtaaaaaacaaaacaataaacataaagaattatacaccacacccagccaggtgtggtggctcacgcctgtaatcccagcactttgggaggccaaggtgggcggatcacgaggtcaggagatcaagaccatcttagctaacatggtgaaaccctgtctctactaaaaatacaaaaaattagccaggcgtggtggcgtgctcctgagtcccagctactcgagaggctgaggcaggagaatgatgggaacccaggaggaggaacttgcagtgagccacaatcacaccactgcactccagcctgggtgacagagcgagactccatctcaaaaaaaaaaaaaaaaaaaaaaaagatttatacaccacacccaggtggagtttattccaaggatgcaatgctgactcaagatcagaaagccaatcaatgtaatctaccatattaacaggctaaataagaaaaacacatgttcatagcaactgacacagaaatgcatttgacaaaatcgaacacccattcattctttttttaaaaagcctctcagaaaaatgggaatagagaggaacttcatcaatctggtaaagggatctaaaaagtccctacagctaacattatactaaatggtgaaagactgaatgctttccctataagaacatgaacaaggcaaagatatccactattactcaacacagctctagaagttctcgcaataaagcaagaaacagataaaaaaagtatacagtttgtaaaggaaaaaacaaaactatccccatttgcagatgacataactgtctatgtagaaattccccgtaatctacaaaaagtcttagaacaagtgagttcagcaagattgtgggatacaagataaacatacaaaagccaatcttatttcagtatattagcaatgaacacatgggcaatgaaatttaaaatacaataccatttacaattgctcaaaaaataaagtactaggtgtaaatctaaaaaaaaagggtacaggatttgtatactgaaaactatgcaacactgaggaaaaaatcaaaatgctaaatataacagatataacatgttcatggattaaaagactcgacaaaaagtacataaatcctcctcaaattggtataaaggatcaatgcaattcttatcaaaatcccagcaagatctgtagatatagacaaggttattctaaaatttacaaggaaaggcaaagaaactaaaatagctaaatcaatattttttttgagacggagactcactttgtcgcccaggctggagtgcagtggcgcaatctcggctcactgcaacctccacctcccgggtgcaagcagttttctgcttcagcctcccgagtagctggcattacaggtgcccaccaccacgcctggctaatttttgtatttttagtagagacagggtttcaccatcttcgccaggctggtcttgaactcctgaccccatgatccacccacctcagcctcccaaagtgctggattacaggcgtgagccaccacgcctggctgctaaatcaattttttataagaaagtgggaacaatcagtctacctgatttcaagacttacacaattatgataatcaagactatatagtattggcagagggacaaacatgtaaatcgataaaatagaaggcagaacccagaaacagactcacaaaaatatgcccaactgatttttgacaaagtgcaaaaacaattcaatgcaggcagcatagtttttacaacaaatagcgctggagcaaatgtaaatccatcagcaaaaaaatgaacctcaaactaaggttcacactttatacaaaaatttactcaaaatgtatcatgaacttaaatgtaaaacatcaaactctaaaacttttagaaaaaacataagagaaaccctcaagatctagggctaggcaaagagttcttagacttgacaccaaaagcacaatccataaaaagaaaagctggtcaactagacttcttgaaaattaaaatttttattccacaaaaaacaagtcacagactgggagaaaatacttgcaaaccacctatctgacaaagacaaaggagtagtatctaggaaatatacacctttcaaaatggctaaaatacagtgataacaccaagtgctagtaagaatgtggaaaaaatggatcactcatacattgctagtccaaatattgaatagtacagctactctggaaaacatcctggcaggttattaaaaaaactaaacatgcaataattagccaagtgtggtggcgcacacctgtaatcccagctatttgagtggctaaggcatgagaatcgcttgaacctgggaggcgcaggttgcagtgagccgtgatcccaccactgcactctagcctgagcaacagagactctgtctcaaaaaaagaaaaaacccaaggctgggcacggtggctcacgcctgtaatctcagcactttgagaggccaaggcgggtggatcacaacgtcaggagatcgagaccatcctggctaacacggtgaaaccccgtctctactaaaaatacaaaaaattagccgggcatggtggtgggctcctgtaatcccagctactcgggaggctgaggcaggagaatggcgtgaactgaagaggtggagcttgcagtgagccgagatggggccactgcactccagcctgggcaacagagcaagactccatctcaaaaaaaaaaaaaaaaaaaaccaaaaaactaaacatgcaactacaatatgacccagcagttgcacttctggtcatttatcccagagaaaggaagacctaggttcacacaaaaacctgtacgtgggctgggcgcagtggctcacgcctgtaatcccagcactttgggaggctgaggcaggtggatcacctgaggtcgggagttcgagaccagcctgaccagcatggagaaatcctgtctctactaaaaatacaaaactagctgggagcggtggcgcatgcctgtaatcccagctactcgggaggctgaggcgggagaatcgcttgaacctgggaggcagaggttgtggtgagcccagatcgcaccactgcactccattctgggcaacaagagcgaaactctgtctcagaaaaaaaataaaataaaataccctgtacacaagtgtttatatcacatttactcaaaaaagccacaaactggaaacaactcagataacctcaatgagtgaataaacaaacagtggtacattcataccacagggcaaaaagtaaaaatgccaaccccaagaggttgtgttctgtatgattccatttgtgtaacattcttgaaatgacaaagctatagaaatggagaacagggccgggcacagtggctgatgcctgtaatcccagcactttgggaggctgaggagggtggatcacctgaggtcaggagttcaaaaccagcctggccaacatggcgaagcctcgtctctaccaaaaatacaaaaattagcccggcgtggtggcaagcgcctatagtcccagctactcgggaggctgaggcaggagaatcacttgaacccaggaggcggaggtcgcagtgagctgaggtcaaggtcgtgacagtgtactccagcctgggcaacagagtagcaacatgggggactcttgtagtaatggaaatattttacatcttgaccatatcaatgtcaatatcctagtagtgatactgtattacagttttgcaagatgttaccaacaggggaaactgggtagggcataaggaatctctctgtattatttcttacaatggcatgtgaatctacaactatctcagaagtttaattaaaaaaaaaatcaatgccttgcatcacattaacaaaataagtgatgaaatcatgtataatcatatcaataaatgcagaaagataattggacaaaatttaacaatcattcactatatttaaaaaggggagggaaagctggcatctacaaaacaattacagctaacatgatacttaatggtgaaataggccaggcatggtggctcacacctgtaatctcagcactttcagaggctgaggcaagaagatcacagagctcaggagtttgaggttacagtgagctatgattgtaccactgcactccagcctgggcaacagagccagacactgtctttattttatatattttggttttttgtttctgttttttttttttttttttttggctcactgcagcctcctgggctcctgggctcaggtgatcctcccgcctcagcctcctgagtagctgggactataggtgtatgctaccatggccagctaatattttctgttttgtagagacagggtctcactttgctgcccaagctagtcttgacctcacagctcaattgatcctcccacctcaacttcctgagtagctgggactacaggcccacaccaccacacccagctaatttttgtattttttgtaagacagggttttgccatgttgcccaggtttccaactcctgagttcaagctatctgcctacctcggcctcccaaagtgctaagattacaggcatgggctaccatgcccagctgagactttgtctcaaaaaaaaaaaaaaaaaaaaaggtggggttgaaataaatgctttccccaagtactgaggatgaggcaaggatgtccactctcaccacttgtacttatattcaacaactgtaggtcctagccagtgtaataagacaagaaaaagaaaaaaaaaaacccagaaagttaaataaataataaagttaaataagacagtaaaactgtctttatttgcaatgacataattagctgtttacagtcaatccataaaaagtcctactagaactaataaggaaatttagcaaggtcacaggatatatgctcgatgtagaaaaaacaacaacagcagcaaacaactgaaaatgaaattttaggccaggcatggtggctcatgcctgtaatcccagcactttaggaggccaaggcttcccaaattttacacaagttattcctagaacactttccccagctctatgaatggttagttccatcctgcctttccgacatctggtaaaacatgaccatctcaaaaaagccttccctgtctacccaatctaacgtggctactcatcgttattctccaacaccttaaatcctgttatgatctcaaaatcaatcactatatgaattatcttgtttcttcatattgtgtgtgttggtcaggcatggtggttcatgcctgtaatctcagcattctgggaggctaaggtgggcagatggcttgagtccagaagtttgagaccagcctaggcaacatagggagaccccatctctgcaaaaaaattaaaaaaactagccaggcttggtggcacatgcctgtaatacaagctacagctactcagaatgctgagacaggaggaccacttgagcccggaaggtcaaggctgcaatgagccatgatcaggccactgcaccccagcctagatgacagagtgagaccctgtctcaaaacaaaaagtatatagatagatagatagatagtgtgtgtgtcaccccactagaataggacaaatgacatagtcttgttcagtcaataagagtgcctagagtggaagaagtcaataaatatttaatcaatcgatgaatgaattagaaataataaacgtgacagaagttactcaaaatctagagtacctacatgtttatatctaaatgtcttggctctttttgaaaatggttctaaaaaatacagtatccttgggcatactctatgcaaaatcctatataaggtatgaaacctaacacttccccactcacacgaggaagtcagaaaacagctagcagatgatagcagatgaatataaatacacatgttaagcacaaagtgaaacactggttcagtgtttttacattaaaaaaagaaaccagcacttgaaactgttttcaaatactaatttcagacataaaggagcaaaaaagcatataaagcacccctctggtaaaagagtatgtcctgactgagtgtgggggctcacgtttataattccagcagtttgggatgccaaggcaggtggatcacatgaggtcaggagttcgagaccagcctgaccaacatgatgaaaccccatatctactaaaaatacaaaattggccgggcgcagtggctcacgcctgtaatcccagcactttggaaggctgaggcaggtggatcacaaggtcaggagttcgagaccagcctgaccaacaaggtgaaaccccatctctactaaaaatacaaaaattagccaaatgcggtggcatgttcctgtaatcccagttactcaggaggctgaagcaggagaatcgcttgaacccgggaggcggaggatgcagtgggctgagatcgtgccattgcactccagcctgggcaacgagaacaagactcggtctcaaaaaaaaaaaattagccgggcatggtggtgcatgcctgtaatcccagctacttgggaggctgaggcaggggagtcacttgaaattgggaggcgaaggttgcagtgagctgagatcacaccattgcactccagcctgggcaacaagaacaagactccatctcaaaaaaaattaaataggccagccacggtggctcactcctataatcccagcactttcagaggccgaggcaggtggatcacctgaggagtttgagaccagcctggccaacatggtgaaaccccatctctactaaaaatacaaaaattagccaggtgtggtggtgggtgcctgtaatcccagctatttaggaggctgaggtgggaaaaccacttgaacccaagacgcagaggatacagtgagcagaaattgcgccactgcactccagcctgctaacaagagcaagactttgtctcaaaataaatacataaatgaagggaaaggggcaaaaaagcatatacagcactcctccaggccagccgcaatggctcacgcctataatcccagcactttgggaggccgacgtggacggcatggtggcatgcacctgtaatcccagctactcaggaggctgacaggataactgcttgaacccaagaggcggagcctgcagtgagccgacaccgcaccactgcactccagcctgggcaacagagcaagactccgtctagaaaaaaataaaaaataaataaaaataaagcactcctggctgggtgcagtggctcacagttgtaattccaggagtttgggaagccaaggcaggagcatcacttgagtccaggaattcaagaccaggctgggcaacacagcaagaccctgtctcaaaaaaaaaaacaaaaaacagtatgccccattagaaacactaagtctgaaagagtccagctctagggattaatcaaactctagatagttctctagtgatctaactgagccagtatcataaaactatgcggacagaaccgaagattaaaagaacaatgaattagcaggctcatacaggcttttttttgttacatttattatagaatgaaacagagccttgctctgtcgcccaggctagagtgcagtggcgcaatcttggctcactgcaacttctgcctcccaggttcaatcaggcaattctccttcctcagcctcctgagtagctgggactacaggcgcccgccaccacacccagctaatttttgtatttttagtagagatggggtttcaccatgttggccagactgatctcgaactcctgccttctggtgatctgctcacctcagcctctgcactaggattacaggcatgagccactgtgcctggcccttgggtaaattttcaatgcaacacaatttcaacaataatgatgatggtaaaaaagcacaaaatacacacattttaggcttcttttcccttcctgatcaacctttgcctaatgtcacaaaagcatgagtttcctttcctatcatttataatccatcataattctactcagatgcttagatagatgcagaataaaaagcaccagaaattaaccagatatgaaaaggcttttactgttttatttaacatatatctttaagacactgatgttgtgcattcaagtttatattatggtagtagtaactgaatagaatttttaacactttgaaaatgtggatactcgtttataagtgttcttctatgtagttaatattaatagaaacttttaaaaatataaccactgaatgtgtaacaaacttccctttcctcagaaacttcccttggtaaaatagcattattcaaaactcctcaaacaggtttattctataaagaaaattatgctatttacagaaaacagtaaatctaaaacaagtacagtgcccatcaactgggttcctaatcggactagggaaggggctccatcaattatacagctaacacctccacgtcaaaagaagtacaggagatacaggagctacaaggaaccaatcttgtcttttattttctacttttctatcaaggtataacatatacagtaagtcagtctacatattttaagtgtacacctccctgaaattttacatatcaattcacccatgtgaccaccactcaaaacaagacagactatttccaacacctcaaaaggctccattgtgtcctcctacaggtagttattattctgacatctatcatgaaagattatttgagcctgattttgagcttcacataaacagaatcataaaggttctctttcagagtgtttgtcttcttttgctcaaaagtacatctgtgaggccaggcatggtggctcatgcctgtaatcccagcactttgggaggccacggcgggtggatcacttgaggtcaagagttcaataccaatctagccaacatggcaaaaccctgtctctactaaaaatacaaaaaattagctgggcgtggtggcacatgcctgtaatcccagctactcaggaggctgaggcacaagaatcgcttgaactggggaggcggaggttgcagtgagccaagatcctgctactgcactccagtatgggtgacagagcgagatgctgtctcaaaaaaaaaaaaaaaaaaagtacatttgtgagattcatccccattgttgcatgtatcagaagtttattctttctcatagctgtgctgttttctgtaagcatgcctcaatgtatttatccattctactgctgatacatagttgggttatttctagttctgacttattacaaataatattcttaaactgtatacagtatatttctgcgatggacaaatacatccatttctactgggcatataacacaggaagtcatgttatatttatgactttattaggaaccactgaacagttttccaaagtggttgtaccattttgtattaccatctacatttatacaacccaccatacgtgagttctttctgctcctcatcttgccaaaacttggtactattgttctcttcaacttactcattctggtggggtgcaatggttttggtattttcttaaacatacttcttatttactcttgcttcattgatactgttattctcccaataaattattcctaaaattgtaatgactactgaattcagagatgttgtgaattactattcagtcaagaacttgctaccaaagttcatttagtcttatttgtcttccttctccctccatttcttttttttttttctttttttgagacggagtctcgctctttcgcccaggccggactgcagtggcactatctcagctcactgcaagctccgcctcctgggttcacaccatcctcccgcctcagcctcctgagtagctgggactacaggtgcccgccaccgcgcccggctaattttttgtatttttagtggagatggggtttcaccgtgttagccaggatggtctcgatctcctgacctcatgatccgcccgcctcggcctcccaaagtgctgggattacaggcgtgagccactgcgcccggccctgcctccatttcttaaacacctccaggtaagaatactttaattcatttaccactttgttcttatacaaataaacaagttgccaattacaaatctagctactttggaatatccttcatctcattaatacattactagtgtaagtttgctgacaggatttgatgtacaataaaaaaaaatacatcttccctgtaaagcctattcatgacaataaatccttcaaacaattccacttctaaaaaaaactaatttttctgtgtagtattcaacaatgttaaatatttcaaaaaaatgcaatgtttgtgcagctagctaaccaacacttattttgccaacttgttattaaaatctatcctaacaatctgtgtagctaggaagggagccacagatgtgacataatcaagattttccagattacttttaattatgggactattttgctcaaatgctgaactatcaggatttccagactactgaatgccagataagtaatgggactttatcattattctgataagcctttggataacaaagtcaggtagcgctaaacactcttccatctattatattactaaggcagcgcccaaatgatccataaattacaaataaacaagttgccaattacaaatctagctacctccatctctgtgccacatcagacaactcacagcattcagatccaataaacaacccttggcctgctaaaaacaattataattaacagctgtggatgagtgagtagttatagatttctgaaaaactaggaattgttccacacaacaggaaaggtgtttgtttaatcaaaatattgggaaaggcagagatcttaaaagaaaatatgcaacccagcatgatggctcaggccctacatcccagcactttgggaggctgaggcaggaggatcacttgaggccaggagtttcagaccagcctggacaacatagcaagactgtttccacccccaccccgcctcagaaaaagaaatccagcacaatcccctatctaaatccagtactaaacccatatcttccataaaaggcagcacggtgaaaagagaataaaattctgaaatcacactgggtgtggtggctcacgcctcaggtggctagtgtctgcaatcctagcactgtgggaggccaaggagggctgaccgcttgagcctaggagttcaaagccagcctgggcaacatggcaaaactctgtctctagaaaaaatacaaaaaattagtcagaagtgttgggaggcggaggttgcagtgagccaagattgcaccactgcactccagcctgggtggcagagcaagaccctgtctcaaaaaaaaaaaaaaagaaaaaaatgaaatcagacatcacagcccctggttcacttctgaacttccttactaaccagcactacgacctgggcaaattacctaatctgagtctcaactgcctcatctgtagggaattatgccaattatacacctatctcatagaaccactatatgaattattttaagatactatatggattattttaagatactatatggattattttaagattaaatgagataatccatatagtgtctacaacataaaaaattttagttcaaatgtctccttttgccagaaagaataccgatcacatagggaacttaagttatggcgctgtgagggccacctcacttctcacccaaacaaaattacaaaaatacatgaattccctctacaacatcttggaaatcaagtcctggtctttacactggaatacacatgtccgtagggggtacacaaagatatgcaagcaagggaatcaacttccatgctactctcataaacctgatctgtgtggataactagatgatcaattttaaattttcaggcataaaatttattactttaggatgggtaggaaaactacagccctaaaccagatctggtctgctaccaataaagttttattggaacacaactacacaaaaatacttgcatattatctacggctattttctgggtttttttgggtttttttgagacagtcttgctctgtcgtccaggctggagtgcagtggagcgatctcggctcactgcaacctccacctcccgggttcaagcgattctcctgcctcagcctcccaagtagctgggactacaggcgcccaccaacacgcccggctaattttttttgtattttttagtagaggcggggtttcactgtgttagccaggatggtctcgatctcctgacctcgtgatccgcctgcctcagtctcccaaagtgatgggattacaggcgtgagccaccgcacccggccacatattgtctatggctgttttctcactacagtgagaattaagcagtaatcacagaaaccatgtggcccataaagcctttcatctggcctttgacagaaagttgacttttgctttaggataaaattctgtgggaaaagtggaatggatacaagttcaaaaagaaaaaggaaaaatatgtaatggacaaactcccaaaatgataaaaatgaccaaaactaactcaactaactatattaagaaattgaattagtaaaatcttcccagagagaaaaacccaggcccataggacttcactggtaaattctatgaaacacgtaagaaataataccaatcctacacaaactatttcagaaaacagaggaggaaggaacacttcccaattcattttatgaggtcataattaccctgctactaaggccaaagatgacataaaaaaaaggaaacctcagaccaatatccatcatgaacacagtcacaaaaattaacaaaatgttagcaaattgaatccatctatatgtaaaaagtagtagatacattactaagcagggttcatttcacaaatgcaagatgggtttaacatctgaaaatcaagtaatgtaataagctatgttatgtatttcttacagtctttgtttcaaaagtttagttgtatgtttttacaacatcaaattgatattgtatttaggtaattttatatttatttttaagaagtcaatatttacttgtcagaaattacatcctaaactatttaaaattaaatacttacactatgtaaatctaggatgaaaagtttcaggtgccaacttaaaagtatataagatctaacagattccacagtcttttagacattctcaagaagaaatgttttaagactagtgacccagcctatacctgaaagcctgaaatgacaaggagaaaaataatcattcatgccaaagcaacaccaccatatcttcaaacttttgacttctgcccataaatttactcttagcacatctagatctaaacctaatattccaggtacaagcctaccagtgatgcaacctttctcattctagattttgcattttcctgatacaatatactaatgcaggtcacatcggttcttctcacagccttcttaaccacaccactgattggtgattaaaacatcacatctttttattatagaactcctgtgaggtcacatctccaccctcccctaataggtatagttgattttgtttggacccaagcgcaatttctcacatttatacatgcttccttcatttcattaaacagcactgagcaaattatattgagatcttttcccattctggcaatcaccaaccaaatgactctttctttacttcacaaaggcaccaaatccaataagcaaaccttctagataaggtctcaaatacatgaagtatataaagaaagtgatgaaaccccagtttagatcaccggaattccagctgtaagtagtgtccacaaatcaaacctctccatacatagattttcaaactcatgactccatctaactaccacaatctggcaaattcctccatctcgcccactcagttatagtaagactcagtaagaccaggcgcggtggctcacacctgtaatcccagcactttgggaggctgaggtgagtggatcacctgaggtcgggagttcgagaccagcccggccaacatggtgaaaccccatctctactgaaaatacaaaaattagccaggcgtggtggtgcatgcttgtagtcccaggtacttgggaggctgaggcaggagaatcgcttgaaccaggaggcagaggttacagtgagcagaaattgcaccactgcactccgtccaacctgggcaatggagtgagactccatctcaaaaaaaaaaacaaaaacttcataaatgccttgctaaaattctgacacactatcattatggtcactacactcctttgagccacaatttggatgtcctgtcctgttgttctggctgaatttaggagaactctagtaagcccttctctggataagaaaagaaaaatgatacatcttccattttgtattaattacagaatctcacaaatggcaaggattttaaacattttctaatgttgtttttcttagacagagtcttgctatgttgcccaggctggccttaagcaatcctcccaccactgcactcggccctagtctaatatttttcttttcttttctttttttgagaagtttagttcttgttgcccaggctggagtgcagtagcatatcttggctcactgcaacctctccctcccaggttcaagcgtttctcctgcctcagcctcccaaatagctgggattataggcacccaccaccacccagctaagttttgtatttttagtacatacggggtttcaccacgttgcccagactggtctccaactcctgacctcaggtgatccacccgcctcagcatcccaaagtgctgggattactggcgtgagccacagtgcccggccttaatatttttcaaactatacgtcatgacctattaggggtcagactcaatttagtgagttgcaaccaatatttttttagagtgcatcttctgtagaaagggtaagtaaacttttcattggtgtgtgtgtgtgtgtacacactgagtgtgcaggggcacaataagtcatgatgtataatatatctaactgtgggtcacaggtaaaaaattttgagacacttttctagccccacagccctatgccaaggaggctctaccaagaaattggtaataaacaaaatgtcatgtttttacatcatacagagaaactagctaagaggattttgtgctcagtacacgtaatctgccattcattaaaaaaaaaaaaaaagattaggatccatctgggtgtccagttgaaatactaaactgcttggagacagccatttctgttttggtggggtgaagacctgtatttgagacagcagactgaaatcggtttggtctgtggcgaaggaagagaagaaaaaccattctgggtcgcgagttcctcacctgtaaccacaggagaagactgttggcttggtcagttgattttcaactaatctcccaattgaagagttaggcgaagcaattgctattgggagattaactgaaaattaactgaccaagccaacaaggactatgcctcccacaaaccaaaacactttaaccactcagcaagtcaagtattgatacatacaatcaatatcacacaaagtgtactgaaaagaaccacagacttgcatcaaaggcagaaatgaatccagggataacttcctgggattcgaagatgtgacctggtaggtataaatttctcaggcatcctctttttctaccctccagttcatctccgtcctcaagctatcagtcatggatgtggcactggcgttcttctctgccaccgtatctcattatgcaaagggaaactgaggcacgaagaacagagtgagtgagccaaagaactgcagcagccaccaacaaggctggactaagggcccaagcagctaatgcctcactccccacacaatccccatactatttagaatcctgcagtcctcagccttccacctcaaaccaaactcctggggccgcccgtagtacgtggtcccctgctcatccgatgaagcccccagctcttgcctgcctgcctgcctctataaaggtctacgaggcctggaactctgaagcctaaagcaaccccggcagccccctcccacgaccgtccacaaaccagtagcctcccttcgctcccacctccgcgccgacgggcctggagctcctccgcacaccacaccaagccgaccactcaacaccagaggacccacagaagaattctctccacgcccacccccacagcatcggccttcaccaccgccgccgctgccggaagcgcccccacgtctccacgccaccaccgtgaggtcacttccggcgcgacaccttggaatccagggccgtcaattgaggggcgtggcacccgggaaatttaagaggttggaagaacgtcccttcggccttacagaattgcgcttgggtagtcattttgccctccacgcttacttatgtcctgtggcgtcttggctggaatcggggctctacccacgactccccagcctcgatgcctgggcccccctcttgcaggctcgatgaaaagcacccgcttcccctcctgttaccccagcgccaatcgcagagctggagcggaggactttcagggaggcctggtgacgtgacagcccctccgtgctaaactgcagctgtgggacttaataagtgcgacaaccccctgatggattaaagaaaacaagatattcctgccgtggtcgatcttcaaagcgtatcagcttcagcccttttgggggttaaaatcagccagtccgtgcttgactgctctcccttcccccatactcagtacacaggaaagtgccgctcttctacccctggcattttagagtcttgatttgtggggagacgggaaagcatgcgtttagggccaagaccgtgtaatgaggaatattgcacagccttgaagcctgacacctggtttgggaaccactacttgggcgaatagcatagagtagggtagcagttccaaacctagctctacaaaatcagttgaagaactttgtaaaatctacactttctaggggactgcttcacccttccccctccatcaccagagattccctaggtcagaaggggtccttgtcttttaaaattactgttattaatgaacacttatagagcagtttttggttcagggcaaaactgaacagaaagtacagagttcccatatatcccctgtacacacaggcacatacacaacttgtcccctcatggacatcttgtgctacagtggtacatttggtaacaattgattacccaactttgacacatcattatcacccagagtccatagtttacattagagtttactctcggtgttgcacattctgtgggttttgacatatatgtaatgacatgtatccaccattatggtatcatacacgatagtttcactgccctgaaaatcctctgtcctctgcctatttatccttctcagtcccctaaccactggcaaccactgctccttttactgtctccatagttttgccttttccagaatcccatatagttggaatcatacagtatgcagccttttcacatcggattctttcacttatgcacttaaagttcttccatgtcttttcatggcttgatagctcatttcttttttgtgctgaataataatattccatcgtctggatgtgctgcggtttatccattcacctactgaaagacatcttggtggcctccaagtttgggtaattatgaataaagccgctatacatcatgtgcagatttttgtgtagacatgagttttcaattcatctgggtaaataccaaggagtgcaactgctggattggatggtatatttagttttgggagaaactaccaaactgcctttcaaagtggctgcatcattttgcattcccacagcagtgaatgagggtttctgttgctccacatccttgtcagcgttttgtggtgtcagtattttgccgttcaagtaagtgtgtagtagtatcttattgttttaatatgcaattccctaatgacatatgatattgaacatcttttcatatacttacttgccatgtgtatatcttctttgatgaagtgttcattcaggtattttgcccatttttacattgtgttattttcttgttgtgatttaagagttctgggtatattgtagataacagtcctctatcagatacgtcttttataatattttctcctagtctgtggcttgtcttctcattcttcttttgaagagcagaagttttaaattttaatgaagtccagcttatcaattatatttttcacagattatgctattggtattgccctaaagtcattgccattcccaagatcagttaggttttctcctgtgttgtcttccaggagttttatagtgttccattttacatttaggtctacaatccattctgagttaatttttatgaagggtgcaaggtctttgcctagataattttttttttttttttgagacggagtctcactctgttgcccaggctggagtgcagtggcacgatctcagctcactgcaatgtctgcctcctgggttcaagtgattctcctgtctcagcctcccaagtagctgggattacaggcacccgccaccacacctggctagtttttgtatttttagtagaggcaaggtttcaccatgttggccaggctggtctcgaactcctgatctcaattgatctgcccacctcggcctctcaaagtgctgagattacaggcgtgagccaccgtacccggcctgatacatttttatgtgtgtgaaaattcagttgttccaacataatttgttgaaaaacctatctttgctccattatattgctttaactcctctgtcaaagatcagttgactacgtttatgtgggtctacttctggattgtttattctttcaccaataccacattgtcattattactgtagtttatagtaagtcttgaagttgggtagtatcagtcctccaactttgttctcctttaatagtgagctggctcttctaggtcttttgtatctccatatcaattttacaatcagtttgtcgacatccacaaaaataatatgctgatacttggattgggattgcatcgaatctatagatcaggtttggaagaacagacattttgactatattttctttctatctgtgaacatgaaatatttctcaatttatgtaattcttttatatctttgatcagagttttgtagttttactcatatagctcttgtatatgttttgctgtatagatttataacctgatgactttttttttttttgagacaaagtttcactcttgttgcccaggctggagtgcagtggcacgatctcagctcaccgcaacctctgcctcctgggttcaagtgattctcctgcctcagcctcccgagtacctgggattacaggtatgcaccaccacgcccagctaattttgtatttttagtagagatggggcttctccatgttggtcaggctggtcttgaactcccgacctcaggtgacctgcccgcctcagccccccaaagtgctgggattacaagcgtgagccacccagcctaccttttgtttctctaaatctgctctttctgaagttagtatacctactcctgctttcttttgattagtgttatcaatgatatatccttctccaccactttacttttaatctatgtatgtctttatatttaaaatgtgtttcttgtagacaacatattgttgggtcttgtttttcatccatactgagaacctctgtcttttaattggtgtatttagatgactgatgcttaattaatgatatagttgaattaatgtctactatatttgttactgttttttttttcattttttgttgttgttgtttgttttttgagacaccgtctcgctctgttacccaggctagagtgcagtggcatgatctcagctcaccacaacctccatctcctgagttcaagcgattctcctgcctcagcctcccgagtagctgagattacatgcacatgccaccacaactggctaatttttgtatttttagtagaaatagggtttcaccatattggccagggtggtcttgaactcctgacatcaagtgatccaccagtcttggcctcccaaagtgctaggattataggtgtgagccaccacaccaggccctttttttgtgtgtgtgtgagttggagtttcaccctgtcacccaggctagggtacagtggtatgattgtggctcactgcagccttaaatcctgggctcaagcaatcctcccacttcccaagtggtggtactataggtgcccaccatcacacctggctaagctttttttttttttttttgagatggagtctcgctctgtcacccaggctggagtgcagtggtgccatctctacgaagtgaaaccccgtctcaatgcaagctccgcctcccgggttcatgccattctactgcctcagcctcccgagtagctggaactacaggtgcccgccaccatgcctggctaattttttgtatttttagtagagatggggtttcaccgtgttagccaggatggtctcgatcgcctgacctcgtgatctgcccacctcagcctcccaaagtgctgggattacaggcgtgagccactgcgcccagcctgctaagcttttttatttgtttgtttgttttgtagagacagagtctcactatgttgcccaggctgcttttcaattcttggtgttaagtgatcctcctgcctcagcctccaaaagtattgaaattgcggtgtgagccatggcacctggccttgttactattttctgtttgttacccttattttttatctgtatttgtcttctacacattttctgcctttggggtgtgtgtgtgtgtgtgtgtgtgtgtgtgtgtgtgtgtgtgtttatgtgtgtttgagatggagtcttgctcttgttccccaggctggagtgcagtggtgccatctcagctcactgcaacctctgcctcccaggttcaagcgattctcctgcctcagcctcccaagcagccgggactacaggcatgtgccaccacacctggctaatttttgtatttttagtagagatggggttttgccatgttggccaggctgatctcaaactcctgacctcaggtgatccacccgcttcagcctcctaaattgctgggattacaggcgtgagccaccacacccagccaccttttggggttttaattaagaatttttatgattctcttttctcacctatattaacataccaattattcttttctttttttttttgttttagtggttgcccaagaatttgcaaatatgcaatttacattttcaaataatccaattcaactttcaaataacactatactacctcatgaacagtgcaggtaccttataataacaaaatattcctaattcttccctcttgtccctgctatcattgttgtcattcatgccacttatacataagcatatattattaactttaccagcatttcttagttttcaccttaggtgggacaggatggctaaagaggctaaagttgggtatttttctttccacagcaaggttaggctttaataaaaccccagtaggttaggctcctaccacttcaggccttactcccagagactctgattcgcctagtctggggtacaagccagggatctgtattttaaaaagctcctcagattagctgggtgtgggggctcacacctgtagtcccagctacttgggggactgaggcaggaagatagctttagcctagaaggcggaagttacagtgagctgaaatcatgccactgcactccagcctgggcgacagagtgagaccctgtcttaaaaaaaaaaaaaaaaagagctcctcacagaattcagatgcttatggccagaagcagaagaccacacttttggagctgcaccaagctctttgcttaacattacaagggaaagcctcatatcaccaccattccctcctcaagactctcaataccaccccatgccccattcacgcaaaaaaatctggaggttcattgctccaatgtctaatttggttctttccttccccacctttttccctgggctcttatcactcccacactaatgcatatctagttttacacaagaggatgttttcgcaacagaatctagaacttggggtgtttgttaattatacaacaaattcaaattaaagatcaacatcatacagaattagggacacgtgggtcatgctatgacatattccagatacctgtcttttcaacaatcaccagcaatagtgtgttaacattgaatacaagttgggacaagaaatatacatcatgtgcctggaacatcttgtcatacaagacagcaaataaaccatcacactacaagatttttgtcaagagctcactgtaacctccgcctcccaggttcaagtgattctcccacctcagcctcccaagtagctgggactacaggcacacgccatcacaccctgctaatttttgtattttttcgtagagacaggctttcaccatgttggccaggctggtctcaacctcctgacctcaagcgatccaccatccactgggattacaggcgtgagccacctcgcacggcctgtgtaattctatttatatgacattctggaaagggcaaaactataggaacagaaaacatcagtgtttgcctggggtagaaaatgggagggtatgactgtaaaggatttggcgagagggttggaggagtggtagaactaaatcttgattatatgcatttgcaaaactcatggaaatgtatacctggaagaatagatctggagctcaggaaagaaagatgaggtttggaagtcaattaccaggcaataattaaagtcccaataatgggcactatagtccagggatagcatatagcatgagaagagtcaacagctaaggacagaaccctgaggaacaccgacatttaagggatacgcacaggacgaggtctattcaagggcaactgagaagcagcagctaggaacatagaggaaaatccagcagtgggtgatgccaaagagaccaagaggatctttaagagaagtcaacagtgctaaatattccaaagagctcaaatcagaggaagactgaaaatgtacattagatttagcaactaggaggtccttggtgattttgacagaggttttaaatcggagtaaaggccccagaagtcaaatgccagtggtttgaggagagaacgggaggtaagcaagtggaagcactgagcgcagtggctcacccctataatcccagcattttgggaggccaaggcagatggatcacctgaggtcaggagtttgagactagcctggccaacatggtgaaaccccatatctactaaaaatacaaaaattagctaggcgtggtggcgtgcacctgtagttccagctacttgggaggctgaggcaggagaatcacttgaacctggaaggcagaggttgcagtgaaccgagattatgccactgcactccagcctgggcgacagagcaagactccatctcaaaaaaaaaaaaaaagtaattatctacttcaccccatgtgtatagctgaaagcttagcaagttaatgctgaatctgacattagaactcaggtctcttattacatatatgtaggggaaacatatgttccagtttggatggaatagtccctgttcatgcctgttaccttattgtaattattaataccacctgcttttattctcaaatacattgagaaaaatttgattaaaggtgataactttctatagtcagcctacttatatggcataggctttgaggctggcaagcattcttggttacttaagatcatttttcttttatattatctcaaagatttaagtctcttacattctcaaatgtcactttataaatgaagtaatgcacatacataaaagcaggccccagactataaagtgctaaacaaaggttaggattaaaaagaataataaccttttaggcaacagtttcttaaatgtaacaccaaaagcacaagcaaagcaagaaaaaaataaactgtacttcatcaaaattaaaaacttttgtgcattaagagatatatcaagaaagtgaaaagacaacctacggaatggtagaaaatatttacaaataatatatctgataacggtctggtattcagagtatgtaaagaactttcttttggtcaataaagggtttaaaaaataaaaacaagaaataacaaaaaagaactctcaacaacaaaaagataaacaactcaatcttaaaatgagcaaagtacttaatagacatgtctccaaagaagatacacaaatggccaacaagtacataaaatgacactgaacatcagtagtcattagggaaatgaaaatgaaaaccacaatgaagccaggcactgtggctcatgtctgtaatcccatcacttagggaggatgaggcaggaggatggcttaaagccagaagttcaaggccagcctgggcaacaaagtgagaccctgtctctacaaaaacaaaaaattggcctgtgggccaggtggggtggctcacgcctgtaatcccagcactttcggaggctgaggcaggcggatcacttggggtcaggagttgaagaccagcctggccaacatggtgaaaccccatccctactaaaaatacaaaaatatgctgggcatggtggcgcgtgcctgtattcccagctacttgggaggctgaggcacgagaatcgcttgaacatggaaggcagagattacagtgagccaagatcgtgccactgccctccagcctgggcaacagagcgagactctgtctcaaaaaaaaaaaatttatcctgtgcagtgatgtgcacctataggcccacttacttgggaggctgaggcaggaagatcccttgaacccaagagttcgaggttgcagtgagctatgtttatgccactgcactccagcctgggtgacagagggagacccagtctctaaaatgaaacacagccaaaaaaaaaaaaaaaggcccaaaacaatgagatactacttcacacccattaggatggctataaattttaaaaaggaaaataaatgttggcaaaaatgtggagaaattggaacccttgaatattgctggtggaaatggaaaatgagacagccactacagaaaacagtttgagagttcctcaataagttaaatgtagaattatcatgtgacccagcgattccacttctaagcatacatctaacagaattgaaaacaagtgttcaaataaaaacttacacatgaatgtgtatacaaaatgtggtctcgccatataatgaaattattcagtcatgaaaaggaatgaggctgggcgcagtggctcatgcctgtaatcccagcacttcgagaggctgaggcgggcagattgcctgaggtcaggagttcgagaccagcctggtcaacatggcaaaaccccatctctactaaaaatacaaaaattagccaggcatggtggcacatgcccatagtcccagctactcaggggctgaggcaggagaatcacttgaacccccaaggtggaggttgcagtgagccaagatcgcacaactgcactccagcctgggtgatagagcaagactctgtctcaaaataaaataaaaaaatagaagggaatgaagtactgctacatggtaaaacatggatgaaccttgaaaacattatgctaactcaaagaagccagtcacaaaaggccacatattgtatgattccatttatataagatattcagaataggcaaatctatagagatccctgttcccccttccccttagatcctgggaaccactactttactttctgtctctgtttatccattcatctgttgatggacatttaatgtgttttcatctttgcctatcgtgtacaaaattttctttcaacatgtgctttccattctcttggtatatacctagaagtgaaattgctgggtcatatggtaattctatgtttaactttttgaggaaccgcccagtgttttccacaatggctacatcattttacattcctaccagcaatgcatgaagattcaattttctccatattcagcatttattttcatctttttaaattatagctatccaaagggatgtgaagtggtatctcattgtggttttcatttgcttttttcttttctttttttgagatagagtcttgctctgtcacccagatttcagctcattgcaacctccatctcccaggttcaagtgattctcctgcctcagcctcccaagtagctgggattacaggtgcccaccaccacacccagctaatttttgtatttttagtagagacggggtttcaccatcttggccaggctggtctcgaactccttacctcatgatccacctgccttggcctcccaaagtgctgggattacaggcgtgagccaccgcaccccgccttcattttcttaatgattaatggcaagtatcttttcatgtgctctttggccgtatcttctttggagacatgtttatcaagttctttgctcattttaaattgggttgtttgtcttcttgttattgagttgggtttttgttttgttttttgaaacaaggtcttgctgtgtcccccaggctggagtgcaatggctcgatctcggctcactgcagccttgacctttggggctcaagagatcctcccacctcagcctcccgagtagctgggactacaggcaggtgtcaccatgcctggctaatttttgtagtttttgtagagatggggtttcgttacgttgcccaggttggtcttgaactcctaggctcaagctatctgcctaccttggcctcccaaattgctgggattagaggtgtgagccacttcgccaagcctgttttgccagggaggggggaatgatgatgaaaacgttctggaatcaaatagtgctgatggctgcataacattgtgaatatactaaaaatcatggaattgtacactttcaaatggttaaaagggtggatgttatgttatgtgaattttacttcaataaagaaaaatttaaagaagaatatacttaatgaacaacgaatactcagttctttttttaaaaatgttagttctgcagccaggtgcagtggttcacatctctaatcccagcactttgggagaccgaggcaggaggattgcttgaggccaggagtttgagaccagcctgggcaacaaaacaagaccccatctctacaaaaaaaaaaatttttttaattagccagacatgatgacatgtggtcgcagtcccagctactcgggaggctaagatgagaggattgcttgagcccaggagttcaaggttactgtgagctatgatatggccactgcactatagcttgggcaacagagtaagaccctgtctctaaataataataataatgttatctcattgttagcattattgttgcaattatttttgtttgcaaggccggaaactctcttcatcattcatcaatttttgtcatggaagacaatggtgaaatgggattcttctcatagaaacttgtgtcaccatcaaacttgttgtaatttccccattctattaatcaagaactccccaagtaaatgaatccagatttgctagctggtagctttgtgttttggctgcaatcatctgaaaatagctttccctttcgacctcattttgttgagataagtttaggcatgaaacagtagtcaggtgcagtaagtggggatcctgaatcccagcagatgaggctggatgaggacctgacctcaaggattcttgtttgtttcctccacccatccacaacagcatgcctctctcccttatgccctccctcctgctgcacccttcccacaacatcctgtaatccttgcttcttccttggcctgctttctcatgctccattctctatgtctaaactagagagaattctcttaattaaaactggagcagggatggatattgaacataaagaacgggatggggagggagagtgggctggtgcggtggctcacgcctataatcccagcacttcaggaggccgaagcaggcagatcacttgagctcaggagtttgagaccagcctgggcaacacagcaagaccccatctctacaaaaaatacaaaaattagccaggcatggtggcatgcgcctgtagtcccagctacttgggagactgaggtgggagggttgcttgagaccaggaggtcgaggttgcagtgaaccaaaatcatgccactgcattccaacctgggtgacagagcaagaccctgtctcaaaaaaaaaaaattaaaaattaagaaaaaaaagaacaagggggaatccagaacgatgctagctaatagaggcacgtgtgttgccaatttgaaaagacatctgaggctgggcatggtggctcatacctgtaatcccagcactttgggaggccaaggcaggtggatcacctgaggtcaggagtttgagaccagcctggccaacatggtgaaaacccatctctactaaaaatacaaaaatcagccgtgcatgatagcacgcacctcaggaggctgaggcaaaagaatcgcttgaacccagcaggcgaaggttgcggtgaacggagatcgcgccattgcactccaacctgggcaacaagagcgaaactccatctcaaaaaaaaaagacatctgagaagagaacagacagctgtcactgctgtggcagcagccctgcctcaggtgtgtggcccctcccagctccagccgcttgacctctgctgtctgccctctcccattcccctcctgggatacacatttagagaacaactggctcagcaacaattagccttttcagaaatgccagtgagttgccacttcttactcctgtgctggggcttttaaccgtttcaggagtgccagcttccccatctcctctcagcttcacaggcaagcctgaggggctgcgtgaagacaagtggctcttggttttccttacctggacctgcaagccaactattaaagtattcaggagagatgatcttgctgtgcaggcacagaactggaccagacacaagcccagatggtggaggagagggggtgggttggggaagcttccagggtcatcatgggaaatagcacagaacatgggctcccttctagattccgtgtattcctggggacctagaagccaggtgtcctccccaagcatcacaagggttagaccactctgcagggtatttaggagtccagggcacttctgtgtgttacccacaacccagatggatgaaaattgcaaggtgtatacttatttgctgccttgttctctgagggacccgtctgcctccactaccacacacttcagtcttacatcctgaaatatctgacatctgacattccccctgcaagagaagtacagagaaaagtggaaagtgaatgaattattttgcatgctgggtaaaagcatttaaacaaatggtgattaaacccaaaaatgtttcacaagacctgtttcacaatttttctgcatttataataaagtagatcaagtcttcttatgactcagtcttcataagactcagtcttcacagatcccaccaggagatgctctggaaaagtttcgacatggagattgacatctttattcattcctaatccagttcttgaaaagagtaaacagagatatgaacaagagacaaatacatttatccagggaggcaaaacagtattctcaaagtcacccaatcaaccaagacagtttctagtgaagacctgattcatcaacaaatcttttcttcttctccttctccttctttttccttctttcttttttaagacagggttttgctctgttgcccaggtgggagtgctgtcatgatcatggcttattgcagacttgacctcccaagctcaagcgatcttcctgcctcttttttttttttttttttgtattttttggtagagataatctcaccatgttgcccaaggagtctcactatgttgcccaggctggtctcaaactcctgggctcaagcagttctcctgcctcagcctcccaaagtgctgagattacaagcattagccatcacacccagcaatcaacaagtctttatgtaatgcccaaaatgtgctcaatcccagtgctaggagctgggatggaggcaacaaagaaattgacctgccccatttaagtgtcatgtatggttcaaaaattgtatgaaccatacatattcaaaccatacatggttcaaaaattaaatttaaaaaaaaactgacgtgccctgaagaagcttatggctcatccagggaaaccaaattaacacagggtatcaattgtccattgctttgtaacaactaacccaaaatttagtggcttaaaataacaaccatgtactgagctcactagtctgtggtttaggtgggtatactgctgattggggtgggactggctgatcttggctggactcactcaaggaagttggctagagtctggctggtctatggtggcctcaaccagggcaattcctctctgtttcatatggtcttttatcttccagcaggctccctgggtttgttgttgtggtcgtggcaggattccaagagaaggtaaaggtcgatgaggtctcttaagacctggcctcaaaactagcatgccatcacctccaatgcattggactgatcaaggcaagtcaccaggccagcccagattcaaggagggggaaaacagaccatacattttcacaggaggatatgtaaagtcactttgtaaagggaataaatacaggaaggaaataaaattgggccacaatgacacaggaagtaacaagaaaaaccagcaagtggctaaaggccactctgtgctgggaagaagttgaccaggtcccagggctagaacccaggccaggcttcttgtcataagtcagggtagcaaaccactcatactgctcccagtccctctgggaaatagttaacatttgttgtaggccgacagccagtgtcagtttcaagaaggcttttaaaggtgggtggtgctggaggtggttcccaggcttggaatgggagatccagcatctcctttggaactctctgtgtccttcgctccttaaacaagctagataggcactcctgggccccccattttccagatgaaattggggccctgtatggaagctgccaaaccgtttttgagtcactgaggaaacccttagatactctctcctctgtggagacctacagacttcctggattaaccatagcagcctatgcagcctgatctcacattgactcttcttcttcctgtcatcctttggctatgatttggctaggaatggatacagatttattctgatggagcaggcttttgtttactctccaaaaccttcaaggagttttgtgtgtgtgtgtgttttgccccaaaattacatttgttatctgtaggagggttggtttgtaaggaacttaccctgccataagccacataattcaaaataactgttaattttttccccgaattaaatctgctgtaaaaattctatggtatgagaggcatcataccatagaatgaacagagtactggactttaaaacagaatacctgattgtaaaaattccatataatcttggaattgagaagacctccttaattgtcgttcaaaaatccaaaaaccataacagaaaagattaagaaattctactacataaaaaaaacctatccatattaaaagccaccatattcaaaaagtcaaaatacaaacagggaaaaatattttcacatcacagacaaatatctaatctgaatatataaagagtcccaagtaataaataggaaaaagaccaataactgaaaagaaaaaaatggacagaggctgggcacagtggctcatgcctgtaatctcagcactttgggaggctgaggcgggtggattacctggggtcaggagtttgagaccagcctggccaacaaggcaaaaccccatctctactaaaaatacaaaaattagccaggcatggtggcgtgcacctgtagtcccagctacttaggaggctgaggcaggagaattgcttgaacccaggagacagatgttgaagtgagccaagatggcgccactgcactccagcctaggaggcagagcaagactgcctcaaaaaaaaaaaaaaggacaaagaatatgaacagacttcaagaaaagaaactacaaatggttcttaactatgtgaaaagatattaaaagataaaagcaaagaccaggcgcagtggctcatgcctgtaatcctagcactttgggaggccgaggcaggtggatcacttgagctcaggaggtagagaccagcctggccaaaatggcaaaaccctgcctctactaaaaatacaaaaaaattagctgggtgtggtggcgggtgcctgcaatcccagctactcgggaggttgaggcaggagaatctcttgaactgggaggaggaggttgcagtgagccgagatcatgccactgcgctccaacctgggcaacagaccaagactccatctcaaaaaaagaaaaaaaattaaataactggtgatcaactggatacagagtaggactaaatacaactgtgaaaatctagggacgtgaatcagaattttgaggtctcatcttagataaaaaaaggaaaattgtaaaaaggacaaacaggccattgcttctgataatgagtgtcaaggacataatattaggaaccatgtttattgaaatcatataaacatgaaggacaatgctgagaaatattattcttttattacaagaccctaaaaaactgctgtttaaaatcataccagggaaaaagaggaattaatttggaggaatcacacttcccgatttcaacacttactacaaagttacagtaatcaaaatagtgtggtcttggcataaggacaattgagagtccagaaataaactcatacatccatatccaattgatttttgacaaggacgccaaaaccattcagtggggaaagaatgatctcttcaataaatggtgcttggtaaaatgtaaaagaatgagtttggaccgttactttacaccatatacaaaagttaactaaaaattgatcaaagacctacatataagagctaaaatcaggatgggcgtggtagctcatgccatctataggttcagcagtctgtaaacaaaaaatggcatagtacttgggagactaaaactctgtctaccaaaaagaaagggggaaaatgataacattgtattgtaagatttataatgactctgcctccaagaaaaaaaaaaataggccaggcgtggtggctcacgcctgtaatctcagcactttgggaggctgaggcgggtggatcatgaggtctggagttcaagaccagtctggccaagatggtgaaactccatctctactaaaaatacaaaaattagccaggcgtggtggtgggcacctgtaatcccagctactccagaggctgaggcaggagaattgcttgaacctgggaggcagaggttgcagcgagctgagatcgcgccactgcgctcgagcctgggtgacagagcaagactccctctcagaaaaaaaaaaaaaatatatatatattatatatatgtgtatatatataatatatattatatatgtgtgtatatatataatatatattatatatatgtgtatatatataatatatattatatatatgtgtatatatataatatatattatatatatgtgtatatatataatatatattatatatatgtgtatatatataatatatattatatatatgtgtatatatgtgtgtatataaaatatatacattatatatgtgtatatataatgtatatattatatgtgtgtatatataatatatattatatgtgtgtatatataatgtatattctgtgtgtatatataatgtatattctgtgtgtatatataatgtatattctatgtgtgtatatataatgtatattctatgtgtgtatatataatgtatattctatgtgtgtgtatataatatatattatgtgtgtgtatataatatattatatacgtgtgtatataatatattatatacgtgtgtatataatatatattatatacgtgtgtatataatatatattatatacgtgtgtatataatatatatattatacgtgtatatataatatatattatatatgtgtatatataatatatattatatatgtgtatataatatatataatatatgtgtatgtatatattatatatgtgtatgtatataatatatattatatatgtgtatgtatataatatatattatatatgtgtatgtatataatatatattatatatgtgtatgtatataatatatattatatatgtgtatgtatataatatatattatatatgtgtatgtatataatatatattatatatgtgtatgtatataatatatattatatatgtgtatgtatataatatatattatatatgtgtatgtatataatatatattatatatgtgtatgtatataatatatacatatgtgtgtatatattacatatatatgtgtatatattacatatataatatatgtgtatatataatgtatattatatatgtgtatatataatgtatattatatatgtgtatatataatgtatattatatatgtgtatatataatgtatattatatatgtgtaaatattatgtatattatatatgtgtatatattatatatgtgtatatatgtgtatatattatatatgtgtatatataatatatataatatatgtgtatatataatatatataatatatgtgtatatataatatatataatatatgtgtatatattatatatattatatatgtgtatatattatatatattatatatgtgtatatattatatatattatatatgtgtatatattatatatgtgtatatataatatatattatatatgtgtatatataatatatattatatatgtgtatatataatatatattatatatgtgtatatataatatatattatatatgtgtatatataatatatattatatatgtgtatatataatatatattatatatgtgtatatatatattatatatagagagagagatagagagagagagaaagcaatgagaagtcaatggaaatatttgaagcttgctattgtccttgacacatactatcccagcagcagaactagaagactatcagtgaagagcatacgacaggacagagctgagtactcaagaattgagggtcccttgcagttgtcactatgtggggctttcattttggtgaaacttccaaactgttaataagataaggagcccaactgaaagatgctgaacatattaaatttgctgagcagcagatacctgcattagtttggaaatacagtctttccccaaaatgtttcagctgttcatatatatattatatataatatacacacacacacacacccctccatatacattatatatatatatatatatatatatatatatatatatatatatgcactgggtatgcacagaggattctgaatggctctaacagcgggtgtgatggttaattttatgtgtaaacttgactgggccacaagatgcccaaatagctggttaaacactatttctggctgtgtctgtgagggtgtttccagaagaaattagcatttgaattggtggactgagtaaaggaggtggccctccccaatgtgggtgggcatctgttgagaacctgaatagaacaaaaggcagaagaaggttgagtgaactctgcctgaccctttgaatttggacatggttcttctgtccatggtgctctcgttcttgggccttcagacctggaatggaatctaaaccatcaactcttcagctctcaggcctttgaaacacaccactggtttttttgggtctccagcttgcagatgacaaattatggactgtctcagcctccataatctcatgagctcttatatacatataaagagatattacatgagctctttatatacatataaagagatattatatattatatacagattattatatataaagatatatatcatatataatatatgaagatatattatgtaaaagatatatagtatatataatatatcgatatataatatatataatatattatacataaagatatatatttataaatggaaaaagaatatgaacatatatattatataaagatatgttacatattatattatatattatacattatatattatatataaagatatataatatataaaatatatattaaatataatacatataaatatatattaaatataatacatataaagatatataatatataatacatataaagatatatattatatataatacatataaagatgttatatataatacatctaaagatatatattatatattacatataaagatatgttatatataatacctataaagatatatattatatatataaagagatttattttgaggtattggctcatgagagccaattatatatgtattatatataatcagtcttttcaaaaccctcttgtcgagataccccatggttccccactgcaatgagtaataaatccaacttgtttaactacaggtgttttcctggtggcccttgactggagggcattgacaatatatattaattatatttctcaaaagcaaaaagcaatacaagctatttatatgtttttcttcgtttttataaagcaaacatttttgtaaccacactgggtcaaggaatagaactttatcagctatcccagaggccctccacatgtcccatttcaattatcacccactccctctcccaaaaagtaaccactccccaaactcttgtagtaatcatttccctgttctttacagtttcatcactaagtgtgtatccctggacactatagtttattgttgctcatttcttaaaatttgggttcaagcaatttgatgtctttttatagtttcttttcatctacaagttttccctccatccctttcttttccttatagattttctgttgaagaacccaggccttttgacccacagtcttccaaagtctgaattttactgactgcacattcatgttgcaattcacgtccctacatcctctgtatttattgcatattggctgctggttccggaggcttggtcagcctctgatgcaatccctttgacaacactataggtgctgttgtgttctttcatcaggagtcacatgatgtctgattttctctccttttatgatgtcagcagttgttaggcacaatgtttagatctattaatttattggtgactacaaaataatgacactaattctataatttctttttcacataataattgaattttttttttttcgagacggagtttcgatctttgttgtccaggttggagtgcagtggcgtgatctcggctcactgcaacctctgcctcccgggttcaagtgattctcctgtctcagcttcctgagtagctggcattacaggcgcccgccaccacgcctggctaatttttgtatttttagtagagacggtttcaccatgttggccaggctggtctcgaactcctgtcctcaggtgatctcggcctcccaaagtgctgggattacaggcatgagccactgtgcccagctggagtatttttaagagatacttctttctaatctatttggttctttttaggtatagttcatataggacaggtagaataaattcttgatttttttttgagacagattcttgctatattgtccaggctggagtgcagtggtgtgatctcagcttactgtaaccgccacttcctgggttcaagcgattctcgtgcctcggcctcctgagtagctggtattacaggcgtgtgccaccacacccagctaatttttgtatttttggtagagacggggtttccccttgttgcccaggctggtctcaaactcctggcctcaagtgatccacccacctcagcctcccaaaatgctgggattacaggcgtgagccactgcgccaggccttttttctaccatttaagccattttgaactgcataagtcactggtttttagtatattcacaaagctgttcaaccatcaccactatctaattctagaatatttccatcacccctaagtaaactctgcatctcccaattctccctgccccacattccctggcaacctctcatctactttctgtccctataaatttacctattctgaacttttcatacacatggagtcatacaatacacggccttttgtgtctggcttctttcacgtagcatgctttcatggcttgtttatgtatatagcataaatgcaagttatagtttaagtagaaaatataaatcactacaagaatgattgagcaccaaatttctcatccccccggccgccgctgcacaaagcaggttgccgcagctgacttcagcttggttgttccttgcagtagcctgaagctcctggtgagcgggagccacggtgcatgaacagcaactgctggccactacgcaatgcttcaggaagaaagctggtctggggtggggtagggaggtcacatcccaaggtgtgtctcccttcagctcctggctatgtgggttcagcctctgccatacttggcatcaccaccactctgccatctcagatggacaggggctttcagcattgagatgtgggttctaatgtgattgtagaacccacgccagggcatgaagagtgagcagcagattacaactgctgagctgagaacccctctccccacaaaactgtgaccagagcctacccacttggacttcagcatctaatgctatcagtcccaaatgaaagactgtctctcatccttcaaggaaggcttggctcagatagtctcaagacctggagccgggcgtggtggctcacgcctgtaatcccagcactttgggaggccgaggtgggcggatcaggaggtcaggagatcgagaccatcctggctaacatggtgaaaccccatctctactaaaaatacaaaaaaattagccgggtgtggtggcaggcgcctgtagtcccggctacttgggaggctgaggcaggagaatggtgtgaacgccggaggcagagcttgcagtgagccgagatcgcgccactgcactccagcctgggcgacacagtgagactccgtctcaaaaaaaaaaagacctggaaatctcgcggtgcccactccccaacccagcctctggaccccacctcccgtatgcatctgtctggtagagttctgaccacaatgaattgaatgatgtgtttatgtgtcagttccctcaaccattttgggaggttcttgaaagcagggactgtactatattcacttgatacccttattgcctaattcggagaatacgcttcatcaatttgtgataagttagagagggcgtaagtcagcacagtgattaggagtcttgtctcatgcctgtaatcccagcactttgggaggctgaggcaggtggatcacttgagctcaggagtttgagaccagcctgggcaacatggtgaaaccccatctctacaaaaaaaaaaaaaaaaaaaaaaaaaagctgtggtggcgtgtgcctgcggccccaactactcagaggctgaggtgggagaatcgtgtgagcccaggaggtggaggttacagtgaaacaaaatggtaccagtgcactccagcctggatgacctggggaccctgtctcaaaaaatagagtcttgtccctcaaacagactgcttaagtgcagcggctacacctcttcactgctacctcctcttcttcctccctacagtaaaacccaacacagaatggggttcagggtgagtatttagacgagtgatgaatcatttatgattcaaaaaatctccacctataggatttctgaacaatatctttatttagctcaggtagttgttcttacacatttttggatacctgggttagaattttccctattacattaaatcaatggttcttaagctcttatgcaagcatgcaagctcaatgcaggctagaatagaaggattgttgtgtacaaacattaaaaatagacattttattacaagagtgtagagaagggagaccaatagaaggtaattgaaatacccccccctcactccagccctagtcctggtgcctggatatgtgcactccctgtgcgctctgatccccgcagacacaagtccccagcccctccaggacagcaataagggtcttacaaggccagaaggcagccctgtttgttcctgcctgcaggaagggcagaggaatgtgatgttcccaggaactgtgtcctagacccatagggtcagattgctcagcctagttcaagcagtgagactacctctgtgccagtatcctgggctgtctcttcccttcactcttggcagctcccaattgtcaaagattggacagggtcctggtttggctagttctaacttgctgaagccagtcagcaccctcacagagccagctaggtactgggcccaggggcttccagagagttcttcagagcttctcagaggcctaaggacctcctaaccctagcaggcctcctggctcaagcacaacttgggaaggctccatcagcatctatgtggccctgttttacctgttgtctctggagggtgtgcagaggcaagtccagggtaggggcaggcaggatcccttaggcttgcccacagcccagatagcaaaactgcagccagatcagtgtctatgagtttcaggctgaaccttagaccacataggccagcctgctggtctggctgcccaaccagaccaggtagacagagtctaggcctcagggctctcaagcacctaagagcgcagctgcatttggaagtgctcacagcaggcatgcttcatggttagcccatagatgggggtcatgtccaccttcacgcccagtggcacgctgaattccacccgttgcagcaggatagccaggaagagaaagacctcccagcgggcaatggtctcaccgatacacttccgcttgcccatgccaaagataatcaccttctcacttaacaccttgtcgatagcaccatcaggggtgagaaaccgttcaggtaggaactcagatgggttgacccatagcttcctgtaaccagagggagacagctgaagtggcagttcagggctcagaagtgtcaagtgagtggagctccagccccaaaggatagaggacaggcaagcagcccatggacaggaggatcaatgcaatgattgtattaatcatatataagagcttaagagggtggacccagcctttcctctgcatctctgaacttactggtcatggttgatctgccactggtttacaaagacacaacgccccttggggatgtaaaagcctttcaaacttgtgtctcttgttgtgctagggagaaaggaagctcagtcaggctcagggcaacaggcaaatctccctgtctcccatgccgtgtccctcccactaaccctaatcaggtatgtggtccggagtaagatcagtaacagacagcagtggctccatggggccttacctgtgggggatggtgaaggggacgaaggaagagtgtcggaaggtctccaggatgaaggcctccatatagggcagatgggatctgtcagagagccggggccgccgtgacctgccaatcactgtgtctgcagaacacagggacaagatggatgcaggggctgcctagacctggccagacccctggcactgacccctttgaagggagccactacctacctagctcctcttggatctttctctgtaccctggggttcatcaccaaatacatgaggctccaggagatagcagttgtgactgtgtcaaaccctggacagggtagaacagaagaagttaggcaggcagcagcaggtcagggcacttgagcacaggaaggacacaatggggtaaccataccagctccaaagaggtccaagacgatgttaatgatcttctcatctgacagctggacattggcgttctcatccagctgcttctcctgacagtgctcaatcaggctgtctgtgatgtcccggatgtggcccttaggtagggaaagtccacaggtgagcaagatctcaaacccagagctacctctccatccaggtctggtccttcactattcctagcacatttgttctggaggtgatgccccctgaggctgttgtcccagcttctctctgcctctgcaaggctctctcctactaccttagaatgctgctagccccaactcatgggacatttgacacacagcgtcttgtactgttatcatctggatgtgctctttatcttctttctattatgaggccaggagatgaactctttaactcttcctggctccctcagcaactgccccagggtcctgcatgtaatgactcttcagtggctattgctgtctgtggaagcatggaagggttagtcaagataaagttctatttccctgccaaggaagaagactattccacaactggcttcaagatcccaggttgaagccttcctgagaacttgccaagccccatgcagttcctcttacctttgacctcccaggccctgatgccatctgcttcccaccacccacctgcctttccccagactgtaccttctcaaaggttttgtagtgctccttgaccatcttctgcatgaagctgtagaacttctcattcaggtccttgaaggcattcagggaagggttgggtaggtagcgaagaatagggatgaagtcagctgggtttccagagccaaccacctccccgaaattattattcaggttgactaggctaagcagttcttggtggttgtggtcatagcgccggccaaagcaaatggcacagatgacattggtcactgataccaccacatacctgtaggggttaaagtgcccaggccctgccatcagctcctgcaacgtgcttatcaggacctcagcctccttgctcacatgctcttccaggtagcaggaggttgaggaggctgggtcagaggcaatggagaaacttttcaggccattctgggccaggcgccggcgggcagcccacactggtccagagtctgggctgaaggacatgctctgaccattactgatgagggtgaaggtgtagaggtcgggccggcccttgaaatcatcgccctgccgcaccagggcctgccggatggtgtccaggccgctcagcaccaccacgggtgtggagccaattcggatctgcagcacgtccccatactgctggctcatccttgacagtgccaggtgcgggttctttcccagggtcagcatgtgcccaatcagaggccagccccatggccctggtggattcttcaggcctttggggacctgaggtcttgaggccctgattacccagaataccagacagaagatgacagaggccagaagaaactccgtggccgacatggagattgggaaaagcatgatcagtgtagggatcttggaggtggctgctgagagaaggtgcaggaagaaaaaaagtcaagccgtcagattgggggatgagaaaagccaatatctagagtgtcagggaaaggggaaacctttccaccagaactgcttactgggcatgaagaagagggtgaggtggggagaagttgttgaactaccactgtgggctaagaatttcacagtccttcttcattcagccctggccacaaatctatgaagtagcctgcaatgaggctcagagaaggtaagtaacttgcccaaggtcacacagccagaaagtgttggatgcagactcccaagccaagttgcctaattccagaacgctttctcttaactgctgtaccaatctaaactgacatcttccaatgtcaatctgtgatttccacatagtaccagtactgttatttacttcacattttcctaaaatcaactttaaatctacctacatatcatcataaacaatatctatgtgaaagtacaagtttgatttttcccctaacacattaaaataaacacataatcaaggtgtatcaccccgagtcctacccaccacacttaggaaaatcatgttctcaggggaattagggatcatctgatcctttagcctcatttaacatttgggggaagcagcgctgacttgtccaaagtcccccagcaatcagtgacagagccaggactcagactccttagggacacttccctggaaatttccagctgctgtcacatgtacctccttttgaagagtggtcagatcaatgaaggaattttcccagaaccctcagttctctgctgctcaatcccaggatgcaggaaatcccaccagaccccaggacagactgaggaagagataggggacaggatggccacttcccaaaccacattgctttcagccccagctctctgagttcaactgatccacagtttaaaggcagctggagaccagctagattgagctctttagtcagagaaatccaggccagggtttttttttggctcaattctcaatgaatgaacagtttggacctcccccttttgcaggttaccagagagcagagaataaatggaaggttcccactaggctgtaagaaaaccccagactggaatcagggaaatcaggaatggatctaaactgaaaggaaactgaggcaatactttctctgtaagcttgacctaaaaagggtgtttaaattcataaaccactctctccaacatatcaggcatctctgcctgttaccctggactagaggtcagtagacccaacattctagtcaaagtgatcttggactgcacattttacttttctggggtccaatttcaacatctgagagagggtaagacaagatctctcagttcagagtacccagctggatccagagggaagagaaaacccagatctgctgtggggaacctgacagtcttaccagttaggctccccacaggagaacctcacaagacagggagatggatggttcctaccacaagtattatagtggagggaggcttcctggaggggctaaatatcaaagcacactagatccctgagtcaacaggggacagtgccaggctttggtgtgctatggtgtccccttctgcacagtgggtatcccaaggacctgcagcctttgtaagatggtaggaggccaagggagatgtgactggtgagtttttagggactggtatttccagctccctgcagttggcaatctgtcaccctgattgtctcccagcaaaggacaaagaagatggtcaatgagataggaaaggcctgggactcctgcacagatctgcctctattgtcccagctgtctaggacatctcagcactgacaagccacccttaggagggtaaaatctgccaggggtagcttcttaggctagggcagggtacagctggtaagaacccagcccaccccctccatccaccctgtccacccaaggagaagcccctgtcatcagaaagcctgagggaggggctgcacatattccagcctgccaggtggccttgatggggaagccccagggtaggcagggagacactcactaggggatggagctggagcctgggtcctgaagtcctgaatgagatgccatctgtatctagaggtctggtaccagctgtgggaccatgggcaagtcctcctcttcccctggcctcagtttccccactagggggctagactgcctggtcactaaaaacactctgagcctccctttttggaggtgctagacaggtagctacctaagaagtcctggaggcaccaaaatgttccttttattgggagagaaagggcaagccagaagtcccccagcaactcacctgaggtactgagctgagctgggaagggtggactcttggagcctgggatcacaaggatcagggaaggttccaaggaactgtcaccttcagggtgagggtgaaggcactgccacctttataggcgggcttgtacgtgtggccacgcctccttccctggagcgagctgagatggagggagaagcagcctgaaccgggctggtctctctgggattggagagaaaggtggcggagggcggcgggggtggggggtcgggtgggcaagaacccactatgggacacatctcggtgcctgtacatagaggggtgagggctgggaacacctggaagtcccaattccaaggcgtcccaagggcagtgcagaacccagccgaggagggggcttgagggagaagtcccaggacagcccgaagagagggtacgggaagctccatcctggggcgcggggactcctcttcgtcatttttgcacccactggaacgctgggcgtgcagatgcctccccagcgctacagcctaccaggactcggcaggcgggggcggggctgccccgtggtgacctccttcccggggttactgagtcccggctcgcgtgagaagcgctgcgaccccagccctgaggtcacgggggccggaaggccagaggcgccgcggggctggacctgtcccccagagcccgggcgactagctgaggttcgcgcctcttgattgaaggatcggaatggatggcgaaggggcaggctcgctgagcgctcactagcggctcctcgcagcctctaggatcgccttagtgctgattgcaacgcgcggtccctccagccaggacccaccggcccttgagggtccctcttggctcccggggtggctagtgctttgattggcagagcacagaaatccggcggcggggggccacggaaagactcgggcccagggaccacggagggggcacctggcgcggagcccccaccctacccccggctagcttgcgtgcgccggcgacatccctctagggggcagaggtcaggcggcccgtccccgccccacctggcccggaggcgcggtgcccaggcgttgcgtgagaaggaccggaggcccgcgcagccacccagccgacccattccccggcccggcgcgggggctcgcagtcacgcgaggggggagggagtcggggcggggctcttaaagggccagcctcgcgcgcggcgtggggttggggtggagggagaggaactgtcgaagggtggcgggtgcgcgattgaataaggggatgcggtgcaaagggtctaggtctgcgtgtggcttctgcctgcgaggagaggcagcctgcatgtgtccgcattttcggtccacgcctgtggcacgacacgaagccccagtgccatttggcatggcctagctgcctgcctccgacgctgtcccgccctccggaaccttcctgttacagggtttccaggaaaaaaaaagttgtatttgcgtgcctagctcaacctggccccagctaacatcgttacgcgccatccccgacgtgctccccaacccggtggcaccaccatccgtcgctggtccaggccagaaaataatcccctcacctcccattccggtcatatgcggcctcgtgcattgcacaaatatttaccaagcaactactatgtgccaggagctgttcggaggcgctggcgattgacagagaagggaacacagctgacagcactcctaatctcgtggagtttacattctgatggaaggagacaagtaatatgccccaaatctagagaatgtgagagggtaaaaagtgcggttgaaaaaaattaaacagaaaaggcgtacggattatgtgagggcagattgcaattcaaaacaagggggtcagggaaggccttgcggagagaggcaggagtgtggagtcaagaatcaatgtgcatagatatctggataaaaagtgtacctgggcaggtgcggtggctcacgcctgtaatcccaggactttggaaggccgagtcgggaggatcgcctgaggtcaggagttcaagaccagcctggccaatatggcaaaaccccatctctatcaaaaatacaaaaattagccgggcatggtgttgctcacctgtaatcccagatactggggcggtgaggggggtttggggggagtggagtcaggcaggagaattgcttgaacctgggaggcagatgttgcagtgagctgagatcacgccactgcactccagcctgggtgacagagcgagactccatctcaaataaaagactgcaactggcagagggaataagcaaaatcaaagcctcccgccaccccccaccacagtggttcttgaaggaccgagcagtaccagggatgtgcagaggtcatgtgactggggagttctcctggcatgtagtccagggggatgggatgcccatgaggcacagcgccctgccgcatgtgcagggagcaccccattgagagacatgagacttcctctgtgcgagatagagacatggctggggtgtaagagaagcaaggtcactcgggctactgtgctaagaataggaggcacatttctctgcttggcatctgctttggcatctgtccagctccactgccacaactcatccagggcccatcattgctccctggagcacttagcctccacctaggttcccatttgccttttgctccgtccaattacttctccatcctgtggcacccagagtggtcctgtcaaaaatgcaaaatctcattccatcaccaccttgcttaaatttctttggtagctcccaccactctgaaggcaggaataagaatctttagcagctctccctctccctctccctctccctctccctccctctccctgtcccctctttccacggtctccctctgatgccgagccaaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaacagggagtgatccgccagcctcggcctcccgaggtgccgggattgcagacggattctggttcactcagtgctcaatggtgcccaggctggagcgcagtggcgtgatctcggctcgctacaacctccacctcccacccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgccccaccgccatcccatctaggaagtgaggagcgtctctgcccggcagcccatcgtctgagatgtggggagcgcctttgccctgctgccccgtctgggatgtgaggagcgcctctacccagccgcgaccccgtctgggaggtgaggagcgtctctgcccggccgccccgtctgagaatcaaggagaccctccgcctggcaaccgccccgtctgagaagtgaggagcccctccgcccggcagccaccccgtctgggaagtgaggagcgtctccgcccggcagccaccccgtccgggagggaggtgggggtcagcccccgccaggccagccgccccgtccgggagggaggtgggggggtcagccccccgcccggccagccgccctgtccgggagggaggtgggggggtcagccccccgcccggccagccgcctcgtccgggaggtgaggggcgcctctgcccggccgcccctactgggaagtgaggagcccctctgcccggccaccaccccatctgggaggtgtacccaacagctcattgagaacgggccatgatgacaatggcggttttgtggaatagaaagaggggaaaagcggggaaaagattgagaaatcggatggttgccgtgtctgtgtagaaagaggtagacatgggagactcttcattttgttctgtactaagaaaaattcttctgccttgtgatcctgttgatctgtgaccttacccccaaccctgtgccctctgaaacatgtgctgtgtccactcagggttaaagggattaagggcagtgcaagttgtgctttgttaaacagatgcttgaaggcagcatgctcgttaagagtcatcaccactccctaatctcaagtacccagggacacaaacactgcggaaggccgcagggtcctctgcctaggaaaaccagagaccttttttcacttgtttatctgctgaccttccctccactattgtcctatgaccctgccaaatacccctctgcgagaaacacccaagaatgatcaataaaaaaaaaaaaaaaaataaggacatgcttgaagcctcctcaaaccacgagcaataaatccatcctgcactcttgaaaaaaaaaaaaaaagtatctttagcagaacctaccaggcctgcctgcctctagttctagtgtcccctaccttgagtctcagataaaacatcacttcctctgggatgccttcctggattctccccccagaaaattatgtttctcctggtcgctgtttccagcacttctccacggtaattcttaggacactggatacttgctatagccccgacccaacctgccacttctttccgtatgctctaacaaggaaaaccaacctgcaggaaattgatctgataagccaagtccaggcaagatattaataactggtaaaggaattagacacagctatactatacacaggccaaatggcaagagagatgttgaatccaaagtgctcatgctataatggtggaatttaggcaacagaacaggcaggagacaagggaggtattgctgggctttctcagcacccttccaattattctactctctgcatctttgattcagtctgaggagcttcatggtacccaagagaggtctgtccttcaatcctagttggagctagagccacagagaacgagcctgtgtggaagccatggcaaggaagtggaaagcaaggcactcctagatcctccaacatgctctgcagcacaacctcttcttcagcttcccagggtccccaccaatgccccagcgctggagaatcatggcagcctggtcaccagggctggaagaccaactagtgctagggctcccaaccagggacccttctcttgatagaaagtgcgttgctttgcttgcattatctaagaggctcttgactcctcaaaaactcattagctaataaaaccaattcgtctctcacttcttaggtggagagatgggtgccagaaaagaaaaggcccaagtacgcatggcaaatcaaagcagagcctagaactccagcttcttgcttctaggccagggcccgtctcaccataacttatcatcccagactatgagtgaagccccagggggccaaaggtagacagactcagcccctgggccagggcccctcacctctccacacccctggactggtgcactggggttacaagagatgttgcacttctcatcaccaagccgtatcttggctaacagttcacaataacaggaagggggcccacactgagcactgggcagagaaggagggagtcaggcaggaggttagaggaccttggcctggagctgaacactcattcctgggtcaaagtttgcatgcctttgcgtgagaagctctttggctaggattccctagtgatcaataccaggagcaggggcagaagtgctggggaggggaaagggctctgggctggagagatcgagacagctgagaggccttagcccagcaaaatcatcagcctagggctttcagtgagccctgctgaaggctgtgggcaaaggggactggaagacaagcaagatccacagcaaacccctgccccatggtagagatgggagtcataccctagacaagtcctgtgatgagtctggagatgctgcaggagctgtgaggaggctggggcaggaggggtgttaaagggatgctccccggagagtggagaactagagaaggcccctggagtctaaggagcataggaagggcattcctagcatggggaagagacacaatgtgaacaacagatagtagtgggaggtcggggtgaggcagtttgggtggatgtggagaactgggacttgtctcccaatgtgtcctctccccacccagtcatccccttctcctactgagatctgagcctgagcatcttcccttcctctcctgcctgtgcccagagagccagatagattgagtttgcaggatacagggctcagatggggcagctcttggctccctggctcttggctgctatagttaggatgacagtattttcccaggacagtctaagcctgttgtcatggaagaattgttaaaagtgccctctttcactctcaaaagatcctggcttagatgataataagttatatagtcaccccagtgatggtgggcatgggtgggttttgggggcccagcatctgttctcccttcttttggcaataccacatcaattgtcctttcgggatcacctcacccctactctcagcccatagggttactgtagctgacccaccccaggccaagccaatgagaaccctatgggagtttcccaacaccccctgccttctgttgctcgccagagtgcagtggtgcgatcttggctcactgcaaactccacctcctgggttcaagcaattcttctgactcagcctcccaggtagctgggattacaggcgcctgctaccacacccagctaattttttttttttttttttgtatttttagtagagacggggtttcaccaagttggccaggctggtcttgaactcctgacctcaggtgatcccccctgccttggcctccctgggattataggcgtgagccaccacacctggccccctatgggagttttgatgaaatcattggaaaagagaggttctccttctgtcagaggtggctacactggctagaaagtaagtctgaagctgccagtagtcattttttaaggaagccggccttagaatgatacctactcaaggaaaagcagatctgggagatgaggggaggaagcgggggggaaattgaagacattaagcctctagatccagttattcctgaagtcaatgaagttcacccatagaaggtccctgttaaaaaaccaatatcaccatcacctcccccttctcttcctgtctccctctttttccttcttcttcacccctgcctcattctcttcctcctcttccctctcctcctcctcctcttctttcttttctagtatgaggtgggtttgggggacttacaactgcaagaacacaaacctgccagccaggaagccttacctggcagagctctctgagtgactaaagcctggtacttgcaggccccaagaagacctacccaggttgaacagagtcctaagaggttacttctatctagcagcttcccactggtctgcttctgtacctaaatggccaccatccgaaccactgtgggaggcaaattgtatctccagaagaccccatgatggtgtcaagttgttggctggacagttcctgtgagagaagccatgtgcgtgacattgttgatcagttgagtctgcgccgtgtcactgtgcagttcctcctgcactcccagcagtctgggagcagagctcaccaccatggaggctggaggctccttggctccaagcaaatagccaacaagggaaaggaggagaaaacggaacccagagagggttgctatggaaaggctatagacaggagctgtggccttcagtagagggtcacagctagtgctcaaagacccgcagagaaacagcctacatgttccaacctcgctccattcgtgctctctgtcctgctggtgacttccatgaatggaacctaactggaagccaggatgcaaagagtccatgaatgcagcctgcataagttagccctctaggacagtgggcagagaagggtggaaagtgagtctggagagacaagtggaaagcatctagtgctctaccccagggcctttgcacttgctcctcccttcaccagcaaacttttttttaaagcttgcttgcatttatcttttcccccttccccaatttttatttgtttatttttcatacaaatatatggggtacaagtgcaattttgttacatgcatagattgcaaagtggtcaggccaggacttttaaggtacccaaaagcattgtacaattacccattaagtaatttctcatcatccacctcctttaccagaaaactcttctttcccaaaatcctcatgtcttacttcctcaaatatcactttctcagtatgccttctcctatagttttgtttttgtttttttgagacagtctcaccgggtttgcagtggcatgatctcagctcactgcaacctctgcctcctgggttcaagcaattctcctgcctcagcctcccgagtagctgggattacaggtgcccaccaccatgctcagctaatttttgtatttttagtagagacgggatttcaccatgttggccagccttgtctcgaactcctgacctcaggtgatccaccctcctcggcctcccaaagtgctgggattacaggtgtgagtcaccacgcccagactctcatatagtttggatgtttgtctcctccaaatctcacgttgaaatgtaatccccaatgttggaggtgggggctggtgggaggtgattgggtcatggggtcggatcctcataaatggtttagcaccatccccttggtgctaagtgagttctcaccctaagttcatgtgagatccgattatttaaaagtatgtggcacctccccctacccttgttcctgctttctcttgcacccgctttgccttctgggatgattgtaaggttcctgaggcccgcaccggaagcagatgctgcatccatgctggtactgcctccagaaccatgagccaattacacctcttttctttatcaattacccagtctcaggtattccttaccttccttggccatcccacctaaaactgttaccctgactcatagtttctatccttctctctacttaattttatagcacttagagactccaaacatactgtatattttgcgtatttatgttgcagataggctatatccctcaactaaaatgtaagctccaacagagcaggcactttgatctcttgtgatcaatgcttcacgaatagcatctagcacatagcagatgctaaatagatagttgttaaataattgaatttaagcgtggcaggcccccaagtgggaaaatacacgagatttgaagtggcagaggccttgtgtgagagtctggttcctggtaggcagggcaccaagtccaagacagtcagctgaatggatcccctcagctcagatgcttttttaatgcctgctagatgggcgttaatcattttgctcccaggagataggtgatcaggtacactcctgccttaagaagttcatcttggtctggcctagcttagcatcctgccttgtgccagcttcactctatccaagaccaacatctgggctgggtctcactgccaaccacatggccatgatcctcagactttcccaacctcctccaattttaaagtctccaggttcctcccaacaggatggcttctctctacacaccccagatacaccacagtaatcaggggagatcaggctctgcagctgctctcagcaggattgggacaaaaatcctccatgttttggtgggtggggaagggctatgaagatccagcctccgggatgctgcccagagaaagctggggagcaggtggcccagagcttctggactgaccctagatggagggcagtggagatgaaaggagatcttctttttcctttctcttctgcctttaataacatcaaatatgattaatttaggtccatattatagatgagaatttgactaattcttctcaggttagcagtttattattgcacaaatgtttcccaagccaatgaattatgaaataagccttgcaggggaatgtttgagctactgaagggcatgttcggcatgatcagaggaacactctgtttccaagttagtaatgcctctttacatataaacactgatgtttgttgataatgaacattcatgtcctcaatcaaagcagagcctctggggacacttctctatcagccaagtgctcctagaagtgttccgccctggttagaatgtgcgccccaattttcatgtgttggaaacataatcccaaaattcatatgttgattaaaggtagtgagggctttgggaagtaattaagattagataaggtcatcaaggtggtactcccatgatgagactggaggctttataagaagaggaagagagacctgagctgacaccacactcttgccctcttaccatgtaatgtccccctctgtgttttggtgttttggcttgttttgtttgtttgtttgtttgtttttgagattgagcctcactctgtcactcaggctggagtgcaatggtgtgatctcggctcactacaaccaccacctcccaggttcaagtgattctcttgcctcagcctcccaaatagctgggattacaggcatgcaccaccacacccggctaatttttgcatttattcagtagagacggggatttcaccatattggccaggctggtctggaactcctgatctcaagtaatccacctacctcaacctcccaaagtgctgggattacaggtgtgagccaccacgcctgacctagtcagtggtatcctgttatagcaaccgagaacagactgagacatacatgctcccatggtctttgccaaggaggtagcctattcagatccactggggtgtccagccagtgagggccactcagccaacttacgaatccttttccaactcaactgctccatcacttgtagacacccaatagcccttcctcccaatcttgatttttcctccttagcactcaccgctcttgttttgtctaggaaccctccatcttcctttctagaactatgtgctttaggggaagctgaccccagccccagcctcacagagtgggtcttggctgatctgaaccagtcattgttgccctggctgtcttgctggtgatttaattaaacatagatctgtgacatgattctggccaatgatatgggaaaaaatctgctgggacaacttttaggagaagctttcttcactcttcaaagagacacatgagaatgaaactagacccctgtctctcaccatatacataaatcaaaaccaaaatggattaaaggcttcaatctaagaccacaaactatgaaattactaaaaggaagcattgggaaaactctccaggactggacaaaaattcctcttttctttttttctttcttttttttttttttttttttttttgtagaggcacagtctcaactatgctacccaggctggtctcaaacttctgggctcaagctatcctcctgcctaggtctcacaaagtgctggaaatcataggcatgagccaccttgcctggcccggacaaagatgtcttgagtgatatcttacaagtacaggctgaagcaaaaatggacaaatgagatctcatcaagttaaaaggcttctgcacagcaaaggaaacaatcaacaaagtgaagagacaatccacagaatgggagaaaatatttgcaaactacccatctgacatgggattaataactggaatatataaggagctcaaacaactcaacaggaaaaagtctaataatctggcttttaaatttaatctggcaaaagatctgaatagacatttctcaaaagaagaaatacaaatggcaagcaagtatatgaaaaggtgcttaacatcattgatcagagaaatgcaaatcaaaactacaatgagatatcctctcaccagttaagatggcttttgtccaaaagacaggcaatgacaaatgctggagaggatgtggaggaaaggggaccttcgtacactgttgaaaatgtaaatcagtgtaaacactacaaagaacagtttggaggttcctcaataaactaaaaatagagctaccatacgatccagcaatcccactgttacgtatacacccaaagaaaggaaatcagtatgtcaaagagatatttgcactcccatgttgactgcggcattgttcacaaaagttaagatttggaagcaacctaagtgtccaccaacagatgaataggtaaagaaaatatagtgcatatacacaatggagtgctattcagctgtaaaaagaatgagatccggccgggcgcagtggctcacgccagtaatcccagcactttggaaggcgtaggagggcggatcatgaggtcaggagatagagaccatcctggctaacacggtgaaaccccgtctctactaaaaatacagaatattagccgggcatggtggcgggcacctgtagtcccagctactcaggaggctgaggcagaagaatggcgtgaacccgggaggcggagcttgcagtgagccgagaccacaccactgcactccagcctgggcgacagagcgagactccgtctcaaaaaaaaaaaaaaaaaaccaatgagatcctgtcatttgcagcaacacggatggaactggaggtcattatgttgagtcaaataagccaggcacggggagacaaacttcacatgttctcacttatttgagagctgaaaattaaaacagttgaactcatggagataggagaatgatggttactagaggctgggaagggtagtgggagcagggagggagtagggatgattaatgggtacaaaatatagttagaaagaatgaataagatctagtatttgatggcacaacaagatggctacagtcaatgtattagtccgttttcactgttgataaagacatagccgagactgggcaatttacaaaagaaagaggtttaatggacttacagttccgcgtgggtggggaggcctcacaatcatggcagaagatgaaaggcacatctcacatggtggcagacaagagaagacagcttgtgcagggaaattcccctttttaaaaccaccagatctcatgagacttattcactatcacgagaacagcacaggaaacacctgcccccatgattcaattacctcccactgggtccctcccacagcatgtgggaattcaagatgagatttaagtggggacacagccaaaccatattagtcaatgaaaatttattgtacattattaaataactgaaagaatagatgtctgtaacacaaaggaaggataaatgtttgagatgatggatacctcatttaacccgatgtggttattacacattgtatgcctgtatcaaaatatttaatgtgccccataaacatatacacctactatgtacccacaaaaattaaaaattaaaattaggctggacacggtggctcacgcctgtaatcccagcactttgggaggcccaggtggggttatcacttgaggtcaggaggtcaagaccagcctggccaacatagtgaaaccttgtctctactaaaaagacaaaagttaaccaggagtggtggcatgcacctgtaatcccagctacttgggaagctgagacatgagagtcacttgaacccaggaggcagaggttacagtgagccaagatcgtactactgcactccagcctgggtgacagtgagacttcatcttcaaaaaataataataataataggctgggtgctattgctcacgcctgtagtcccagcactttgggaggctgaggcgggcagatcacgaggtcaggagatcaagaccatcctggctaacacagtgaaaccctgtctctactaaaaatacaaaaaaattagccgggcatggtggcaggcatctgtagtcccagctacttgggaggctgaggcaggagaatggcatgaacccaggaggcagagcttgcagtgagccgagatcgcgccactgcactccagcctgggcgacagagtgagactccatctcaaaaataataataataataataataaaataaattaaattaaataattgcaaggtgtggggagtttttctgaaagggggataagtggcaagagatacactctagtctctctggcctttgtcaggtgtggatgatgtgatggccagagctaccgcagccatcttgtgaccacaagggagccagcgtggggggaagctgcattcaaagattagcagtgcaaaaatgcagaaagatcctgcatttttcaggatcctggtaataaacagaggatccactcaaactggattattagaagaattcaataagggggctatttacaaaagtgcaggcagagcatagagaaactaacccaggatagtgtagtaccaatggactagtaacggaggggagccctcaccaccttgggcctgaaggagcaaggggcaggaacccagagagacactataaggagaggagagctgcctagcaggtgtcttcacagacagggtctggaggggaacaaccccaaactcattcttctcctacccgcccatcttatgccagtgccttccattggctgaacccaacaagaagccagtgggcggggagcccatggacaatatgcagaggtcatcctcccagaacacagagactcgcagagtgatctagaggacaaaggattttcagcactacccgggcctgcaattatctttttcatctgtttgcctgcatattggcggtctcctccctgaaggcaggaactgccttactgctgtaagtttcctcctagaacagcggatggctgcacaacttacgctcaaagaatatggttgagcacccactatgcagcaggcactgtactagaaatcaaatgaagccgggtgtggtggctcacgactatgatcccagcaatttgggaggcttaggcaggaggattgcttgagcccaggagtttaagactagcctgggcaacatgatgagaccctggatctacaagaattttttaaaattagccaggcatggtggtgtgtgcctgtggtcccagctatgcaagagactgaaggggaggattgcttgagcccgggaggtcgaggctgcagtgagccatgatggtgccactatacgccagcctgggcaacagagcaagactctccaaaaaaaaaaaatcaaatgaataaaacatagcgtgcctcagttgttcacaagctggagagggagagtaaaaccaaagcaatatggcatcttggtgtcataccaggagagagacatgcccaaggaaggaggctctgaccagagtagggcctggaggaggtgggcctggtaccaagtgttgaaggacttgttttaatggagaggtgaggatgctttgtcattaatgcatcataatattgcagtatgagtaagtatctctaacccaaaagcaatgcatttccttgagggtgtttgttgaatggggaagaagtggttggaaggaaggttgggtgttccaaacagagggaacatcatgtgtgcatgcagaaagacagaaaactagagaaattgtccccactggctggtgggaaaattgtgtgaggaggaagggatgggaaatgaggtgagagaagagtaggaactggctcacatgttgagctgaggagttcaagctttattctgaatgcctgaagaaattgataagggattttgattagagatctgacatgctcagatttgcaacttcagagacttcacttgagtggcagcgtggagtgtgtggattggaaggatgagggagcaggaagccttagagctttgtgtggctacttaaatttaaaattaggccaggcgcagtggctcacacctgtaatcccaacactttggaagaccaagatgggcttgttgcttgagcccaagagttcgagaccagcctgggcaacatggtgaaactccatctctacaaaaaaatacaaaaaattagctggatgtggtggcatgcatctgtattcccagctatttgggaggctgagatgggagaatcacctgagcccatgaggtcaaggttgcagtgagccaaggctgtgccactgtactccagcctgagcaacagagtgagacccttttttaaaaacaaaacgaaaaaactagtattcacctcacagggtggctataaagctaaaacaaggatggttcgtgttaaccatgtagcacagagcttggggcatagtaggtgctcaataaatcttaatgcattattccttgcaatttccataaaaccaatgcaggaaatgcccccaagcagagtcttcctaaagttcttgggcaggtgagcattcttacttgtgaacactaattgattcaataaatgtttttctgaataggtgttcctcagtaactgtggggaattggttccaggacctccccactagccatggataccaaaatctatggatgccaaagtccctgatatacaatggcataaaatttgcatataatctttgcatagtatttgcatataatctatactttaaatcatctccagattacttgtagtatctaatacaacataagtgctatatacagagttgttggccgggcgcagtggctcatgcctgtaatcccagcactttgggacaccaaggcaggaagatcacctgaggtcgggagtttaagaccagcctgagcaacatggagaaaccccatctttactaaaaatacaaaattagccgggcatggtggcgcatgcctgtaatcccagctactagggagactgaggtaggagaattgcttgaacccgggaggcggaggttgcagtgagccaagactgtgccattgcactccagccttggaaacaagagcaagactccatctcaaaaaaaaaaaaaaaaaagatttgttagttatactatattatttagggaataatggcaagaaaagtaagtttgtacatgttcagtaccgatgcaaccatccatcttttttccgaatattttccatctgtggttggttgaatccatggaacctacagatacgagggccaactgtgtggctgcatgccagcccctgcgttggagactagagataggaagaaaggcagaagctgccttgaccttcaaggagctcaaagtccagaggggcaacggtgttacggatgctgctaaggagggcagtatggaggctgtgggaacttaactgcgggggagctgagactcagacagtgtggtgacagctgagcagggtataaaatgatgagccaaagtggccggggaatgcagggtggggagaaggtttcaagcaaagggatcagctttggagaaagacagtaaaggtgggggcaagggtgacatggggggcaacagagccagagagtgaacagaaactgctgctgaagcctttgggtgctaagcaaaagagttggttttatcctgaaatctctggggaatattgaagcacttttaaaagggaagtagtcaacatacctccagagtggctcaaatgaaaaagatcaaaaatatccagtggtggccaggtgtggtggctcatgcctataatcccagcactttgggaggctgaagtaggtggatcatctgaggtcaggagttcaagaccagcctggccaacatggtgaaactctgtccctcctaaagatacaaaaattagctgggcatggtggtgggtgcctgtaatcccagctactcggaaggctgaggcaggagaatcatttgaacttgggaggcggaggctgcagtgagcagagattgtgccactgcactccagactgggtgacagagcgagactccatcagaaagaaagagagagagagagagaaagaaagaaagaaagaaagaaagaaagaaagaaagaaagaaagaaagaaagaaagaaaaaaagaaggaaagaaagaaagaaagagggagggagggaggaagggagggaaggagggaaggaaggaaggaaggaaggaaggaaggaaggaaggaaggaaggaaggaagaaagaaagaaaatatccagtggtggtgaggatgagaagcagctggagcctcatacacaccgggtgggggtataaactggttcaactgcttaggaaagttggagtttttgtttgtttgtttgtttgtttgtttgtgagacagggtctcactctgtcacccaggttggagtgcagtggcactatctcggctcactgcaacctcctccgcctcccgaattcaaacgattcttgtgtgtcaacctctcgagtagctgggactacaggtgcacaccaccacacccagctaatttttgtatttttagtagagacaacgttttgccatgtttgcctggctggtctcaaactcctgagctcaagcgatctgcctgccttggcctcccaaagtgctgggattacaggtgtgaaccattgcacccagccaggaaagttgtttggtagaatatattactgctggacattcacctatcctatgaactagcaattccagcctgagcagcaaacatgcattcaaaagcaggttcgagaatgctcctggatgggcacggtggctcacgccggtaatcccagcactttgggaggccaaggaggacagatcacctgagttgggagtttgagaccagcctgaccaacatggagaaaccccatctctactaaaaatacaaaattagctgggcatggtagcctgtaatctcagctactcaggaggcttaggcaagagaatcgcttgaaccgggaaggcagatgtggtgagccgagatcacgccatcgcactccagcctgggcaacaagagctaaactctgtctcaaaagaaaaaaaaaagatgctcctgacagcagggctcatcttagcccaacagaggaagcaaccgaagtatcaatcaacagttgaatgaatgaataaggtgttgggtattcatattataatggaataccgtgcagcaatgagaatgaactataactatgcccaacatcatgaatgagtctcataaaaaaagaatgttaagtaacagaaaccagaaaccagacacaagattatataccgcccactgaaatgtatacttaaaatggttaaaatggtaaattaaaattttttttaaaatagagatggggtctcactatgttgcccaggctggtcttgaactcctgggcttaagcgatcctcccacctcagcctcccaagtgctagggttacaggtgtgagccaccatgcctggccctatagtgttaaatgttatgttatgtatattatttcaccacaaccaaaaaagtgtaggtgggggaccatagaactgtacaacacaaagtgcatcttaatttaaactatggtcgtcggttaataataatgtatcagaggctgggcgtggtggctcacacctgtaatctcaacactttgggaggccgaggtgggcagatcacctgaggtcaggagtttgagaccaacctggccaacacagtgaaaccccgtctatactaaaaatacaaaaattagccgagcatggtggtgtgtgcctgtaatcctagctactcaggaggctgaggcaccagaatcgcttgaatctgggaggaagaggttgcagtgagctgagattgtaccaccgcacttcagcctgggcaacagaacaaaactttgtctctctttattttattttattattttttttgagacgagtcttgctctatggcgcaggctggagtgcagtggcgcgatcttggctcactgcaacctccacctctggggttcaaaggattctcctgcctcagcctcctgagtagctgggactacaggcatgcgccaccatggtcggctaatttttttgtatttttagtagagatggggttttatcatgttggccaggctggtccagaactcctgacctcaagtgatccgcccacatcagcctcccaaagtgctgagattacagatgtgagcctccacaccaggcctgagactctgtctcaaaacaacaacaacaacaaccagaatgtatcaatattcatccacgaattgtaacaaatatattacaccactgcaagatgttaataataggggaaactgcagagtgggggtggtaaatggccacttttacctccctcatcatactttccactcaatttttctgtgaaccaaagactgctctaaaaaaatctattagctttttaaaattccttggctcccctccaaaaagtgtacatatgacatgatctcatttatgtaaaatacaacaagcaaaacaaatccatgcaatagatgttggggtcatgggtacccttgagaaaggaacacaacgggacttcttggatgcttatgatgtctcttgattagagctggttatatgtgtgtttgttaagtttgcaaaaattcatcaagctacacatgatcgagctatacatgacatatgcacttttccatttatttatttatttttgagacagaatcttgctctgtcacccaggctggagtgcagtggtgcgatcttggctcaccgcaacctccgcctctcggattcaagcaattgtcatgccccagcttcccgagtagctggaattacaggtgtgcaccatcacgcccagctaatttttttttgtatttttagtagagatgaggtttcactatgttggccaggctggtcttgaactcctggcctcactcaagtgatcctcccacctcggcctcccaaagtgctagaattacaggtgtgagtcaccggtcccagctgacatatgcacttttctatattgtatcctgtaatttaatttttttaagttttaagaaaacattaaaaataaaaagataaatagtctgtcatacaggagaatttcaaatagtttatggagataatcccccctcaaggagaaggagcgtaatcccccactccttcggtgtgggctgtgcatagtgacttccttccaaaaggtacagtatggaaaggtgggaaaggagtaactttacagtgaagagacctgacacgcactaccttagccaggtgatcaaggtcaacatccacatctgtaagtcacattgataggatgtaaccctgatatgatgtgacgagaatggcacctaacctccaaggtcttcccaccaacaaaccataaccccaggcttaccatgagaagaaaaacatcaggcacattccaatagtgggcatcctacaaaatgtccaaccagtactcctgaaaattgtcaaggtcatcaaaaacaaggatatcctgagaaactgtcacagccaagaggaatccaaagagacgtgatgactaaatgtcatgtgatatccaatgggtcctggaacaggaaaaggacattaggtaaaacgcaaggaaatctaagtaaaccatgaactttagttaattagagagacagacagacagagagaaagaaagagtccattttctataaaaccgagcctaacctcaaaccttgacctttttcattgagtcatctgaacccaatggagatatagacaggaaacaactttcctcttctcccattcatggccttcaaacatgctctgtttctctattggattccccatccatctgccttggcatcttcacaggttgatcccacagttttctcattttcaggaataaaagcccactccagtctaaatcaaaacttccctctcacatccatgccgggcacagtggctcacacctgtaatcccagcagtttgggaggccaaggcagaaggattgcttgggcccagaagttcaagaccaacctgggcaacatggcaagacctcctctctacaaaaaaatgtttaaaaataaaaaaattagccaggcatggtgcacacacctgtgattgtggtcccagctactcaggaggctgaggcaagaggattgtttgagctcaggaggtcgaggctgcagtgagccatgattgtggcacatgaaccccaacctgggtgacagagcaagactctgtatctaaaaaaaaaaaaaaaagatagcaaacttccttttcacatccaatttaaggcttgtcctcctcctcctcttagatctgactgagatctgggtccatattaaagactcctttagtacaacaaacaccatatatcctcacgtaagtccatgaatatctgacatttctcatatctactttctctcgatttattgatagataggtatacattgttttaattttatgggtacatagtaggtgtatatatgtatggggtacatgaaatgttttgatacaggcatgcaatatgaaataagcattcatggagaatggagtatccatcccctcaagcaaggataaacctttgagttacaaacaatccaattacactctttaaaggtgtacattttttttttttttgagacggagtctcactctgtcgcccaggctggagtggagtggcacgatcttggctcactgcagcctccacctcccaagttcaagccattctcctgcctcagcctcccgagtagctgggatcacaggcacatgccaccatgcctggctaatttttgtatttttagtagagacggagtttcaccaggttggccaggctggtcttgaacacctgatctcaggtgatccgcccatctcggcctctcaaagtgctgggattacaggtgcgagccatcgcgcctggcctagaggtgtacattttttaacagaaccattcaaaaggaggttgtggggatcatgacacttccatgctacagcattaatctcctaagaataaggatacactcccacataccatgacactctgttcacacctaaaaaaatttacatttattccagaatatcatctaatctccagtccgtgcttacatgtccccaattgtccccaaaacatcttttatagatttttttaaaattttgtttaaatgccatatccaatcgatatggcaatcaaatgcaaatccatattgcatttggttatgtctcttagtctttttgcataaggggggcctctctttaggatgcaaaatctttatcatctcttcttttccacttggggacttgggctgaaaatcaggagtggctggaacacgcccatttactgtttggttttgcaggttgttggagggtactacagaagaacatccctctggagaggggccgtgagcctggttggcctagactgagtgccctggcagagctcttcctcatgtgtgcagtgggaaagaagcccagatcagtccaaaggcctaacccccactcccagaccctaccctactcttcagagaaataggctccctaccctgaaccctaaagacagctgtaccttcatccccagggacccagcaccccttctggcctatccccaaagagtcaccctgggtcttaggtagtaggtggagctgagggataatggcccaaggccaagagttgatccttccaactttgttcagtgatccagctttcatatcaggtgatcaggacaaccaggccaatctgatagggggcggtgtttataaaaaggccactcacctagagccagaagctccacaccagccattacaaccctgccaatctcaagcacctgcctctacaggtacctttcttgggaccaatttacaatctctgggatccccaactatagaacctggaagctagtggggacagaaagacggggagcctgggctaggtgtaggggtcctgagttccgggctttgctacccagctcttgacttctgtttcccgattttaaatgagcagtttggactaagccatttttaaggagagcgatggggagggcttcccccttagcacaagggcagccctggccctggctgaagcccaaccccaacctccaagactgtgagaggatggggactcatccctggaggaggtgcccctcctggtattgataaagaatgccctggggagggggcatcacaggctatttgaaccagccctgggaccttggccacctcagtgtcactgggtagggggaactcctggtcccttgggtatatggaaggtatcagcagaaagccagcactggcagggactctttggtacaatacccagcatgcatgctgtgccaggggctgacaagggtgctgtccttggcttccccattttggagtggtcacttgcctctactccagccccagaagtggaaactgagatgatgtgtggaggagagagccagcgttcatgttgggaatcttgaggctcctttccagctctcagattctgtgatgctcaaagggtgagctctgtgggcccaggacgcatggtagatggagcttagtctttctggtatccagctgggagccaagcacagaacacgcatcagtgtttatcaaatgactgaggaaatgaatgaatgaatgtctccatctcaaccctcagcctggtccctccttttttccctgcagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaaggtgagcccggggtgcaggtggcaaggggcaccttgcagggcctgggtgcagcccctccctcccagctccagcatgcccacacagctgctgtgttgccaaggcctaggaaggctctggacacctcagaccagctgtgtgacctggagccgactcttccccttctctgggcctcagtttcctcatccttgaagcccccttctcagggctcctcaaagcccccaagaaaaaagccctggaaatggggccctagcagagtcctgcaatgtggggggcctatgagtgagaaagctttcattctgcagaaacctaaaccccaacagaggctaatccccagctctggtgtcacgttgcttccctgtgttcacactaaccttttccttctttgaaattggacccctggtgttattgggaggaagggtcaatggggcataaaatgacactttaagccatacccagggctgctaccagctcctgctgcaagctgcaaccccctgcctagagaccaagttgggaggataggggggtacccagccaccaggtacaggccaggggagtggagcaacgttcagcctttgaccttggaagtgccagaggtgcccctaagcttgtgccccctcagaacagtgtccgggacatcacgggtgccctgttcaagcacagcaagaaggggcctagagccagcggcaacctcatcccacaggagaagattgtcaaccttgtcaatgacatctttggagcaggtaggaaccagaaccttgcccctccatccaacaatgcctgctgttcacccacagccttgcccagcccctcagtccatgaaataacccaccaaccctacaccagatggtacaacatactgagatctggcttgggatcagggtttgagcctgggctatgccaccaattcccagtggagaaacagcaaagtccttctcctcccctaggcttcagtttccccatctgaacaataaggtgttctctggcctgtaagtctaggcccctataattccagcagctaattctgaaacctgtatctcaagtttatgttgaagagacccagcctctgtcttcaggaaactcacaggctagggccagagaaagctaatgctggatacatacatagcagatacttgggaaatgatggtttccttgtttctgtcttccttctttcctcaccttacactacacggttcaggatttgacacagtcaccacagccatctcctggagcctcatgtaccttgtgaccaagcctgagatacagaggaagatccagaaggagctgggtacatgggggcccccaaccctatagccaggagaagccttgagacccaggttgtttgttcagtctacaaacacctgttatgtgcctgctgtgtgcaagccctgggcacacagtagtgcctgcccttgcctagaagatgtgggaggttagtggggtcgcagacttgtgaatagacagtcttacataagagtgacatggggtataagaggggataattcatggggcagttagggcagcccctgagctctgcttgtcctctgtgttctacagacactgtgattggcagggagcggcggccccggctctctgacagaccccagctgccctacttggaggccttcatcctggagaccttccgacactcctccttcttgcccttcaccatcccccacaggtgaggcctgccggttctgccctcccacctctaaagtgcttgccatgttttctcttcctggcttctcagccctggccctggctcagcatctccttcccgacctcgttccccacagatcccggcctcagtctgcccccatccagtccaaacataatctaacccccagctctcaggagaaagttccacttgtgatctcagcgctcattcccctctgttcatattccctccctcccagtgccctctgtgccagtcaggtcggcctcaccctcacaagcatgaccctattggcctccaatcttgctaacgctgaaccttctgcctggaataccttctagcctcttctctgaccaccagaatcctacccttgctcaaagtcaatgccgacacgagcttcctctccccagaagccttttgactcatccagctggcacagcttcattcctgatgtcttataggacttacagccatcagcccttgatcatgccctggaattttaacaatgtcaagagagttagtgagcatttacttctacccaaacgttgttctagttattcctgcagtaagaggcctgaatccccagccaggctagaaattccccggggctgccccaggctgcctgctgcttttttttttttttttttttttttcatagaaaatagaaaaacatttatctgaaattgcctgcttcttggctccagagaacagccaagtgcgcagccaggcgcaaagagaagtttagtaaatacttgctgaagttaaagaacaggacgcaaggaagagggaggatgtttctacctcttccctgttcctcccctcccctcccagtgtagggatggagatggcggtgggcaggctgtctggatggggtggaggtaggagcaacacatgccccagctttccagccctgagcctcacagtgccctcttccctcctcagcacaacaagggacacaacgctgaatggcttctacatccccaagaaatgctgtgtcttcgtaaaccagtggcaggtcaaccatgacccgtgagtacatacccctcacgaaaaaatgtgtgcaggttcagcagtcaggaaggctgtttgtccctgctaggaactgtttatataatgaaaggaggggacctcaattgctatagtctgctctaagtgacgatatttacaaaagtttcacaaactttagtgcacaggaatcaactaggatggccaggcgcagtggctcaagcctataatcccagcagtttgggaggccgaggcaggcagatcacttgaggtcaggagtttgagaccagcctgggcaacatggtgaaaccctatctctactaaaaatacaaaacaaaaattagccggacatggtggtgcgcctataatcccagctactccagaggctgaggcaggagaattgcttgaactctggaggtagaggctgcagtgagccgagatcgctccactgcactccagcctgggtgacggagtgagactctgcctcaaaaaaaaaaaaaaaaaatcaaccaagacgtttgttacaggtgatggttcccccaggattctactgtggtatctaaggtggggtacctcaggcgattctgatgtgaatggctcagagacctctctttggaaagccccactttagtgtataggtagggggaccatatatataatttaccatccacactgggacatttgagtgtgaaaatgctatcaatgtttatgctagtcatcattactccaaaacaataaacataagccaggacatactgttgaggccccttaggaggcatattttgagtaggatgaagaaacgtatgtctttctttcttcctttcactttaatttttaaatagagacaaggtcttcctatgtggtccaggctggttttgaactcctgggttcaagggatcttcctgcctcagcctcccaaagtgctagggttacgggtgtaagccaccaaacccagcctgtttttcttcttttaatttcttttagataaagcattatttaaagtaaattaatattaaaaggcactatctttaaggctggtcattttagagagagctttgtaaaagaaataagcatcaggccaggtgtggtgactcatgcctgtaaccccagcactttgggagtccgaggaaggtggatcgcttgagctcatgagtctgagaccagtgaaaccccgtctctgcaaaaaaaaaaaaaaaaaaaaatacaaaaattagccggatatggtgcctgtagtcccagctacacgggaggctcaggtgggtggttggcttgagctggggaggcagagagagtgcagtgagctgagatcgcaccactgtactccagcctgggtgataggagccggagggtgtctcaaaaaaaaaaaaagaaagaaaagaaaaagaaataagcatcaaagttcagtttggttccttcccacctacccttcattgctttcaaagtgccctcacacttgtgttctcaacagaagtctccctcccccaggcacctcctcccagggcctctccagccctgaggtcccatctcctctgttcctcttgcagagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaactgaagaagacaccaccattctgaggccagggagcgagtgggggccagccacggggactcagcccttgtttctcttcctttctttttttaaaaaatagcagctttagccaagtgcagggcctgtaatcccagcattttaggaggccaaggttggaggatcatttgagcccaggaattggaaagcagcctggccaacatagtgggaccctgtctctacaaaaaaaaaatttgccaagagcctgagtgacagagcaagaccccatctcaaaaaaaaaaacaaacaaacaaaaaaaaaaccatatatatacatatatatatagcagctttatggagatataattcttatgccatataattcaccttctttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgttttttttttttttgagacagagtcttcctctgtctcctaagctggagtgcagtggcatcatctcagctcactgcaacctctgcctcccaggttcaagtgcttctccagcctcagcctcccaagtagctgagactacaggcacacaccaccacgcctggctaatttttgtatttttagtagagacgggtttcaccatgttggctagactagtctcaaactcctgacctcaagtgatctgcccgcctcgacctctctcaaagtgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaatggaattacacaatgagtggtcttttgtgactggcttctttcacttagcacaatgttttcaaggcttatgtgtgttgtggtgtgcgtcagtaagctcttggtgcttgagtcctgagactgggtctaggtctgtgctctcttaagtcgttgataggcacctccttcactcctctcctctcctttcatgttgtttgacccaagttttttaacaattgaagggaacaaggagaaagggatccagtctcaggggccaaacccagttgggtggatggggatccctcctgtcccattctcaaaaggcagaacacgtgacttctcacaaggccttgatttcttcattcacagcccgggaggggataagcttcccagaagtgcttaggttatttgaaaaaggcccaggtctcatcaaaggacactatcaagaaattgaaaggaggccaagcacagaggctcacgcctgtaatcccagcactttggaacgccaaggcaggcggatcacttgaggtcaggagtttgagaccagcctggacaacatagtgaaacctcatctctactaaatatacaaaaactagctgaatgtagtggctagcctcagctgctcaggagactgtaatctcagctgatcaggaggctgtaatcccagctactcaggaggctgaggcatgagaatcacttgaactcaggaggcaggggttgcagtgagctgagaccctgctgttgcactccagcctgggctacagagtgagactctgtctcaaaaaaaaaaaaaaaattgaaaagacaacccacagaatgagagaaaatatttgcaaaacatatagctgttgaagcatttatatatagaatatataaagaactcctggccgggcacgatgcctcacccctgtaattccagcacttcgggaggccaaggcaggtggatcatctgaggtcaggagtttgagaccagcctggccaacatggtgaaatcctgtctctactaaaaatacaaaaattagccaggcatggtggcgggcgactgtaatcccagctactcaggaggctgaggctggaaaatcgcttgaacccagggacagagtttgcagtctcactctgtcgcccaggctggagtgcagtggcaccatcttggcttactgcagcctcaacctcccaggctcaatcgatcctcccaccttgggacaacatatgcaggccaccatgcctggctgatttttctaatttttgtagagatggggttttaccatgttgcccaaactggtctcgaactcctgatctcaagtgatccacctgcttcagcctcccaaagtgctggaattacaggcatgagccactgcgccaagccaaaaaaatttttaagagtaaaacctggccaggcacagtggctcacgcctgtaatcctggccctttgggaggccaaggcgggtggatcacttgaggtcaggagttcgagaccagcctggccaacatggtgaaacctcgtctctactaaaaatacaaaaattattcgggagtggtggcacacacctgtaatcccagctacttgggaggctgaggcaggagaatcaaatgaacccaggagatggaggttgcagtgagctgagattgcgccactccactccagcctgggcaacagagggagactctgtctcaaaaaaaaaaaaaggtcgggggcggtggctcacacctgtaatcccagcactttgagagaccgaggtgggtggatcacaaggtcaggagttcaagaccagcttggccaatatggtgaaaccccatctctactaaaaatacaaaaaattagccaggcgtggtggcaggcacctgtaatcccagctactcgggaagctgaggcagagaattgcttgaacctgggaggcggaggttgcagtgagccgagatcacgccactgcactctagcctggcaacagagtgagactccagcttagaaaaaaaaacccatctctactaaaaccacaaaaattagccaggcatggtggcaggtgcctgtattcccagctattctggaggctgaggcaggagaatcgcttgaacaccggaggcagagtttgcagtgagccgagatcacgccattgcactccagcctgggcgacaagagcgaaactttgtcccaaaacaaaaagcaaaacaaaacaaaaaaaacctcccggcaagccgcaagcaggcattgccatactttgccaatctaagaatcagcagggcccagctccctgaggtaatttcaggaccgatctgaggtggctcgatggtcaccatacagccactgccccatctggctcactgtggtctggagatggcttgagcttctcatgcacacctggccaatctttaactggttggcctagagctcccctctggccagagccaaggtaggaggaattggagacttcgccccgctgcttgccattcctgcctcccacagcaggtacgaggcaggtgggaccagcctgttctatcttttcctggtaggccctggacacgcatcatctcaggctattctcacaacaaccacaggagatgggtactgttataccaactttagagatgagaagcctgaggctcaggaagcatgaggagggcatgtgtggtggagagattcaggactgcaccatttgccctataccacctccagggtctcttccctacctgtgtctctccctgagtcaggattgtgggactggaacaggaagcttggaaacactacatgatcaaggaacggcatggagagttagaaagagctcttggccagagggctaggagtcctgcactcaggttccaagtgtgggtgaccttgggccagtcccacccctcacaggcctcgaccccatcttcagccttctgtgaggtcttctccagcaccattagcctgaagttcaggccactagcaatgacccctgctctgccagcctcttgcttaataaggctgtgggcaaatccagtgagtgcctggcaaatttcgaagtgcagtgtacccggtgaggggtgatttttggcaaagatggtggaatgaaagatggtagaatggtgggaaaaaccttgagctgggaatcccacctctgcctggtagggaaaattaagagacttctctagacctccccacctgttcagttcagatccccaactccctttatgtcaagcatctaccaccaaccagataccagatctttcgtttatatcttagtacaggtctttcttgtttgtttgttttttgttgttttaaagagatgagggtctccctctgtccctcaggctggagtacactggcgaatcatagctcactgcggcctcaaactcctggggttcaagcaatatcctcctgcctcagtctctcagtctcctgccaccgtgccgagctagttcagcttcttttttttttttttgagatggagtcttgctctgtggcccaggctggagtgcagtggcgcaatcttggctcactgcaagctccacctcctgggttcatgccattctcctgcctcagcctcctcagtagctgggattacaggcgcccaccaccatgcccgcctaatttttttgtattttttagtagagacggggtttcaccggggacggtctcgatctcctgacctcgtgatccgcccgcctcccaaagtgctgggattacaggcgtgagccaccgcgcccagcctagtttcagcttcttgagagaggggtttgattggctcagctcatctttttcagccaggctacacaggtcagagaccacagtcagtcagtggttgggtccccttggagcaatgtttaccctggtaaatagccacaggcaacagagtgagggtcacagggtctaagctacctcagcaagggatccctgcacacaagtcctggaagaaacaatggcacagcggaaagctagcggaacacacaaaagcctccatttgtcacttttctgctctgcccacctctcctcacacccacactacaaagaaaattatctttgctctcatcttttcccgtgactcccaggttgagacctcctaacaacaaattagaaatagctttaacacacaccccattgcaaaccagcttacactgctctaactaaggttggaacactgggtcaggtggtcttgcctggctcttttttccctaagggtgacctccctcccaggattccactcagtccctatgcaaatgaactcagtcactggggtctccctcacccagatctgcccagataaatctcagcctctctctctcttttttttttttaggtggagtcttgctctgtcgcccaggctggagtgcagtggtgcgatctcggctcactgaaacctccgcctcctggattcaagaaattctcctgcctcagcctcccaagtagctgggacgacaggcatgtgccaccatgcccagccaatttttttttttttgagatggagtcgcgctctgtcgcccaggctggagtgcagtggtgcgatctcagctcactgcaagctctgcctcctgggttcacaccattctcctgcgtcagcctcctgagtagctgggactacaggcgcccgccaccacacctggctaattttttgtatttttagtagagacgggatttcaccgtgttagccaggatggtctcgatctcctgacctcgtgatccgcctgcctcggcctcccaaagtgctgggattacaggcgtgagccaccgtgcccggccaatttttgtatttttattagagtatgggattttaccatgttgtccaggctggtctcgaactcctgatctcaggtgatccacccacctcggtctccccaagtgctgcaattataggcatgagccaccatgcccagccaaatctcagtcttaaagtaacttgccccccaaggaaggattttccagttgacaaaggaatctgaggagggtgcagactctctgaaagaatggtagtgagtataccatctgggtgggggaaccaagcagaggctgactagaccagggtttatgcagttcagcgtcagtccatgagcttgccctatatcttatccctatcactggctcctgtccctgagaggggactgccaccagaggtagccataccctgagccaagctccccattctttagtgatccccctcaaaattagttctgagaccctgcattctgtccacccctctgccatgacataacaccaggttcactagagtcctctggagtacagctgcgatggagcctctcaggcagtgcaatggggcggaggggggcacttttgggcaaggagcctgcccgatgcccatcaccctgcactaataagggaagcagactctgctctgcattgagggacctgcactctccctgtgggccctgcagcccagcgggtttttctgggtttaagataacatagtggcataggtgatactcaataggttcccccaggccttcacctctgtatttacccctccaccccaggccagtattaagataattacagggcttgggaaagggaaaagagatgagaccagaggctggctcacagatccagaagaaaatcccagctcacccactaaccttgggcctgtgacataaactttctgagtctagactttctcatctcgcaactggggatgataatcttatcttacaggttgggtgggaggtttaatgagataatgtgtgtaaagtgccaaattacaggtcagggtacaacacacacacacacacacacacacacacacacacacacacacacaccagaaatcctgagaaaggtggactcagggcaagatggacccccgacacacgtgtggcatgtgcagctgtgcacacaccaggcccacacgtgagccagcatttccccaaaccctgcgctctctcactggggtcttgccagggcctgggctcagcccacttccttccactgctccccccacccagaagctggggagggctgggggtggtagcgtgccagggaacaatgggcccccaaccccttcccgcccattgcgtgagaaggagctgccggaaggaaactcacctcccagtgggacaggccgccgcccccctgacgtctgccccagggaagtctggagacccccatgctgctcaaggggcgggcctctgtgcactccaggcctgccacccttgggacatcctgttttcaccacctggactggcttcccccgccccctctttcagagaagatggtcccagaccctctctctggggctgggctgggttccccacaagagtctagggccctgttctcattcatctctgtgtcccccgtgtgtagcctgttccggagtcgtctcgaggaatgctggccaactgcatgagaggctgagggaaaggagccagactaggggtgatcagggacccagcagctgagccagaaaacatgagagagagaagggcccagctcagagtggccaaaacgcctgtgctgcagataggggtgtggtcccagaaatgcctctggagagcacagggcatgctgttgagggctgggggatgctctccccccaaatttttggaacactcagctcagtttcatttgtgtagtgacacttcccttacaggcccgcattcctctctctctctcatacacaatcacactcattccaggggtctcagcagctccaccatcagatgggggctcttaaaggcaggggtcagggaggaggccaggagcagatgaggagctgttcttgcaccgtgcctatccacacttagcaggatagctcagagggtccccaccaggctggctgctgaccagaaactctggacatcaatttccccagctagaaaatatgaagagttggggggcctggctgaaactgaccctgccctgggccttgctgacctggggtggcccagctgaaagtgccagtgggccggcaggggctgggagcaggcgtgggcacgcattttgaaccctagtctcgggtgtgtcgataaggcaacaacagacgtgagtgccagctctcagcgggtgcatgcgcatgggcagatgtggcctggagtggtcaggtggatgcctgtgcgtgagttctccaggtgtcagttcaggtggctcagcacgccagccaggtatgtgcgtgtttgtagccaggcatgtgtttacaggtgtgcctctatctcctgtgccctcagggccaagggagccgctggctcgcgtgtctgagagtccttcttgccgtgagaatcatggaatctcaaagtccccagattagtgcttcctccaaggtgggggctggagtggggtggctggctgggtaatcaggcaggtttgggaagcatgcttctgctcctgctggcgggccatggttacatctgagggctgggagacctggactggtaactctacctccttggacagcagtagtggggggcgggaagctgaggccctgcccagagttttgggggtccacagtgataaaacaagtagctgagcacagttgggcaaatttcagcaaccatcgcacaccagacaggctgcgctctgggtcagtgcctccaccacaaactcggctcactgcaagctctgcctcccaggttcacgccattctcctgcctcagcctcccgagtagctgggactacaggcgcccgccaccacgcccggctaatatttttgtatttttagtagagatggggtttcaccgcgttagccaggatggtctcgatctcctgacctcgtgttctgcccgccttggcctcccaaagtgctgggattacaggcgtgagccaccgcacctggcaattttttgtattttttagtagagacggggtttcaccgtgtttgccaggatggtcttgatctcctgacctggtgatccgcccgccttggcctcccaaagtgctgggattacaggtgtgagccaccacacctggcaaggaattgatttttttaaagtagtatgagagtggagaaagcctttctaagtttgacacaggtccagaagcggcaaaagaaaagactgattccactgcataaaaatcaatcatttctgcattccaaagaatcataaccaagttggaagacacacaaggaacataagccggttggcttccagttctccccttcagtccccctccatcccgtgctctgtgaggggaagctgacctgtggggcttctatccacagactccctggccctctggctcctagacgggttcatagaatggaggctctcacaggagatggggatgtgtcctctgaggcaatcctctccatgcagctctttcccccagtagcattcttcaggcactaccctctcagggcccccaccgttccctgcctaaccccgtgtaataatctctgtattaatccttcctcgaattaaactgtttcctgctggggaccctgaatgatgcacagattaaaggttaatttctttaatatatagagttcctattaaaaaaaaaaaatccaggccgggcgcagtggctcatgcctgtaatcccagcactttgggaggccaaggcgggcggatcacgaggtcaggagttcgagaccagcctggccaatatggtgaaacccccgtctctactaaacatacaaaagttagccgggcgtggtggcacgtgcctgtaatcccaactactcagggggttgaggcaggagaattgcttgaaccagggaggcggaggttgcagtgagctgagatcgcgccactgcactccaggctgggtgacagagcaagactccatgtcaaaaaacaaaaagcaaaaaaaaaaaaaaaaacaacaatccagtaaaaaatagatgaaaaacatgaactgttaacagacacaaatatattttaaaatataaagagatgcttggctgcacctacaatcggcaaactacaattttttttgagacgaagtctcattctgtcgcccaggctggagagcagtggcacaatctcggcccactgtagcctccacctgccaggttcaagcgatcctcccacctcagcctcccaagtagctgggattacaagtatgcatcaccatgcctggctaatatttgtatttttagtagagacagggtttcatcatgttggccaggctggtctccaactcctgacctcaagtgatccacccatcttggcctcccaaagtgctgggattacaggtgtgagccaccatgcctggcatcagtgaactataacttaaaactacaaatataattttttaccaattacattgggaaagatgtatggtgttagcaagggtgctgaaaagttggcattcatatttatcattggtggaagtgaattttagttgaaaagtaaagctttaaacattatgctaagtgaaataagccagttacaaaaacacaaataccgtatggttccacttttgtgaaatacctagaatagtcaaaaccctacagatagacagaacagtggttgcctggggctggggagaagggggaatggggagttagtgtttaatgggtagggtttcaggtttacaagatggaaagggctctggagatggacagtggtgatggctgcacaacattatgagtgcatttaataccactaaactgtgtacttaaaaatggttaagatggaggctgggcacgttggctcacttctgtaattccagcactttgggagtctgaggtgggtggatcacttcaggtcaggagttcaggaccagcctggccaacatggtgaaaaccccatctctactaaaaatataaaaattagccgggcatggtggcgggtgcctgtaaccccagctactcgggaggctgaggtgggaggattgcttgagcctgggaggtagaggttgcagtgagttgagatggctccactgcactccagcctgggcaacagaacgagagcccattaaaaaaaaaaaaaaaaggttggctgggcacagtggctcacacctgtaatctcagcactttggggggctgaggcaggaggatcatctgaggtcaagagttcaagaccagcctggccaacatggtgaaactctgtctctattaaaactacaaaaattagctgggcattgggaggcagaggttgcagtaagcccagatcatgccactgcgctccagcctgggcaacagagcgagactccatctcaaaaaaaaaaaaaatagccaggtatgccgggcgcggtggctcacgcctgtaatcccagcactttgggaggctgaggcgggtggatcacctgaggtcaggagttcgagaccagcctcaacatggagaaaccccgtctctactaaaagcacaaaattagccagacatagtggtgaatgcctgtaatctcagctactcgggaggctgaggcaggagaattgtttgaacccaggaggcggaggctgcagtgagccaagattgtgccattgcactccagcccaggcgaaggagcgagactccatctgaaaaaagaaaagaaaagaaaagaggagggtgggcgcggtgggtcacgcctgtaatcccagcactttgggaggctgaggcgggcggatcacaaggtcaggagttcgagaccagcctggccaatatggtgaaactctgtctctactaaaaatacaaaaattatccgggagtggtggcggatgcctgtagtcccagctactcgggaagctgagacaggagaatcgcttgaacccgggaggcggaggttatagtgagccaagatcgagatcggaccactgcactccagcctgggagatagagcgatactttgcttcaaaaaataaaaaatcaaaaaaaaaaaaaagaggaaaaagagttctaggcagagggaccaacctgtgcaaaggtcctgaggcaggaaaggggttactgtgtgcttgaaggcaaattatcacccctcttaggaaaggcatagcctcacctgtgaaataacccaaatttagagatggagagacagaggttcagagagggaagatggcttcttcaggaaagcagaagagccagaactgaaacctagatctttttggctctatgaactcagaggtatttcaggtatgcatttggggaccttttgcaagattgtaaagaccaggacgggaaggaaagggccaccctccgggggcttttcttttcctgggaagaaggtcttctttccaggaaggtggtgtacgggcaaggctgaaaacccagccttcattctgccaggccagtcccctcctagtccctgctgccccagggctgcagaatcctatcctggctcctgccaggctcccctgcagctgggcaaacaggcagtgggtgggactcggtataatttcctccttgcccgcctggggtctgctaggctctggctgagctctctggcctctgccctgcacccccaacttggagcccaaagggggtcatgggtctttctgccctgtgtccccagggatgcacccgatgagtttgagaaggggctgccttctcacccagagagaggtgaggccatcccctcacccagagaggggctccaggccccactccaagggagagtcagaacttcccggtgcctacaggcgcactgtgctaaaccagtgtgagcatcctgcgctgataatgctacatgcataagctgcggatgcacaggggctcagactcaggggactgtggggagtcctggcagccacatatacatcgggctcacccctgtagcaccccatctagaaaagcccatccagagccagaaggggcttctggggatggttcctggaagggctgggttctgctgttctctgagtgaccaatccacccattctttccagaaatggtcctatcccatctccttcccctccagccgctctcggttccctgccctcatccacccaggatgtcactgggcctgctgcgagtggctgcccggggaaaaggccaggagctctgcaatgagcctgtaatcccagcactttgggaggctgaagtgggtagatacgcactacacacaagccagcaccaggttcctcccacccaggggatgacagaggagctccagctcaccaccgtgcctcaagtcccctgcttaactgtcctatgtgagctcagggccgccctctgggggcttttcttttatttatttatttatttatttatttatttatttatttatactttaagttttagggtacatgtgcacaatgtgcggggctcccttcctcccagcagccatgctgtcacgtgctccttgccccggagaggcaggaatctgtcccgaaatgtcgagctgaaacgcttcctggacgcttgctacaaccgtggtcttcaaattctactaaatttttccagtggcaggattcactgttgaaaggaaagcttcccaccttgcctgttcctcctaaccccaaaaaagtcgggcttgtgatctatggggagaagaatagcccccgccccacacccatctgatgcccaattcttcccaatccatcagcccccagccctgtcctcatgtcaggatctgcccgcgtcactctccccagccaagaactggagccgaaaatgcagtgtaggctgccccctcgtgggcagttagagaaacacatgtttctcatagctgctagcctttacccactgtcttggggaccccaccccaaataaaaaggcaacctaaggaataagcgactttgttttgcaaatacaacttcaagacaagtctcaagtcagtcctatgcagaaattctagagaagccactaagagtggccagaggacagccccccacttcctctcattccccagcctggtcctcatagacccacctggagtagaaattcctcgtgcaggccaggcgtgctggctcacacctataatcccagcactttgggaggctgaggcgagctgatcacatgaggtcaggagttcgaggccagcctggccaacagggtaaaaccccgtctctactaaaactacaaaaaaaaaaaaaaaaaatagccaggtatggtggcaggcacctttaatcccagctactcagtaggctgaggcaggagaatcgcttgaacccaggaggcagaggttgcagtgagccaagatcacgccactacactccaggcagggtgacagagcaagactccatctcaaaaaaacaaaacaaaacaaaaaaaacaccaattcctcatctaactccctgccaggagttcaacttctgttctcatacttttaagaacagagagctcactaccctcaaggctgattcattatattttctgtgctggggcactgggaacactgatggtgcagatccatttgtaacctcctgggactctcacattgctcacttagctggagcaacaggtgagaaaacgagggttgcaggtgtgccaaaggcacagggatgagagcggccagttcttcacggacctacacctccacctgcctcttctcagggatcttatattcaaagggattaaattccaggatcttggagatggctgcagtccagctgcccccttgcttctgctttcacttgagaatcagccgaagttccccgagcacctgctccatgccaggtccctcctggcactttgtcccacttagtccttaaagctcgctgtgatagcgatgtgctaatgcccactgggcagatggggacagaggcgcaggaggtcacttgcccaggatgacacctctagtcatttgcggagttggatctggcctcaagcttgctggtggctcttggagcccatgcagaagtgactggggcaacacatgacactccaacttggcattcccctcaaagggcctggaccaagccaaaagctgcggagaaggctcagggcagactgtgaagtcaggagtttgaccccagcctgctatgtcatgctcctccttcctggccctgcctccacctgtgccctatctctgcctcccacctcaaggtccaggactgttgcaaccagaccctcctaccccaaccatgtccagcaggagatggtccctgcaccagaagcttctgaaggtctacatggagggctggcaggcagaaggcaaacatctcccccaacttgcagcccttcactgccgagcaaacctaggacctggggcctggggtctctgcagctgccatctggtgacctcctcatggggcaggaaaaagagttcaggctctggggtggttctgtaaatcaccctctgtgggtctcccttgccctacagttaagatctagatgctactgttttccttgaaggaagatgatcaaatgagagcaaatgtgcaaacacccagcacacagtaggtgttcaacaaagtgtgccttcctacctgtcctcactttgctcttattactcaggaaaatctgaggatgtcagcaacactgaggccaatccaggatccccaggggccagcgtggtggtggccttcaaatcagggagcagcccacggtagggggccctgtggggtcccagcagccatatgctgatctggctcacccaccccccagcacctcctctagaaaagttattccacagccaaatggggccccttccagctccctgccctcatccacccaggacctgccctgtgatgctcgcaatcgggaacagtcagctctggctccagccctaggtaagcctgggacatggtcctcccaggagccaaacggctcatctttcccagagcagacatgcgcctgctctccaggcgtgcctctgagcctgcccgacagggcagtgtgaccttgcctgcctctctgtcgctctctcattccttccccttgagctctgtgttgtggccaccaggaggcgctgttccccctcagacccgagtagaccaacagcccagcgccaccagagaccagactggattctagattttctctttttttttgagatggagtctcgctctgtcgcccaggctggagtgcagtggcataatctccgctcactgcaacctccacctcctgggttcaagcgattttcctgcctcagtctctgagtagctgggactacaggcgtgcactatcacgcctggctaattttttgtatttttagtagagacagggtttcaccacgttggccaggctggtcttaaactcctgagctcaagtgatccgcccacctcggcctcccaaagtgctgggattacaggcgtgagccaccaagccaggcctgaattctagattctgaaagaggcaggaggcgagtaatcacccagagtgcaagggaagacaatggcctttgtctaattgctgtgaatctggcacttcaaacgcaagacctgacctcatcttcccacccgccatgatgggggtggggtcagggggcaccagtcaggcttctaagtcacaaacaacagagactgacctccagctaacattagcagaaaataaatgccccgctcacaaagacagagaaccaagctgggaatagggcagtcacccagggaaagtaagggctccagtgcggctggaacagggcactgccagcaaacatcatctccctgggccccagtcacacatcctggccctagccggcctgactcatcccaagctttggtcctgtctccccaacatctatcctcactcattcagcaaagcggggggtggaggtgggtgtcagcacccgcgccaggccccacgcaaggggctggctcccagcagcccacctggtgggcctcctcagtgagctgccaaacacactgctggctggtcacttggtggagacaggcattgagagctggctacaccaccagctgcagaggacttggagtcgctgagggctgcaggctgcaggaggcaacctggctgcggggtgagggtgggaatctttaggggataagaactggccccaggctgggcgcggtggctcactcctgtaatcccaacactttgggaggccaacacagacagatcatgaggtcaagagatcgagacgatcccggccaacatggtgaaaccccgtctctactaaaaatacaaaaattagctgggcgtggtggcatgcacctgtagtcccagctactcgggaggatgaggtaggaggattgcttgagcccaggaggcagaggttgcagtgagctgatatcgcaccactgtactccagcctgggtgacagagcaagaccctgtctcagaaaaaaaaaaaaaggatcggccctgggttcggtggctcacaccgtaatcccagcactttgggagggcgaggcaggtggatcacttgaggtcaggatttctcaagaccagcccggccaacatggtgaaaccccatctctactgaaaatacaaaaattagccaggcatagtggcacacgcctgtagtcccagctactcaggaggctaaggcaggagaatcacttgaacctgggagatggagcttgcagggagccaagatcgctctactacactccagcctgggcgacaaagtgagactctgtctcaaaataaaagaaaaaaaagaaaagaaggaactgaccctggctggagggagaggtgactgggacctcccggggctacctcaatgtcaggagagcactcctggagacccaaagcttccagttagggattcaagaagatagactggggcgcgggcaatagggatgcaggcaaggagcttctccttggaacgggagccctgagacccccgggggaaaatctggtcactcacgtattcattcagcacacatttatggctacaggctctgtgccttcccatggagagacagaagaaagggagccagtccctgtcctcacggagctcacctcacccaaacacacactctctagaaggaaattctgggggtcttacgggccaaaaggaaggggcatttccctccaggtcctctggagtcccctgacaaagggccctccaggcctcatccctgactcactggggcttccaaagtctcctccggctcagggagtatctatccctggccccagcccccagcccagttccaccccacccccaatcaggcaaggaggtctttcaaaagctcctctgatctctgacagggacaatgttggcacacaggtttcttcacaggtgtaacacctgggcgggggcatttgcatgggttttgcaaaagctgggcctgaggctcaccagtgcccagttgctctctcttcccagccctcgcagagcagacctcctgctccttctcacctgccccaccttgggccaggtctctaacctttgcactgcagagaaccccagggcctcttttcctgctttcgcccaaagagttcccaggaggaaagccagaacagtgccaactgcggcttccagtcagcaaggcagagcctggggactattgggttcagcacaaaagtgacccctgacagcattgagggagatatgtcagcctgctgtgagcccaggactccaggtgggaaccaggtagctctggctctgcccaattccagctgctccagtgcctggaaggtagtaaacacgccctcaatatttagtgaatggatgaatgagggttttcaattcatcagccattgcgaaactgtaggcctaggaacagacaaaaggcctggccctacccttggaaagcccgactgaacccagcaggggagagccagaactacaaagcctgtttcaggagtgagagaaaaaatattcatctaactgccgtggtgtgaaagtctgccttgtgtcaaagaaccctgctaagcaagcaactttacatcatctcggtttagcataagtcccctgtgacatgggtcctctcagtcccactttagagatgaggaaactgaggctcagaaaggttcagtgacttttgcttaaggtcacaaggctgggatggggtgcagccaggactccaacctggaagactttgtaataaattgagcaagaatgatgtggtggcatcccgggtcccttttcccccagctgggatctggtgactgtgtcctccttaaatccctctttagttttcttatctgcaaatagaagtaataataatatctacattgtaaagagattgggaggatcaaatgaaacttaagacatgtagaatagccaggcaggcccctgtagtcccagctactctgagaggctgaggcagaaggattgcttgagcctagaagctccaaaaccatcctaggcacatagggagaccctttctcaaaaaaaaagtaaacagcagggtgcggtggctcacacctgtaatcccagcactttgggaggccaaggcaggtggatcacttgagctcaggagctccagaccagcctggccaagatggcgaaaccctgtctctactaaaaatacaaaaattagctgggtgtgatggcacgcatgtgcctgtggtcccagctacttgctgggaggctgaggtgggagaatcacttgaacccagggtggggggaggggggtggcagtggaggttgcaggagatgagatcgcaccactgcactacagcctgggcaacagagcaagactctgtctcaaaaacaaacaaacaaaaagacacgtaaaatgcttagaatgatgctagcacatgcaacacctacattagcattgcctattattattattattaattgaaattcatatcacttattcattcaacaaacgtttgagtaccaggattcagcctccagcagccgatcaggacacaaatacgaagtgggtagtcagtgctataatactaagaagtgggccagtgagggacaatagcagaggggaggcttccagccttgggatgtgggaagaggtcatcaaagcttcccgaggacagccagtcaattctccaaccagaagcagaagtaatatttttaacatgcaaatctgatcagctgaggctgtggtgaaccctcaaatagcatgggggcggggccccgatgccctaaggatgaagtccaaagactcccctattccacaggggatcctacaggctctggccatttgcgcctctgcttccaaggctctgaccccatcccatcctggcctgttttccttttgcccaaagctcaatcccttccagttccagggcctctgctcctgttgccccctctgccaggcccccaggcaccacctctcctcctgcagggtctgagtgctcaggtgaggagaggtctctgctccgcactcacactgcacttgcacaatcctctgggaacttgcctcgccttgttgaacacctctgcccccacaagacagaacattccaagaagatagggacccaggaggagggaatcgtgtgcgtgggggaggcgctgggacagcctgcagggatcccaggcaccttggcgaactcttgtcatagacttggctctggatctgccctctctagggagatatcaaaccaggaagcccaggacccaaaacctttgcgatcaggggtctgccagttaacccctgagtgctggctgcctcaggccccgagggtggggtcctccagttcccagtggcctctcagttgggtcaccaccacaccactcaagccaccaagccaacaaatcaagacttctaccatcatcgcgacgggaaacaaaaactaacttctcaggaaatcctcttggagcaaactggtgcagtggagagagctgaccttggtctgacatgaaaagcggttgtgcatagtaagtgctcaataaatattagctgctattatcaatgataataataaagtacctggcacatagtaggtgttcagtaaatgatagttctctggtcccagggggacagaaattagaggcagtcagcagcccctccccaccttactcccaaggtcctccacttgtacacagggattcagacctatggatcaccaaatccaaacccttcagttgctaggtagggaaacaggcctagaggagaaggactggcccaaagtaagaagcagtgtcggccggacgcggtggctcacacctgtaatcccaatactttgggaggccaaggcgggcggatcacaagttcaggagttcaagaccagcctggccaatatggtaaaaccccatctctactaaaaatacaaaaattagccgggtgtggtggtggcgcctgtaatcccagctactcgggaggctgaggcaggagaattgcttggacctgggaggcagaggttgcagtgagccgagatcacaccatgcactccagactgggcgacaaagcgagactccatctcaaaaaaaaaaaaaaaagaagcagtgtctgtccctagaacctgggtctcctgggccaatgcctcatcctcataataaactttccagccttaggagggaggttttcagtgcctagattcaggcagacatgtttcctccaaaggacagctttggaaggatgggagctcaggccttctcaggagggcgagaggggttattgggaaggccaaggtttatctctgcaggaggaagtctcagctgcttgacttgatggaatccccaagagcctgctctcccgcaggtcaggcaggaaggggcagaggtcacaggggaggcctgtcctggcccctggttccctgagtctttgctatctgtgggcctcagctggcactcagccaacaggcccctggcattaagatgacaagggctactgtggcctcttggcttctccctgtttctccctagagacactcagccccagcactggccggatctccctggccaccttccctgaaggcccctttccccctactttcatgtctcaacccatccccacagctcagtgagaccctgcaccctgcaccctgcaccttggattcatgccaggcctgagtgacccacggcccatgccttttctgcttggtcccattgcctcacgggtgcccccaagttctgcttcctgtctgtgccaccgttaagcctctttcctagtgatgactcccgcgacagcctctttccggaggaggcgcattccttaagggcctggtggggatggtgatgacagggccaaaggacagctcccaaagctggaaagccagccactgcggggggcctggaggtgctgtcagcaagggaagctgcccggcccctcttgctagcagccaactcagcctgagcacctgctctgcaggaaatagaaggggactttgctggaaatctgcctttaatcttggcttcctgttttctgccctgggggactgcccagacggtctgagtttcaagctatttcacaccagcttctctaaactgtcatctctgtgcaaagaggctgggggaggggaggaggctgggtggagagaggagcggcccttcccttcccaggggaccccataagggtataaatgcacatacatgtgcataagctctggactgctggaggccaacccaactttgcatggagctatcccatttggcacttgtatcatcaaaatgcagccagaagcttctctctggttccccacatccaggggtgggtctccaacctctcctctcttctccattcccctggggcaggcccaacagccaggcaagagtggcccagcctcagagagctagtgttcagttcccaacactgccttgactccacatttcacaggcatcccaagctcattttgtccaaaaccaaactcctgagtgttcccccagcctggcactctccccaggttctcccatctcgcaccatctccccaggtgctccagccacacctgaggactgaggagtcatgcctgatttctcctgtggcctcactccccacaaacaacccctcacggagagctgccctgggacttgcctttgtccattcacttccctatcccgctgcttccaccagggctagacccgtcagccctggtccaggccatgcaacagcctcctcactagggctttgacctttgaccttaactttttttttttttttttctggagtcagggtctcactctgttgcacaggctgaagttcagtggctcactgcagcctccatcttcccaccctaagtgatcctcccacctcagcctggctgagatgggaagattgctagctaccagcacacaccaccatgcctagctaattagaaattttttttttgtagagacagggtcttgctctgttgcccaggctggtctcaaactcctggcctcaagtgatcctcttgcctcagcttcccaaagtgctgggatcacaggcgagagccacagggcccagccgaccttcactctttatcatatcactaccctgcttataaacatctttcaatggctccccattgctcatatgataaaacctaaactcctgtaataaaaatctctggcccacaacaccctatagaatctgtcccttcctcaaacaccactctcccctgcttgccggtctcatcaccttggccttctggctgtcccttgagccactgaggctttctgtgcctcagggtctttcactatcttcctccccacctgcaataccctcccccactcctccaacactggcctggggcgtggtggctatcgcccgtaatcccagcactttgggaggccaaggtgggtggattatttgaggtcaggagtttgagcccagcctggccaacatggtgaaaaccatcgctactaaaaacacaaaaattagctgaacatggtggcacacacctatagtaccagctacgtgggaggctgagacagaagaatggttgaatgccagagcgggaggttgtggtgagccgagatcatgccactgcactccagcctgggcaacagaacaagactccgtctcaaaacaaacaaacaaaaaacaaaacaaaacaaaacaaaaacttactaagacagttgtagataaaggcagatttattagaaaaagtaggaaaatacattgcaagaaggcagaagagaagctgactgccaggaaacaaaaggttgttggagattttatagaattagtgttatgctatctgttgaggaggtttttgtgcagtatcaaacgccaagggtacagtgagctaacttgccaagggtacagtgagctaacttgcaggagtctggtgatagtcgggcacaggaagattgtgaattatttgcacaggagagctatatgtcctagacatgaagaaaggcagactcacagcttatctaatttctctttttgctttcccttgctcccaccgaccagattccctttccctaattagcacttcccacctagcacttagtaggtgctcaataagcatttgtttttttgttttgttttgttttgttttgtttttttgagacagagtctcgctctattgcccaagctggagtgccgtggcgtgatctcggctcactgcaagctccgcctcctgggttcacaccattcttctgcttcagcctccccagtagctgggactacaggcacccgccaccacgcccagctaattttttgtatttttagtagagacagggtttcaccatgttagccaggatggtctcgatctcctgaccttgtgatctgcctgcttcggcctcccaaagtgctgggattataggtgtgagccacggcgcccagcccaataattccaccagaggacaggtctgtgggagtggggccctttatcgatttgtttatggttttatccccagtgcctggagtacaggaagattaaaaaatttatttcactttgctgagaagaggtggagccaggattcaaatgctggtctatttgactccaaagttcacagctgggccacagcacacccaggggaaaaagtcaagtgcatttggggataaagaaaggttggtgacaaaactggaacagggattagagtattttccccaaatccccagtcttttctttcccattctgctagctgattcagccaggggaggggagatgtcaatttctccctcccagaaggctttgcagagctgctgaagtgctttcttgtaggctgagaggcggccccccatccggccccatattatcattccatcttgacctcagaggaaagaaagggaaaccagctctgctgagcaccctttccactccctcacccccaggccgttatcttgctgaatctgcactatctatcatgagagaagtatattttgagcctgatcttacaaaagaggaaacagctcagagaccttaggtaactagccctaagtcacacagctagtaagtggacgggttgaaatttaacttggagacttgaaccccaaattcatcttttttctgttacaccacacctatctctgaaacttactggctgtctcctcaaaggacatccctctccaaagggctggctccagctgggaaaccggcctaagggtgccctgggtcagagggccgacctgtggttttgggggcaactcctcctggcatccgaggctctttaaaacaatctgcagccacactgtctcccagctccgtctcccacagggctgtttgccctcttctcgctccctcgggcctcttcatgcttattttgtgttccaagactttgtcagcatgccccacttcctcccccccaaccccaagagtgcctcttccctctgtccacccaagcctgacccttgcttcagggtctagtccctagaaagtcccccacctttacctcctccctacgctggagtctctggtctcgccctcatcactgtatccccattctgttccccggtctcaccctcatcactgcatccccattctgttcccccgccaccctgcactctcccacccctgtcatgcctgagcacgctgtcctctcctgtggctcagagcaggtcatctccctgcttttcgttaacagtgatgtaacagcccttgcttaacggagggctcctcacgtgccagctactgcatactaagcactttaaacgtattaactcatttcctcccctccccacaaaaacttaagaagtcggtgccattatatatcacctattttaccaaatggggaaactaaagcacagagaggttaagtaacttgcccaaggtcacagagctgctgacaacttctttattgcctccaggctgaacataaactccaagaaagtcccatgaggctctttggatctcttttgcccctgttgtttgcaggaacccatctcccaccactctcccccacccacactgcaagcggcagccgcctgagctatatttagatcccagaagccaccaagctccctccgcactccccgcccttgtgcatgctgttccctctgcctggtcccggctctgtgaggtgtgaggtctccccgttagccctagttttctttctgcctcctgggaaccgtgtccaccacctctccactttgatcaattatttccttgccgttgtctgtcggcctgtcagcctacccccacccgaccgagaacgccttgacggtagtgaaatggtcttgccaatagactccagagcaggctccgccacgatgtcagcgccaggaaatgttggtgaatgaatgaatgaaggctttctgctgcgaatcaggcccactctccacaaacagacctgaggagaggggcccaggcccggcccccagcgcttctgcagcgggaaagctgcgtccagagaaggctgggaggttgctcccaggccggctgaggagagaccctcggagccttcaacgcagccaggcggcaagtgggggcagggcgtgggcgcggacacaccccccgcagtgcccccggcgcccggcagggggcgccgccccgccggcccacgccccgccgcgcgccgggcaggccccctcgcgcaggcgcgctgccgcgggcggaggatccgggccgcgcttcctctcgccaggcctgcgagcttcctcccagcggagccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagaggtgagtgcctggccgtcccggagtgtcccctggagggaagagggtggaggtcgcgcgtctagtctctgttgctgccactgtcgcgtccactcccattcccctcttctcccacttctcccttctctcctttactcccttgcacgggttcgaattctcccaggagccactgtcagaacccaaattggaagggagtgcatgagggaggtactgccctgcagctccacggactcgtcttctcgggtcatcccgagtccccccctctgtggagctcagagtaggaggtggctggagtctggaggaagaggatccgtatgggccaggtccctagagagagtgctggactcccctgcccttccctgtacagggcctccccgcaggtgccctggcttgcttggttctgacccctccctcattaccccaccatgaccctgcgggctgcaagcaagcccagggcccagccacctcgggtgagcagttagaagcccaggtcctaggactgagcctgtcacccttggcctctcagaagaccaggcctaagccaagggatctttgggtgggaaactgggcaggccttctgcccggggggaggtaacggagcattagcaccatgcccccaccttctggcaccctgggcagcccattctcctaggctctttgtggcccagaccaggtgtcaggaaggggtgtgtccagccagcagattttttggagcttaactaccagttcacttccccgcccattttgtacacccgggaaccgaggctcaaagggagaagttgctaccccaggcctctagtggagttaggctggctgtcctttcatccccagctatacagggctggatggctgtgggtggaaggaaaccaggcaggcaccttcacccactggggacacaggcccccagcccggccccagagggaccttgttggttgagcacgtgcttccctgcagagggctggagggagtgaaagggcttccggctccagctgtggctgggtcagctagcaggagatgtggggaatgtgtggtgtatggccatctgtgtggtgtggcaggaaggtccggtcctggccccggctctgagttgaaacaacctggtggtcagtcctgacccagcactcgccacacctatggcccagctggcacaggagcagccaagttcaggatataaatggggtcacatgggaaccgtggaagctctgtctccactggcagcaggctacagactggggacatgggagcattgtgagagtggggacacccagggggcctgtttcaagctcctagtaccctggcggttccagtgtctttcttggttgtggccacagcaggaacagggcaaggacagcaggggtgaggttgaggcctggcaggatcctctggcccaggagagcaggcattgccctggtgggtgctgagcagtgtctgggctcccttggagctgctggcagttttgtcctgctgggtccctgctcacgatttagggtttttttgttttttcacttttttttctggctgtcctgacatgcacagtggaggggacccagatgtcctgggcctgtgagactcccctcacatggccccacacccagccctaacttcctttccagcctgagggactggggctggagcctgacatggttagctccctcccaccccagtcagcctttttaatttttattttattttattttatttttttaccaactgtgagctgtgaaggtgtgatccagggtcccagggcctttgaagaaaggagtctggcttctggctggcacgtgtgcagggatgtgcttttcattggtgagcttggtgccctccaccctctcagaagcagctgctcttctctctgcattgggtcaggggcaaggaaaaagcagaaaatgttcccattcaccaccgcaggggggccagaccccaaaaggctgagccacacagagtggccctcggcaagggttggaaatttcggggacagaatgcagcttcctccaaacaagtataggtaggggttgagacccaggatccacagtgtgacatggctgccccccaaagggggcagacccacctgggtgcggttctgggctccatcttttgaaggattttaaaaccttgacaggtcatcttcaaagagccagggatgttgactgagtctgggaaagagaaagtagggacagattctcatatgtctgagggactgtcccaaatgagaaaggcatcccatggcagaaattgtcccagacacgtgggccagagctagggagcaggtgggtcccagggaagtgaatctgagctcattatagggaaaccatgaatgtactcattttcttgatttagaaaataacaaaacagcgctacaggaaatttagaaaatgaaacaaaaatcacccactatttcttcagcaggcagtgactgtgttagcattttggagttcactgccagtcttttccccatccttttccttcattgtcgttgtcactggagtgtgtgtgccgtgacaccttttttcatttaatactgcgtctgtgggcattttctcatggtgctacgcggtctaagtaacgttgcttctaaaaagctacagaacattctaggctggcctgctgcagcgccatcacccatacactggagcgtgtgcatttttcccctctgttgctgttgtggttgtcgttactatgagtcccaaaagcagccagggtgttggagggcacaagcaacttggcacccaactgaatgtgggttccaggcccagacatgccacttaggcccagggtagagggaccttagacaggtcactgacctgctgagcctcgttgatataaataacaggatggtaacacctacttcagaggaaggtgtaaggacagtgtcaactaactaaccaagggactctaaagtgcctggcacagccctttcttcactccctctgtgagtaggattggcattgttgaaggagtgcccactgctggctgcctcaacctgtggggaaggtgcctgagccacgggccaatgttgactgaccactcacctggcaaagaggtggtctccgcctgaggagcccctgtgaaaccccctggccctgaggttctagaatactatggccagtgcccttgcctgccttcccttctccccattaccatatgattggctggcctaggacatggggctggccctgggaagatgggctgctggttagggtccgggacctgactccacccattccccttccggtctcccagcatcagagctaaatagacaaggcctcttctctctctctctctctcttttttttttttgtgtgtgtgtgtgtgtgtgtgtgtgtgtgagatggagttttgctcttgttgcccagtctggagtgcaatggcgcgatcttggctcaccacaacctccggctcccggtttaagcgattctcctgcctcagccttccaagttgggattagaggcatgtgccatcacgcctggctaattttgtatttttagtagcgatggggtttctccgtgttggtcaggctggtctcaaactcctgacctcaggtgatccacccacctcggcctcctgaagtgctgggattataggcgtgagccactgcgcctcttctgtaagagcctggctgcctcctgcctcccagctctggctaggtcagcccagcttggcattttcccagaggaaatagaggcctgcttagcctgagacttagacaaggaacccaggcatcctgagccccagcccaagaacagccatgccagcctcatcttcgcaccctgttccagtagccaaggaagggaaagaagctgggagattaagggtagggggattctggagcctcccagagcttcccaggagggagttggacacatcgggaaactcatgttagcctccccctcctcagcaggtgttccccaggtctaacctgagtgtgtatcactgtgacacacctgcttcctcttgttctacttttgtggagaccagggtaactgggagtgccctcctacagccaccccgtgggcagtagcaggacaccagtctcctcctggcaaccctgggcctaagagactgtagccccagatgaccctagggtggcccaggactaacctaaggaaggggtcctcccccaggtggcccattcagtgcagaggtcccttgggcacacgacttcagactccagctgccaaactttggcctgtggagtatctcctcctccctggtcttagtgtaagggaagtgggcatgacaactgccctcctgtcccacagcttgggatgggatgaggtcacagggtggggtccgccccaagatgctggcctggcctggctcagatgagagccctttgggtgtttctcagtttcccccgcccttggttggggacaggatgggtggaggagcaggccacccccaacgcccggcagggagcactgcctcccttccccctctcctctgggtcccttcatccaagggctggaaatagaatccgctaagtaatgattaaagtcaaattcagacctaaaaataaagagctggtgaaggaagagctggtgctccctgcatggctgaggggagaagtgagcagggagaggctggctttgggtggctgagcccctgctcctcgggatcagaagtactccaccagttgggggggtgctcttttatctgccatgatgtggcccattaagtgtagacggcaccactcagggcagactggcaggacccattagaaaaaaaatcccatttttcccatggggaaactgaggcccagaaaggagaagtggtttgtcaagcgactatttgagagctcccctcagcaggcccccagggactggagggccctgtgcagcccagcctgccctttctgcctgctcagtttctcttcctggttttgaggtgctaagatgaagtcagcttctcatcacacactagctgtgcacacaccctccaaccgcagcttccctccacccctccttctgtggtctgggcccagagtcgaaggaacaagtagaagagaggctgcttggtgcccccctggctgtcctgatcatggcatggttgtaagcctcgtgggcaggcgaaaacctgggcatcatctgccccccttggaccctggctgctgcttctcagcccagcctgacacctggtcctcatgcagactcgcgcatctatctatctgcagcttgtgctgtccgtgctgcagggagacaggagggaaggatgaagagcaaaccctgagagcgcctctgctggcgggtagaggagacgaggagtcagtgaggggaggcctgtggttctcacttcctggcagagctggtaggagctctgaagctggggctctgcgtgggctggggcagcctggagggcctcctggaggggaaggtcctgtgaaagttgagaagtgtttgaagaagaagcgtggtaggaggagaggtccttgtttgaagcttctgccctctctagggctgctggctcttttctgtgtgtccctcgacaggctcttggcctctctgagaggctggggtatgcagacaagcaagaagtgggcacagaagtacctctgcttcccagagcagaacagccaagctctgggcagacctcccctcggtgccccccacctgtccattttcagggtgtcgtctgtcctgcacaaggaaaggtgggaagaaaggtcccctaaccaaggttcagacaactctgagctcaagtacccacacagctagttcctcctctgtcagagatcaccagtccttgccctatggggtgtttgaaggattaagtaactaatgcagtgccccaaacccggttgggtcagtcagctgtaattcccgtgttctcattctgcagcccatcctgctggaggagtgtactggtaacacccccatctcccttaagtagtagcaagtctgtcctttgtgttgatccccacagctttaccttctgagctgtgtgttctgcagatcctggttctgaagtggggagaccagaaatctgggggccgaagttttagacagcttatgggcctccagccgtcagtctccccacctagaatgtggccaggagacttccgggtgagggacaagaacatgactttgaagggtccattgaaggctagtgctgagaggctatatgcaaatgcaggcaaatgaagatgcaaagaccacatcctgtgctaagggggtgggggagcagaggcctgggttagggccctggggaggcccagagtccccattgcccagcgcacataggtaattaggctcctgagcggtaattagaaacctttctgggccaggaatggcagcctcaagccgcagcggtgcctggggagtaggctccccattagcctgctctaaccccagcccccacctctcccaaaccactagacgggatttccggtcccactgaaccattgggggcaggggaaaaaaagccagtgtgttgctataatttggtatttatccattaaatccgcccttctccttaggtcagggtgctgacgggagccccgggatgggggtagggcagcgtgccctggagccagagcaggcattcttctgttccttcgtaaccgccccgggaggtgtaggcatctccaagaccctggcgcccaattctgctgctgctcaccctgagacacctgtgcagtgggggtgctgagggaccaccagcgcaggctgcgggggtcagtggaagccctcgggcacccttccttgcctgatgtgtggtggggaatgtcacagtgcctcagcctggtgtcctctgcagaaccagaggtggagctgattttattgctgccaaacttgcccaactgctggtgggtgccccgccctcctcaggtgcactgccctttggaggggcgggcccaaatctgaaacttaattctgcctgtatctgtactatgacctgtaggccctgctcggaggttccctgggcccccatcctgaaccttcttcagtcttcattaactcgctctgtaccacagtttgcagtcttaatcctggtttacttcaaggcgcccctctctcagtcactttcccctaaaatccttctagctcctgctcccctcacccatcttcctggaagccttcccgggtggcccctgtctcacaatctattgaggcactgaacataccaggccatggctgaccatccagtaaccaggaggacaggagccgggtctgcattttgtggtggttcccagcatccagccctggcttgtgcacagaggagaggtgtgtgagtggtgaccttgggtccccaaaggcaggacctcttgagtcctttccttctccacccggatatcctggcctaccaagcatggctctgggcacacaggaaggcttctaaaacactggctcaaagaatgagaaggcaaggtggaccttgctgttgcctgttttgcctccagtggctgtccccatcccccagagcatccagctaggtcctgtggcagcaccagaatctccgggggccagggccctgagttcccccaggtcttttgtgcacttcccttttcagtgggtatttttagctgggcgtaaacagttactgaaggctcccacgccccattaggcagcagagttttggcaagggggaagggcaagggagccccttgacctcccctggccctcagcacgtgcctggccttgggggtctacagctgcttccagggtaggaaaagggcagcctgggagtttctgggctcccagttctttctccccactccttgtcagcctgggctcacaagaaaggctgcctgaggctgcagccactgacctcagcgcttgggcacaatgccagcctgttcccgggaccccagcacaagggctgctgggagccgggtttagggcaggaagtcagagtgaagcactggtcctgccacatcccaagccccttgtcccctagccctgcgggaatggggtgacagctgctgtccctttggggttaactatagtcctattggttatgagacctcggtgtggtacagccagcctggcgtcccctttttttcattcgttcattcattcattcattcagcactcatttactgagcagccgctttgggcccagcccatgcagacgtgagtcagaccctcactttccccctgcagagctcccagtccaccctaaaccacaggccacaaccagtgaggttctcactggagcacggggatgtgtgagaggccttggaggcctcggcagccaacacagctggggacccaaggaattctccagagagaggtgatttacaaaaagtttcttatttccagttttaagggggaaggtaatagatgcatgtggctttaaaaaaataataataatttttttaaaagcccaaaaggacaaaatagcaaatgaacagtaaaaagtaagtttctcttgaacttgatctcactttcccttctcatcctagaggcaacctctgttaccagtttcctctgtctttccaaagataatcgaggcatatttgagtttagggaggtgttgcattaatacctctttaaaaacacaacttgtagtattccatagagaacctgcacctggctttttttttcacagccttttattttgagtatttgaaacctaccaaaaagttgaagtaatagtataatgaatattcatatatccttcatgcagatttgccagttcttaacattttgccacatttactctatctcttcttttatctacatagacatatgtgtgtatgtattttttgctgatttgagtgttagttgtaggcattgcatctttcaccctaagaactttagcgtgtatctcttatataatcacaatgtcatgatcacacttaagaaaattgacattaattccatattatctactatgtccatttcccctctccccaagtgatttttatagctgtccccccgaccaccccttgatatagaattcaattcaagatcatttattgaatcttgtcatgtttctctagtgtcctgttcaatctagaacattctccagccctttttttgttttgctcttttatgacattgacatgaagagtccgggccagttgttctggatttgtctgattgcttctccctggttggagtcaggtggaacagctctggcaggaacgcccccccgggcaatgcagagtcctcctccaggaggcacttagtgtccatgcgtcaccttgctggtgatgcttcactggatcacttggttccggggttgtccgcacgtctccctgtagtgcaggtgctccttcctgtttccaattagcctgtgggatgggacttggaagctgtgtctgttctgctcccctggcaactttttcttcaatgacttgagctggtgttttgccattttccatactctatcatggggagtgttcagtatcggcatctagagatctcccctggccccatcacagctagagctatgctgtcccctttcagggacatcttgtaatttatccacccagcccccaactgatggacataaaggctgtctccccatcatctcctgctactacagacagcactgcagggactgtcctgctgtgtttttttaaggcatgggtactccagaagcagttgctcagctgcacccccaaggttgagtggaagtccctcggtaaaggaggaggagagagtgtgaagggaatggcaaggcggggagggagacagggcacaggtgtcctggcaacagcagatgggaaacaggtctggctaaggtaccagaagccaacaagtcccagaaaggtcaagtgactttcccaaggtcacacagcaagttgatggcagagctgggtacaggactcagagcatctgacacccaggacgatgttcctgcactgttccatagagtagcccgactcttaagtttaaataaccccaggaaggaccccctctctgtgcctgacccccgctgggttgtagaggcctaagtttgcagtagctcctcccagccactctggctgtcagcctctgacctgcagtgggagggtctcaccttctggagatgttttaaggaggggaccccggcctaggcactagctgggaagccactgagccatcttgtctgcggccactgacgtcagtgcttgggcacaatgccagcctgttcccgggaccccagcacaagggctactgggagccgggtttggggcaggaagtcagcgtgaagcactggtcctgccacatcccaagccccttgtcccctagctctgtgggggtggggtgacagctgctatcgctttggggttaactatagtccctttggggttaactatagtcccattggttatgggacctcagtgtgatgtagccaggctggattcccccttttgtttgttcatttattcattcattcaggggtctcatgaccccaccagggaggagccgtccaagagagttagcagctcccacttgcaagatgtctgtggcaaggcaggcactgttctggtgctgagagctcaactccagtcctcacagcagcccccagagccaaggagtatcaccagtccattgcacagatggggaagctgggttctagagtcacagccagcagagtaaaggtgatgagtttagccctcttccctgtttccagaccctctgaggccttcagagcccagctccttgaggcagcccaccccgaccgctcctaggcttacccttccctgagcaccgcccctgtgcccctcatagctgcttctgcctcctccctcctccctcctctcccttgcccctaggctagtgtggtccccatggcaactcctggggcctgtccggcagggaggcacggggctatggggagggctggctcagcagctcaggagtttgacacctgagggggacagaatgctcactcaaggtgtggccctagggacccccgccttgcccctgtgggcctcacttggggttctcatctgcaaaatggggataataatagcttctctgtctcagagttgttagaggatgtgatgagccataacgtgccaaggacagggcctggcacagaataagtgctcagaaaacagggcctgttattatttttattattataatcaaggcagtggggaggcggcggtggcagtagctgtaggccaggaagggagtgtttgcaaactgacagctggaagggtgactaacagcgcagcagcctccgcgcccccctgtggtggcagggagtttggggaggaagggggaggcatggggatgtggaatgctagcagggcccctattcagaaggacctaaaggttgggggcccagccagccctagtgggaccctaattcaagctctgtcacccctaactagctatgtgacttcaggcaaattgttcaaccagttgagcctcagtttccgcttctgtgaaatgggggtaagagggttagaagagctcacaatcctccttccctccccgccacccccacccccacagcttacagtccacaggaggcaggggcaaggggtcctcaccacccccaccctcacagcttacagtccacaggaggcaggggcaaggggtccccgccacccccaccctcacagcttacagtccacaggaggcaggggcaaggggtccccgccacccccacccccacagcttacagtccacaggaggcaggggtaaggggtccccgccacccccacccccacagcttacagtccacaggaggcaggggcaaggggtccccgccacccccaccctcacagcttacagtccacaggaggcaggggcaagggatggttcctgtacttagtggtgactgagtcatgtggatggaggcaggtttcaggctcatcctccttgggcctcagtgtccctgcctaaacagcaggattgatggcctggcctctggggatagaaagggccctgtattctgggaggaacggaagctctttcatccaggggatggggcaggggcgcaccagacatttccaagttcagggtttcattccagcccctcctcagccagcttgcaggagatacctgtcctccccttcagggtaagcaagacttagaagggttgagtcactcaccccaagtcgcacagtcaacagagccaggtattaagcccaggcctgactatagagccaggtgtgcggcctggaagtgttggttctccctggccgtctcctccccagctccttctgctctccatgatcacatgcccccctgctgaggccccatcgcccttggagtcaaaccctggttcctcacattggcagtggaagtccccctgctgcctggcagagtttatgccaggcccacttgaaaccatcccctacagtgtcccctgagcagcggtgctcaaggtggactctggaagtgtgtggggtcctagagccccagatgggcagggtctgccttcccgcttccctcaccatcggcttccacctgggccagtttctcatactatgccagtcccctgcctgacacctttgctcagactgctgcatcaacctggggtgccttccctggcccgccctctgcctgtgtaagccctgcaatcttcagggctcagccccagagctccctcctccagggagcctgtctgagctctgcagtccgtgcctacttcacacccccagcactttgcactaaaatgtcttctcccgcgccactgcactccagcctgggcaacagagcaagactccgtcgcaataataacaataataataaaataaaatgtctccttccactggggtaggtagcaatatttgtgactgtcagcctagcccccagacctcatccactgtatcaaagagcccagcaaagaggctcatggaggagtttctcttctaacacactgtgaccacgaagatgccactggccctttctcaccctcagtttcctcacccgtagaaaggaaacagtagttccagcccctctgcttcctgagacaggtccaagggggctctgggctgggattacaaagtatgtgtgtgcagacgggtgggttgctgctctcagggaatggggttggctagggtagcttttttggggagtcaactttattgaagtaaatatacggttgacccttgaacaacacaggggttgagggcatcaacctcctccctgcagtcaaaaaatcatatattaacttttgactcctcaaaaacttaactactaatagcctattgttgtcagaaagccttgtagataaagttgattgacactcattttgtttgttatatatattatatactgtattcttacaataaagtaagctagtgaaaataaaataagaaaatcatatggccgggtgcagtggctcacacctgtaatctcagcacattgggaggctggggcaggcggatcacttgaggccaggagttcaagaccagcatggccaatatggtgaaaccctgtatctactaaaaatacaaaaattggtctgctgtgttggcgcacgcctatgatcccagctactcaggtggtcaaggcatgagaatcacttgaacctgggaggcggaggtagttgcagtaagccgtgagtcaccccaccactgcgttccagcctgggcgacagagtcttgctgtctcaaaaaaaaaaagaaagaaaatcataaggaagaggaaatatatctactattctttaagtcgaaggggatcattatgaaggtcttcatccttcacattgagtaggctgaggaggaagaggaagagttggtcttgccgtcacagaggtggcagaggtggaggcggaggaggtggaaaggaaggcagaaaaggcaggcacactcagtgtaacttactgaaaaacatccagccacgtgtggtggcgcatgcctgtggtaatcgctacttaggaggctgaggcaggaggattggctgaacccaggggtttgaggctgctgtgagctatgatcacgtcactgcactcctgcctgggcaacagagtgagaccctttctcaaaaaaaaaaaaaaaagaaaagaaaaagaaaaaatccatgtgtaactggacctgcgcagttcagacccgagttgttcaagtgtgcactatacaccaaaaagtgtgccgatcgcaatggtacagctcagtgaattgtcacagagtggacccacttcatgattgggctcagacagtctgaaaaccaaccccagaggtccccttgcattccttccagtctccctgtcccaagagcagctatcctgacagcatggattagtttggccagattttgaactttattcaaatggaattacataatatgtactttcctgtgtctggcttcttggttaacattttatttatttatttatttattcattcatttagaggcagggtctcactctgtcgcccaggctggagtgcagtggtgtgaccttggctcactgtagccttgacctccccaggctcaagcgatcctcccacctcagcctcctgagtagctgggagtacaagcacgcagtaccacccccggctaatttttgtatctttagtagagaccgggtttcgccatgttgccgagactggtcttgaactcctcctgggtttaagccatctgtctgcctcagcttcccaaagtgctgagattacaggtgtgagccactgtgcctagccatcattatgttttgaaatttatcgggattggccaggcacggtgactggcacctgtaatcccagcattttgggaggccgaggtgggtggatcacctgaggtcaggagttcgagaccagcctggccaacatggtgaaaccccatctctactgaaaatacaaaaattagctggttgtggtggtgcatgcctgtaatcccagctactcaggaggtggaggttgcaatgagccgagattgtgctactgcactccagcctgggtgacagagccagactccatctcaaaaaaagaaaagaaaagaaattcatcagtgttatttaatggttggagtttgtgttggagtttatttaatggttggtgtttactgctgtacgtagtcccttttgtgaatatgccactgtttatccattttcctctggatcggcatctgggcagctcccagtttgaggtttattacaaagcatgccacttgtagccctcctgtgcctgtctaggcagacacatgtcctgtgtcctctcggtgtgtacctagaagtggggttggtatatgtttagagatgctacctgggcgggattttgcaggtgaaggacccaaggacccacagagcataagggactttctcagatcacatagccccttctcagagctgctccggggcccctttccccacagaacagtagctggaaccaggcctggggctgacggtcaggtgtccattgtcccactagccccctttgctcctttctatcagtcctggaaggccccctgtggccttagggttggtggctccctctgcccctgggggtcctcagccctcatgctcctctacccagtaccgtcagcctgccaggactggagagaatggcccatgtgtcaaatcccagcgcaggacactcttggcacctgttcatgcccagtgaggagccagatctcagcagttggggggcatttcttcacacccctcctcagtcttcatgctcttccccacagctctaatggtaccaagtgacaggttggctttactgtgactcggggacgccagagctcctgagaagatgtcagcaatacaggtaccacaggggtgagggtctgggacatgcaagcattcccaccagccccagcggggtgcttagcagaggagagaggatgcagcttagatcaacccactcccctttttcccagcactcagtcaggtacaggcctggggaagtgggggagtctcaacaggaagggacccagggctcgttctccgggcagagcacctcacccaggctcacagaggccagctcagaggctgtgaccacgagggtgcgccagcaggtggctggagggggcccaggctgcacccgcccacgtgtcacctgccttgcaggccgcctggccatccggtacagaatgtattgccaagtacaacttccacggcactgccgagcaggacctgcccttctgcaaaggagacgtgctcaccattgtggccgtcaccaaggtaatcaggtgacgcccaccccaccatcccactgctgggccttccctctgcagggggaggtgggcctgagagcatgtctgggctgccctctccccaggaccccaactggtacaaagccaaaaacaaggtgggccgtgagggcatcatcccagccaactacgtccagaagcgggagggcgtgaaggcgggtaccaaactcagcctcatgccgtgagtaccacgaggaggggttggggagggaaggggccttggtcctcctgaaggagcatcaggagcaagcagggaggccagagtgaggggcttgggtgttggggagggcctcaggaggaggtgcagggtgcgggtgcgggacctcacagagcagggctgggggcagaggcaggagggtggcaaagaagggacagggagcagaagaagagggcctcaaatgcctgactgagcgagtgcgagccacgggtgccaagcagagggaaccccttcagaaaggggagccagggtcagtacctttgggccaccatgacctccagccctgctgctccccagttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggaggtgagctggggggtacagagccttgctcccaccctcacacaccctaaacccatctggggccctggcttctagctccagccccactgcttctgcgtggtgaccagccatgtggggcaacttctgtgagcccttgtttcctcacaccttggtggagcagctgctgcgtgccaggactcacctctgaccccacagtgccaccatgaggaggggagccttatcctcattttatagaccaggagttgaaggttcagagcagttaggggacccacctgaggtcccacagatataatttggtgccaggactagaatctgagtctgtctgatcccagagctaactttcctccagccactcacagacctgcatgctcagaagcgtgtgcagaaacatgagccatgcgccttgatcgccagggcccctgaggctctcgcacctgcacggacatgcccacaggtccctgcagcttcccaggccagctctgccagccctggccaggccacacctggcatccggtagccacaggaagcctcccgtgtccctctgtattcactcttatctccctcccctactggcctggcttggcctgtggcaggtgagggtggggtcctgggcactcctggctagaggctggtttcaggactgagccatgggttgccctctgcatcagatacccatggggcccagagtggtagcagcagctgagtgtccagcaaccgcatgtagggtggcatgggaaatgggccatacgtcataatctgggacttccctaacccctgccctaccagaaatggggagccctccccactcagtgactccaggctaggcggggctggcctctgccgccctctggtggtcaggcctggacggtgcatatggggcaccttgggctgtctctgagcaccctgccccccacaccctgcagcactacacctcagacgcagatggactctgtacgcgcctcattaaaccaaaggtcatggagggcacagtggcggcccaggatgagttctaccgcagtgagtgcaccccaccccagacctcttgcccacccacctcctcccacgcaggcttcctggcactgccccatccaggaacctccagagaaccccagtgcctgatagtccagtcagcctctgtcatcccagccatgtccctagtggcctccaggccctcactggcccctccccacaggcggctgggccctgaacatgaaggagctgaagctgctgcagaccatcgggaagggggagttcggaggtgagctgggccgggccccctgggggggttctgagggactccgaacttgggaacaagaccacctctctgcccccagacgtgatgctgggcgattaccgagggaacaaagtcgccgtcaagtgcattaagaacgacgccactgcccaggccttcctggctgaagcctcagtcatgacgtgagtgggggcggggtaggggggaggttggcctaggttaggagtgaggcaccagcttcccctttctgaccactctcgtcctgccccaggcaactgcggcatagcaacctggtgcagctcctgggcgtgatcgtggaggagaagggcgggctctacatcgtcactgagtacatggccaaggtgggcacctgccgagacccggcactcaggccttccaactgccccgaaacccccactgtgctctagggcccctgctccctcagtcccccgaccccaagtgagcttttaggtcaccagggctgggcttttgtcctggtttaccattcattgactgtaacattggacaaatcatgtcacctccaagcctcagcatcacatctgggaaatggagataataacaacttagagatttgtgagagtcaagggataaggcatgaataacacagagcagtgtccggcatggatgttctggcccctccccactccttccctgtctcacacctccctggagtgtcaacacccacccggccccagcgtgctgtgtgagagggctgcagggcacgtctgacctcggcctggtctgtccttcctgcccccaggggagccttgtggactacctgcggtctaggggtcggtcagtgctgggcggagactgtctcctcaagttctcgctgtgagtgaagcagcctcttggatgggtagggtttgaggggtaccctgccctgctatgggagccccagtctgaggggacatgtggctggcctacccccagagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaaggtggggctggcctcccctggggcctacagaggtgggcaggagtcctgggtcactccccaccctggagtcccaggatctgacgctgcttcttccatccacatggcagaaattctccactaagtctgacgtgtggagtttcggaatccttctctgggaaatctactcctttgggcgagtgccttatccaagaattgtgagtatgggtactgggatcagggtggctcttggagcaccggaggggttggcaggggcgtgagcctccttgggccctgcctccccaatcaaggcctagaagcctcaggcctgccctggggagctcacaggccactctccgggcctgggtctgcggcaaagctgatgggcatccctgagaggctgctgggtaggtgtcctctctgaggccagggcctggactgactcctgcctccccctggccacagcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgagcctgcttgtcctgcccggtcgtccctcccatgccatcttgtccatccccctgtgtctgtgagtggggctgggtggggagcatggctgggagatgtagccgccgctttgtgtcagctgcacgagtgagtgtccttgtgtctgccctccgggaagtgctcaccagttgccctgctgccgccaggcccagctccggggccccatctacaggatgctgcctgggggttccagctgcctcccctgctgttttcaagcctgccgcacaaggagggctacagctagggatgggagggagcccaggcctgcacagatgggaacggggttctagtcaagccccctgtgcaagagagagaaaaagcaatggtgggcccagtgggcttcctctggcaggaggagaagtgtctcatgcctgagaagatgctgacccggagagggacgggaaagctcctggtggttctccagtttcacccacgatgtcacagctttgccctgtccccacccctgccatgtgccaggccttaggtcataccagacttggcaggggttgaggatgcagggcagaggggagatcctggcaccttccagtcagggggagtccctccccaccccaccttgtcggggaacatatagagaatgtggaccagccatgagattttctcccctcactcaggttgtccaggggcagtggtcagtacagaacctctgaaggtgtgaggaggcttcatgtattccctgaggcaggcaggtggggtgttcccctgtcctgttgtggccccgacccttcctctaccagccaacaggacctgaaatccaggaagatctgacttcgaagtctaccttgtgtctgttcctcagccccactgtagttccatctaccagtgcaacagcctcctcgccgcctccacttcatcttctctgcatactgccagacttaatttttctaaaactacaccattcattcaacaacaaatatttgaatacctgctgtttgctaggactgaggttcatcaataagcaaaacacaccctgtggagtccacagttgggaagacaatcaaatagtcacatatagacagtgacaaacttaagtgctacatgaggaacacaaaacatgggaatctttgtagatcagggagggcttctggaaagaagcagcgtttaagctgagatcagaagcagaatgaacaggttgtatggcaggagttagcagcattccaggaagagatgctgagactggagggagggcagctttgtctcagatctccaagaaagtgggtgaggatggacgaacagccaggcctgagaggtgaggctgtggctgtggcaaagacttagcttttatcaaacagagaataatgggaagccaatgacaagtttgatcaggagggtgagatgtcagataatttttgtttgtttgtttgtttttgagaagaagtcttactctgtcacccaggctggagtgcagtggtgccatctcagctcactgcaacctccagctcctgggttcaagcgattgtcttgcctcagcctcccaagtaactgggattacaacaggcatgcgccaccatgcctggctaatttttgtatttttagtggaaacggggtttcgccgtgttgcccagactggtctcaaactcctgacctcaggtgatccaccacctcggcctcccaaagtgctgggattacaggcgtgagccactgcacgcggcccagatatgtgtttttgaaatcaccctagctactggtagaggagtttcagagagtacagtgaggactggtccagatgagagacggtctccagagagatttagctccagagctaaaattgaccgaacttggctatggattcagtgtgagagtggaggagagggaagggccgtagcaaggcctgattgagcagaacggatgcagggagggcagcagggggcatctgctgagcgaggacaggagactcatgcttaggagggagtatcatgagctctgttaaggacatgttaaggtttttgttgttttgagacagggtctcgttctgacacccaggctggagtccagtggtgcaaacacagctcactacagccttgacctcccaggctgaagcagtcctcctgcctcagcctctcaagtagctgggactacaagtgcctgccaccatgactggctaatttttaaattttttgtagagacgaggtctccctatgttgtctaggctagccttgaacgcctgggctcaagcagtcctcccacctcggcctcccaaagtgttgggattacaggcgtgagccaccacaccaagccacacattgagttttaagtgaggctttgaaactgccaagaagctgggcgcggcggctcacgcctgtaatcccaacacttcaggaggccaaggccagtggatcacttgaggtcaggagttagagaccagcctgaccaacatggtgaaacctcgtctctactaaaaatataaaattagctgggcgcagtggtgcacacctgtaatcccagctactctggaggctgaggcaggagaattgcttgaacccaggaggcagaagttgcagtgagccgggatcatgccactgcactccagcctgggcaacaagaccaaaactgcatctctcaaaaaaaaaaaaggtcaagaagaggaggttgaccatgccagtgccatgtcgtaaaagccaaggaaaaagaacttcaagaggaggaagccaccagggtccccgcctcccagaaggcacagagatggaggctgagtctgccccttggtttttatttatgtatttatatttattttttgagacagagtctcactctgtcaccgaggctggagtgcaatggcacgatctcggctcactgcaagctccacctctcaggttcacaccattctcctgcctcagcctcccgagtagctgggactacaggcgcctgccaccactctcggctaattttttgtagttttagtagagacggggtttcactgtgttagccaggatggtcttgatctcctgacctcgtgatccacccgccttggcctcccaaagtgctgggattacgggcgtgagccaccatgcctggctatttattttttttgaaatggagtctcgctctgtcgccaaagccagagagcactggcacaatctcagctcactgcaacctccacctcccaaattcaagcaattctcctgcctcagcctcccaagtagctgggattacaggtgcccaccaccacgcctggctaatttttgtatttttagtagagacagggttttgccatgttggccatgctggtcttgaactcctcacctcagtgattcatccatctcggcctcccaaagtgctgggattacaggcatgagccactgcacctggccaaactgccccttggttttagccacaatgtctgtgttgataagggctgattccagatcacagtgactagagaagggtgtgagaaacgcaagaggtggacagtctgagaaatgaagttgtaatggagagatgagagaggaagagtgacaggaggatgtggtggatttagggtttttttctttttctttttcttttttttttttttttgagatggagtctcgatctgtcacctaggctggagtgcagtggcgcaatctcagctcactgcaacctcagcctcccgggttcaagtgattctcctgcctcagcctcctgagtagctgggactacaggtgcccaccaccacacccagctaatttttgtatttttagtacagacagggtttcaccatgttggccaggctggtctcgatctcttgacctcccaaagtgctgggattacaggcatgagccaccgcacccggctggtagatttaagacagcagagtcttgagcaaatttggctgccaaagggaaggacattgacctttaaattgtactgagtactgagagtgaggcaagagatatagacaggaggggtggtatgtagatggtagagccttccttagagcagggggtgggtggtgggaacccagaacatgggggaaccggcctgagatgggagagggatagtccctccgcaagtgcagagaaggagggagactcaggcagtggtgcactgatgaatgtttaatatccaaatctaggacacgggctgggtggggtagctctgatttatagcatttgctgatatccgcggagttaatactctgactgtggtcaatttcaagcaccaatctgacttcactgaatacagcgctggatggggattccagcaatcagctctcacagctggtccaagccagctaggattcagaaacccacagtgaagcccgtggctatagggtcacaacaggggccagccaagcaacacaacagagatgggccaggcataaaacaacaggagagaagggacagggctcagccaatgggaccctgagggttgcaggctcagatggctgggtgttcccattcatctttcctttttctttttttttgagagggagtctagctctgtcacctaggctggagtgcagtggcatgatcttggctcagtacaacctctgcctcctgggttcaagcgattctcgtgtctcagcctccccagtagctgggattacaagcgcctgccaccacacctggctaatttttttatttttagtagagagggggttttgccatattggccaggctggtctcgaactcctgacctcaagtgatccacccacctcagcctcccaaagtactgggattacaggtgtgagccactgcacccagcctctctgtttctgcttgtttttttcctctttcttttctctcatctctcccttctctgccctggcaactggctcatcacagatgagcaagacatagatcctgcccttaaggagcttgtgaactgatggggaaccttctcaggactcagtctgctgtccggaaaagtgggggaatacctgccaccagcaccccaccaatggggcagaggcggtgggaagtgcagggcggctcctcagacactcaaagaacaggcagggacagcaagggcattcctggcaaaggaagggcactgcccagccaaaggtggtgaggtgcgacagcgagctgaccagcttgctggggctcagacgccaaggggtgtggcttggaagccagtgaagctgaagcgaaagcaggggcctggacctcacctgcctctgtaggcccaatgaggagctcaatgttatgggaagatagccagaagcaattgaagggcttaggacagaggtgtggcatggccagatctgtattttattttattgtatttatttattttttttttgagaaagagtttcgctcttgtccaggctggagtgcaatgatgcaatctcgagtcactgcaacctctgcctcccgggttcaagcgattctcctacctcggcctcccgagtagctagaattacaggcatgcaccatcatgcatatttggtatttttagtagagacggggtttcatcatgttagtcagactggtctggaactcctgacctcaggtgatccaccggccttggcctccctaaatgctgggattacagacgtgagacaccgcacccagcccagatctgcattttagaaagacctttttcactgcagtctgggagacggtgaggaggctgcagtcagcaggtagtggggaagaggaggataaaggggctgctgtcctattgagctgagcactgtctgccaggccctgttctaaatacgttccatgtaacttttcaaacaactcttggaggcatataccattaatgctcccattttacagataagaaaactaaggcttggcaagattaaggaaccaggtaacacggtatgaatggcaagaacaaatgtaagaacctgcctatggctagatgtggggatgaggcagagggaaggatatgggagcagttccactctctggtgtaagggggcggtgccacctgggagacctgaggcctggaggaggatgaaggggctggagaagaggaattcagtttggaattcctgggggccttagtgacatccaagcagagatgtccgctgcagagagacacattcattcaagtcttccaggagaggctggctagaagtagatttgagagtgtgcacagggatgtgcttgaagtcatgggcatggaggagcttggtcagggagtgtggggttgaggagaagcaagccctgaggcttatgggggtagggagggagagcagctggcaagggattagtgaagggagcagccaggggcagggggagaagcaggtgggccttggggggactcagggtacaggaggggtcggggagagcaggtggatgtcagcagcatttcaagcggcagagactgggttgagaagagtctcctaggaccaaagaacaggcatagctgctcaggcctttgcgagggcgttttccatggagtggtggggacaggatcgggaagccaagggcttgaggatccagtgggcttgaggggcttgaggatccagtgaggaggcggggacagaatggacaacctgtccaccagtgtggctgtgaagggaggaggagcagatggaggcaggtgagggcttggtgttgcaaaatgcttttttttttttttttttgagacagagattcactcttgtcgcccaggctggagtgcaatggcgcgatcttggctcactgcaacctctgcctcctgggttcaagcgattctcctgcctcagcctcttgagtagctcagattacacgcctggctaattttgtatttttagtagagatggggtttcaccatgttggtcaggctggtcttgaactcccaacctcaggtgatccgcctacctcggcctcccgaagtgctgggattacaggtgtaagccactgcacctggcctgtgaaatgatttctcatagcatgttctaacatttcacatgtacaactttgattttaatccatttgtaaagcttcagtcactgactcctattgggaacctccaaagcacagtaaaatttcagctatccaggattcttggcaaatgagtcattctggaaaaccaacttttatttggatgaaaatatttgaaatataggatttctttctttctaaaaaaaatttttaatgaaaattttcaaatatataaaaataggccagtgttgtggctcacacctgtaatcccagcactttgggaagccaaggcagaaggatcacttgaagccaggggttcaagaccagcctgggcaacaaaacaagacccccatctctacaaaaataaaaattaaaaaattagctgggggctgggcgctgtggctcatgcctgtaatcccagcactttgagaggctgaggtggacggatcacctgaggtgaggagttcgagaccagcctgatccaaaatggtgaaaccctgtctctactaaaaatacaaaaattggccaggcgcggtggctcacacctgtaatcccagcactttgggtggctgaggcgggtggatcacgaggtcaggagatcaagaccaacctggcaaacactgtgaaatgctgtctctactaaaaatacaaaaaaattagctgggcgtggtggcaggcgcctagtagtcccggctactctggaggctgaggcaggagaatggcatgaacccggtgggggcagagcttgcagtgagcggagactgtgccactgcactccagcctgggcaacagagggagactccatctcaaaaaaaaaaaaaaaaaatacaaaaattagccgggcatggtggtgggttggtgggtgcctgtaatcccagctactcaggaggctgaggcaggagaatcgcttgaacctgagaggaggaggttgcagtcaaccgagatcccgccactgcactccagcctgggtgacagagtgagacttcgtctcaaaaaaaaaaaaaaaaaaaaattagctagcaaggcacggtagtgtgtgcctgtagtcccagctcctctacaatcctgccattgcacttcagtctgggtgacagtgagaccctgtttcaaaaaataataaaagtagaagatataaggaacccctgcatcccgccatccagcttcagcacttaccaactcaaggtcaattctgtctcatctctaccccacctgctcaccaacaagccctggaatattttgaagcaaatccccgatgttacagcaattcatctgtaaagcttttgtatgtttctccaaaagacactttaaaaacataaccacaagccaggcgtggtggctcatgcctttatttccagctattcaggaggcaggaggatcctttgagcccagaagtttgagtccatccttggtaacataggaagacaccacctctcaaaaaaaaaaaaaaaggccaggcgcagtggctcacgcctgtaatcccaacactttgggaggccaagtcaggcggatcacgaggtcagaagatcgagaccaccctggttaacacggtgaaatcccatctctactaaaaaatacaaaaaattagccaggcatggtggcgggcacctgtagtcccagctacttgggaggctgaggcagaagaatggtgtgaacccgggaggcagagcttgcagtgagccaagatcgcgccactgcactccagcccgggcgatagagcgagactccgtctcaaaaaataaataaataaaataaaataaaaaataaaaaacataaccacaataccatattagttctcaattttttttttcgaaatggatttttgctcttatcacccaggctggagtgcaatggtgcaatctccgctcactacaatctctgcctcccaggttcaagtgattctcctgcctcagcctcccaagtagctgggattacaggcatgcaccaccaggcctggctaattttttgtatttttttttagtagagacagagtttcacaatgttggccaggctggtctcgaactcctgacctcaggtgatccacctgccttgggctcccaaagtgctaagattacagacatgagccacagtgccctaaaatttttaacaattcctcaatatagtcaaatatccattgttcaaaaatatccattgttcaaatttccccaatatctttttttttttttgcagttgggttaaaatttggctccaaacaaggtctgcacgttgcgtttttgtgctgtctctaaagactcccttcttttttccatgtaatgcttttgttgaggaaaccaggctgcttggaaggatgagcctgggggaattcgggagagggagagagggggcagggaggagagaaggatgggtgtccagatagatgtgccatccatgctgggggacacaggcagaatgtggaggcctgtctccctaactgggaggggaggccagggctgctgaagggtgggggccaaccctgggcacccccccttcccctctgccgcatccaactgctggaagtgatgggagacagaaagatggcctgagtcaggagcaggggcagagctcaggttgtcgtggggtcccgctgcccacgtcagactggaggtgagggatgggcggggcctgacagcaggcctggaaggaacaggatgtctatgctggagatagagggagaggacagtgccaaaacccagctcctggccagtccccagctcctccctgcctggccctatcccaggatcccctccccggcctcccagctatgatctaccccggggcccagacttcaggcgccttcacgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggaggtgaggggcaggggtggggaccagctatgcccagggtccctcaaagtgctggaggggctgtgacttggtggggagtgggtctgtcacagccatcctctgtccagggtggggcaaggcctgggacagtgccaggcaccccaggaccccttccaggcttgtctcctgctccaccgcctcaacaccccccacccctgcccaagctgtttctcctctgcctctctgcttccctgccccaggacttctctcttctcctctgcctctccttggacccctgcccttcctctacctctgacctgtgaacacacagacacatgctcacacactaagtcccaggcacacagaaggcaatgtggaccagcacaaacctccactctcccggctccatcccagcgggcctgtggctggccatgagaactgggggctacctggagggaagcatcctcatcccaggtgagtgggcaccagcccttccctgtatgtgtgttgtgggtggaagcaggcatgagagcatcttagcccataggtttgtattcagggacttccaaacccagacctacaaagagtgtgtcttctaccagatcttgttcaaaaaagggtttgtgatgatggaactacacgatagagggagtgagcaagaacaatgaggattagagtggagcgtgaaatagtctaggagcatggcttccaaaacatatgctgtgaggtctgtccacctgagagttgggccatggatttaattctgagcctcttagcaggcaaagcaaagacagaaagcagatcggctgtggatttctgtctataaaatgtgagttcttggccaggtgcagtggctcacgcctgtaatcccagcactttgggaggccaaggcggatgaatcacgaggtcaagaggttgaaaaccatcctggccaaaatggtgaaaccctgactctactaaaaatacaaaaattagctgggtgtggtggcgtgcgcctgtagtcccagctcctcaggaggctgaggcaggagaattgcttgaacctgggaggccaaggttgcagtgagctgagatcctgccattgcacttcagcctgggcacagagccagactctggctcaaaaaaaaaaaaaaaaaagatgtgagttctgagaaatggcacgattcctaactaaagccaggacaaaatatcccttttttttttgtgagatggagtttcactcttgttgcccaggctggagtgcagtggtgtgatcttggctcactgcaaccttcacctcccagattcaagtgattctcctgcctcagcctcctgagtagctgggattacaggtgtgtgccaccacacgcagctaatttttgtttttgtttttgtttttttttttttgagacggagtctcgttctgttgcccaggctggagtgcagtggcgtgatctcggctcactgcaagctccacctcctgggttcatgccattctcctgcctcagtctcccgagtagctgggactacaggtgcctgccaccacccccagctaattttttgtacttttagtagagatggggtttcaccttgttagccaggatggtttcgatctcctgacctcgtgatccgcccgccttggcctcccaaagtgctgggattacaggcgagccaccgcgcccagcctaatttttgtattttttaagtagagacgggttgtcaccatgttggccaggctggtcttgaactactgacctcagatgatccgcctgcctcggcttcccaaagtgctgggattataggcatgagccaccgcgcccagcccaaaatattcctttaagatgataggccctgtcagtagggtttcttccagtcctccttcatagagacacaggaggtaacaaaaaggtgggctgtttctcacagcaccaagctgggccctgcttcaggaccaggatggcaaaacttatacaacactcactgctatgggccttgccaaatctgggtgtcacagatcatgtgagggagcagaggcaccttctccaagatcacccagtgatgtgtgcattgtctgttcattcattcgttcaccctgatgttcctctgtgcccagcccagagataccaggcagagtgaggctgaaggagcccatggtctggggcaaggtctcacccacaggccttgtaaggctgaaagccttctgcaaggatttcagaggcagtgacagcttccagaggccctgggacttgtggccttgcagctctgagcctccctacccccatccctggcctttatagagcaaacaggctggattagctgcctccagaacgtcctggcagagtctgggccctgggccaggttccaggctggcaggttggagggtggggagcgagctcgagtagggcctctgagttccctgcccccagttcctgccaagactgcctcagtttctctcccattcctttttcctaccatgcagggctccttcctccccgccccaccaccgccagtggcaattctcacacacatactccatcctgcattctttcatcgcagtcctgtgggccggttctcaccttcacatctttgctttcctgctttcctcaccttggaatgccccctaggtcctgtccaccaggaagctctggcctcatttggccacagcctagagtcttgggccttcttgcagttactccctcctaaagtgctctcctgtgttctgtggtctcaggcacttccttttttgtcacaaggcctcagtttcgtcatctgagaaatgggaagggttagacacaaatctctctcgtggtggaaaaagcttgtgctttggagtcatatggagctgaattccatccaatccacttagttccttaacttttatgagcctcaccttcctcatctgttagatggggtcttataaaaacagacagcacacactgcggtgaggcttcactgacgacgtggatggtgctggcattcattgccctccccagcaaaggcccctccagctgtgctgggctctgactcctgcttccctggctggccgcttatttaatggtaggccttggcattgtcgccttctcttccgggagcccagcccgggccaagtgagagagtgaagggggagatggggtgtagtggagcctggggcttgagctgcccttgtccacagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggtgagtgtcctctcccagagctgacagagcggggtgggtcagggaggcgggtgatgagccccggggtcccagtatcccacacggttccctgagctgaggggctggggacctgcaggccgtgtggtacacccggggcaggggccatgtaggctctgtccttggggggctggcttcgtgggacggcatcgggatcttctttgactctccggcagaggatactcaggtgcgtagtggtctcctgcctgccagcccgcctgcccgctcacaccctccccctcccgccatgtccgcggctcaggctgcttctcacctccctgcaggacagtcctgccatccgtgtgctggccagcgacgggcacatcccctctgagcagcctgggtaagggcctgtctggactgaccactcacctccatttttgcactgggaggggcccatcccccccatccgagcccctgccccagcctcctccagcagggggcccaccctgccgggccgccatacttgctggactctctcacttagccgacgtccgcccccctggggcttgattccttcgacccagcagccccaggtgaaatgacacaggctggggcctgtgatgagtatctttgctcccatgatctcatcccatctccaacaccctccataagtggggggttattcgtcccatttacaggtcaggacattgagcccagagaggggaagggatgtgccgtgcgcagtgctgaactttgagcccagacttacccctggagggtcctcgcccttccctgcatagctgtcccttccctttcccctgatgatttggcttctgtccctccccggccctactgcctcctcagtagctgggccggtttgtcagtgtctctcagcaaccttctctcggctcataacaattagagtaattgcctgcatttatggagtgagctgattgtatgccaggcacagcaccaagcccttctcatttactgtcttagttaaccctcataacattgttatgaggtcgttccaattaccatcctcgttttagagatgggaacactggggtttggagagatgagatggcttgcccaaggtcacatagctcggggcacaaacccaggtggctgctgtggtgctggcttctcccctgccctgtgctgcctccctcttggcggaaggcggcactgtcagacgctctgctgtgagtagcctgaggtgtccagagacactcagcgtttaacactcttctcctgactccccagagcctgccgagccgacctgtcagggaggcagcctggtcacattgtccttggctgccgggacatgtccaggtcatccgtcctgagtcagctgcattctgagccctggcagctgggagaggaaaaggaagccagaggcacagaggacttggagtttaaaagaaggaggagggagaggccaggcacagtggctcacgcctgtaatcccagcattttgggaggctgaggcgggctaatcacctgaggtcaggagtttgagaccagcctggccaacatggtgaaaccctgtctctactaaaaattaaaaaaattagccgggtgtggtggcgagcacctgtaatcccagctactcgggaggctgaggcaggagaaccgcttgaacccaggaggcaaaggttgcagtgagccgagatcgcgccactgcactccagccagggcaacagagcaagactccgtctcagaaaaaaaaaaaaaaagagagagagaagaaggagggacgtaagggtgataggacgagggtgataggtgggtcgggggaatggagggcagaaactgtattgttggtccaggcctttgtccccttaaggaagggccacagggaggcccctggccccttctgtaaatccaagtcccaacactccgtcaggcagggcttgcttcccctgctcctctctcttctgccaagggagcagggtacaacaagggagactcaagctagacaaggtacatgtcccatgccagctcgcccagcggaaagggaggtggcacagcaaatctgggcagagtggcttctgggactgccctcactgtccaggccttgagtcctgtatatcctggctggattccaactgcccacaagagtcaggcatggtggctcacacctgtaatcccagcactttggcagccaagacaggtggatcacttgaggtcaggagtttgagaccagcctgaccaacaatgtgaaaccccatctctgctaaaaatacaaaaattagccgggcatggtggtgcatgcctgtagtctcagctacttgggaggctgaggtgggaggatcacttgagcccagcaggcagaagttgcaatgagccacaactgcaccactgcactccagcctgggcagcgactctttctcaaaaacaaacaaatgaacaaactgcccacagggatggagctagccaagggctgggctcctgtcattgggacttccggaaccggccacaccccttcagagcacggatcacctactgggggcagaggctgcgcgtgagtcacccttcctgcttctgacagggctctgagttacagagctgctatgtgtgcgtgcccacggccccaacacaccagtgcctgtgacaccacgtgaggtccctggcacacacgggccaacatccacaggggatcctccatccctacacagaatcctaacactcacccagagcacatacatgtaagggctcacatgagaccaggagtgcgggtcacctccatgccattctgataccaagccctagggccacctgccatcccacggccaggggagccagggagtcagaggtagggacacccccccactgctcactctctccatgtccctcagatgtccttgaacagtggcctcactcccagtgatccaggtgagttctgtgtggatgtggggcccctgcttttggtccctggaggtttctttggggtctcagcagccaccggcaccctggcaggtgaggatcccactggacaggtaagagcagaagggcagtgatgaataaatcaccctcagcacaccttctaaagagcactggggtggcgtcagccacttcaccacatgacctgggcttctgtgacccttgggagaagtcatgtctgccttgagacttgcaagtctcaaatgggataaaacaagagaagctttgatttcagtgctggccacataagtgcccctagctgtgagttgcgggacaagtggaagacagacagcaaagaggggcatttaggaaaatggagcaaagaaatgtgacaccatggagagtccacggagggtcccacagcgggaaagctgagggcaaccagagcgtgggagtccttgaatgccaggaccttggtctggtttctgaggaggagagtgacatggtcagagctatgctggaaaggtggccactgtgcagttgctactaccagtagcagctgtgctctgggggcctaagagtgtcagatggtctgctgccatggctctagcccaggatgttttgggatcgtccagttctgccacaggggcctgcctctgactgagtgtgaggttcaaccctcaccacccacccgtctacctgtcaaccctcacacctttcctaggaagtaagcaagacaagcatcagacggtggcccaaagtcacccctcttgcctcggtgggatatcatggcggttagggtgaaggctgagcgagggggttgctgggtggaggggtcttacttctccttcatctgtccccttccagatgatcatgatgtcctgtccttcctgaccttcagcctgagtgagcccagcccagaggtgatgccagccctggcctacctgggaatggcagcccagggaccctgccctcacccatgtcatggtgccctcagacctgccattccagcccttacctccacctggcctctgagctctgctcaggccagaccttgtgcagggcagtgctgcgggccagggccggtgtgtgaggtctcgcaggctggctggctcaggctgtgacattacagttcagagcgatcagtgccaggtctcaaaaggtgcagggggctgtgggagcacagaggaggagtcccaaccagccagggggtcaaggaaggctgcctggaggagatgagcttaaaggagcctcggaccagcacatataggcttgaggccacagcagggagggaagatggtggggatctgcgtgaaggcagaactcagagggctggaaactgcagggccagctggccagggaggaaggctgggctcgtggggaagcctgtgggaaggctccccttgcttctggatctcccatgggtttggggcccgactttctgtcttcctcccctaggttccccctcagcccttcctggagatgcagcagctccgcctggcgaggcagctggaagggctgtgggcaaggctgggcttgggcaccagggaggatgtaactccaaaatcagactctgaagctcaaggagaaggtagggaccgagagagcgggcaggtggcgcccatctgagtgtcacagcatcctccacccttatgaccaggggtcctttaatcagtagggaaactgaggcctgaggaggccacatctaagcaggccctgggcccaagtgttctgtgctatccccaccttaccactcagactcatcttccaggagagggtcttggaggcagcagccacaccttctggcacccctctccaagaagccaccccaaagataagataggctgtgttaccccaccatggctggctgcccatcccagctctgccctaatccccaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggtgagaagccctacaggcatccaaggctccacctgcgggcctgaaagaggagcaagcactgtagtcagcaactagtctcccctaaggcctggagggaaaggaaggcagggatgaaatgctgcaggtcacaggatggggcagggcagcatgcaggatggcatctctgcacaagcaaatgcgcacggggctggggctgaggctggggctggggagaggagatgccagctatttggactcagctctgtagatgaatgacagaaatagactaggtgctaatttgcatgtagcttcacatgcgatttgcatagggcttgcttaatgctcagttgcaccagaagcctcattgcatctccattgccatctggctcctcccccagggagtcataactcgggtcatgcccagcctgggggcctgagagctaaactcagccaaggtgttagatactgggcagaggaggccagcagctcttgtgggctttgctgggctctgacagctcgaggttttaatcttgtgtcagagcagcttaggctgggctgctagtgtggggaagaggggaggggacttacactccagggccaagcctctctgatcctatccccaggccctggatgcttcctgccagattccatccaccccagggaggggtggccacctctccatgtcactcaataaggtagggacccaaacactgggtgttgaccagcactggccccagcttggctggtgctctgggagaaccagggcagagaggactgggctgggcctctgcttccttcaggggacagaaccacttttagaagggagacgtattttggcttggcatggtggctcacgcgtgtaatcctagcactttgggaggccaaggcggacagatcacgaggtcaaaagactgacaccatcgggcagatcacaaggtcaaaagatcgagaccatcctggccaacatggtgaaaccctgtctctactgaaaatacaaaaattatacaaaaattagctgggcgtggtggcatgcatctgtagtcccagctacttgggaggctgaggcagaagaatcgcttgaacccaggaggcagaggtagcagtgagctgagattgtgccactgcactccagcctggccgcagagcaagactccatctcaaataaataaataagaagggagaagtattttgagaaaaccctgaagtggccactgttgggaggaaacaaccacccctggggagaggggcgtgagtggagggggaatgtggatgcccttatggatgaggtcagagaaacacagtgtgtccaaataaggaggccctggtaatctgggaaggcctctggaaggaagaggctgcagtgccgctgggaaggtgggctctgagaagagaggggctatgtcctgggccctagacaagaggctgcccctctgcaggactctgccaaggtcggtgccctgctccatggacagtggactctgctccaggccctgcaagagatgaggtaagggactgggtggggacccctccaccaccttgtttctccgccttaagttcctccattagcccttcattccttccatcatttcctgagcgcccagcacacagcctgtcaattggaagggctactggtggagttaggtttgttgagttgacttgaatttaattgaatcaagtttaatgttttgcaagtcctagttaaaaagcaattctctcctggagaagcccatcatgaaggccccctcagacactcccaccctcaggaggcttaagaaatctgagcattccttcaatggcagctcctaggatgaggggcattttgttgggggctcttggagagggagcacagccaagatcagaccagttggatgagacagtccctgacttggttttgtgcccccattaacttcccggtatcccactctaggccaggcctctggagccctgggggttgggggagtcctggggatgctgtggaggaggcatgcatcccaggctgaagcctaaagccccacctgtacacacacagctagatgcctagggttgggggtggagaggcacctagatgagaagaaggaaaggagttaaatccccaggggctgggaatggaaggcagagccggggagcctggggttgacacagatagctttagggagatctttatctgagctaaagtctcaggatctaggaagaaggttggaggtgaaaagaccagcccccaagaaggggccccatggatggtacctgttccccatccatgtgctgcccttggggagatgggaaatgattaggccatctgggtggaagcagaagaggtaatgagtcatcttacttggttaccacccccggttagggatgcagctgtccgcatggctgcagaagcccaggtctcctacctgcctgtgggcattgagcatcatttcttagagctggaccacatcctgggcctcctgcaggaggagcttcggggcccggcggtgaggggaaagtagtgggcagcatggggtccccaaccttgacgtctgggctcagccacccttcttccagcacttcagcagccccaagccctcctgcctttgccctcccctcccaggactgctggcaagcacatctgtgcctgcgtcagtgtctgtgtgtccgtgcatacgtgccaccacacatctcatcttttctctgtcctctctcctctctgaagagtcccacagactcagcagcagcagggccctggacacccctcgatccaatatccaatgaccagaggggaaacagggtgggctgtgtccaagatcactgagtccagtggtagtcagcgcttccccatgccctgtcccatcctcgttccctcgccctcaccctgctcaccctgtctttggctctttacttctctcttctcttctcttgaaccctgggccccttgatgatcccaggccccaggccttcccagctgttcccacagatgcagccatgggagctggggtgggggaggcagctttgtacactgccccctctccaagttccctggatgagagccaggacgccccaagcctggggaaaggaaacggagcatgcacatggcctagattccaggtcccccactccttctgggtaagaagctaagctaggaccttagactttcccctttcagaaggcagcagccaaggccccccgcccacctggccagcccccaagggcctcctcgtgcctgcagcctggcatcttcctgttctacctcctcattcagactgtaggcttcttcggctacgtgcacttcaggtgggccaccccgtgagcaggatttcccacagcactggcatctcttggttctcagctataaccattggatttaggagaggggacacttcagctcagaggggacctgccgagtccccaaatcacaaagagcacagtgcgggatagggcccattctctcaccaagcactactgaccacctgctcggcccccagccccatctgggtcctgctctcacggagctcactcacacaggtctaactgaccctgtgtcgtcaatgccatgatgtcaggaagctgaggggctacgagagtgcaggagaacacacttgaccccccttggttagggaatcaacctggaagggacatttgatatggtcattaaggtgactaggagttttccaccctgacaagataggtaaaggcatagaggcagagggaacagcatgagaaaaggcagggaggcatgagaaaaacataatattttagagaaaaagtggcaagttcagtaatgttggagcaaagggcaggacgagtttgtgaaattgggcaaagagatctgaaaaagtgagaggaggtcactagttttgcttggtgtgtgtttgctgaatgaacgtgcaccgtttagagatgtggggtgtgctaaaggcctcagcaatgagactgacaatctttgttggtggaatttcaagacaagaagagtccgtgtgggctgggatggtcctggaggaggagtaaaatgagctaagctttaaaaagcacaaggtagaaatgctcacaggcttcagcacatgcacaggagtgcagtggtggcaatcagcctggagccactaggacagaccttacatgcccagggggaaagcgtggaccatatgcagcgggccaaaggagccacagaaagtccaagaacagcggaggttgtggtgcagtgagtgtagcaaggcaagcatgagagtcctggtttttcaaaagcccataaaggagagacgcaagtaacctgtaaccttctctctggcagcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctccccatgctgtgatatgctggtcttctttccagcctcaccctaatctctgtgaaggcttccaccccttctgagtacctggctgggagtgcgctccaagcaggcaaggaggccaaggcctggcttaacctccaaaagaccggataccccacgggctttgaaccctcgactatggagggaaagagagccatgactgtatataattctgtcctcaaactcacccataacagagagcagtgtctcccagtgtccctcctggcccagctcagccagcatcactgagcagctctctccctccccactcctagctgctccaggggcagcaggggaggcgcgtgacagagcaaccctgagaggccaactcgtggaaccataactgggattcccgctcgcgccctcaggtctccctcccttttccagcgtcaagctctctgggcagctgctgggttcagtgacttgggtgggtggggagaatggggggcacccaaggctgggtttttaccccttgctgctacctggatctcccagctgaaatcctagttattagtggcccaggagaggagaaagttggaagaggctatggaacagggttccgggagtgtatgagctcaacccctctcccgggagagcgaccccaccaccgcaggccctaatcctctgtcagcagtgcccagcggagctcggcgttgaaggaggcacgtgggggaggcgggagtggggagcgggcacgtggtccagccttctcagccccgtgctgccccccgcccccagtgaggaggggtttggggaggtgggggcgggcccgggcgggggcgggcggcgggcggtgccaagcgtggggcgcgggcccgcggcgggagctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagtgagtgggatcccttcctggctccaacgacctcccctccccacccccacagctgctcagtccatccccgggccagcctcaggtcccaatcccttctcccctactttcctagacacggtaagagaccgggaggtgtcctctacactgcccccagacccatcctatctgacacccaaaaccccgctccagcatcatgctccggccaagggggagtggggggaggggcgaccggacgagggaccgaccggagcctgggacgaggaagggggtgcacgtgcgtttctgacgaaacgataatcccttaatccgatctggtcccagccgcctatgtcttccaactggggctcctctgaacttgaggctctgaaaaaagtggtgcagccgctcagagtcgcggagacagaccctgagatgggggcactcacaaacattgagcacttgtgtgcccgcagtgctgggacagagtttggggctggactctgctgctaggctacttgggttcagagcctggctttgcctattagctggataactttaggcaagttacttaacctttctgtgcctctgtttccttttctggaaagtggggatggtaatcataatacatgccttgtatatttatgaagattaaatgccaatgcatgtaaactgtttagcacagcacctggcacatgataaagtctcataaatgatagctattatttcgctcaatcctgataacagttttgtgagttgcaaaattttatccccattttacagaagaggaaggtaagtgacttacctaaggatatacctaaaatggtagtggagctgggatgtgaacccaagtttggcctgaatacttttccccacatgacatagcttgtcagtgagggaacagcagaccaagttggaggccatgagggacaaataattaggatctgcagagagagccagacagactgccaccctggttccctagttccatccagtggcagagacgacaaagggcactgtgatgggcagaggcagcagaaacctggatgtccgggttggagcgcttttgctacacacagggaccaatgcagcagctgctaggactcagagaccccttctgtccctccctcgaagacctcaacccccttctctcagccctcgtggtgactctgcctccggtgaccctgcaggatggagcgggatgcacagttcacacagaggaaggcagagcgggccacactgcggagccacttccgagacaaataccggctacccaaggtaagctggccccggctgtgaggcacatctgggaccctgagctctgggttctggactccttcgccccattctgggcaccacagccctcagctatgagactcacagggtatttggttagatccttccttctcattcatttgttcttttattcattcactcactcgtagttaaatctgtgcccaccaagggccagggctttgtgctgaggggaccccagtcctcatgagactgacaggtctgtatttctggagccaatctaggcctcttctctcctccaccccccatatccccaccaagcctgggccaggcctgggcagaggaagacacaggggaggcagaaatcagtagatttgactgcagaggtgagtgttctgggggtttctgaacctactgaagggcagaacttacttaaggtgggggagagaagccctgtgtgtgccaagtacttgaccttcatgtcctcatctaacccccaataatgctgccaggcagctatcacccacagcgacaaaagatgaaactgaggctaagagaaatggagggacttggctaagatcatacagccagtgagccatggagctgggaccagccctcaagccggtgaatatgagcctgcctttgctccagggccccaggctgctttccagagtatggagtctgcccgtagagagccaagtacccccttggccggccaagcagccagagagtatatctcaggagatccctgcccccacgctcccctgggcagtgcaccaccagatgggcgtgtaagtgtgctgctcctgttgtctaaggaggggaatgaagcacaaatctctcccagaatatcaccctagtgcatccagaactgtgctggactcaggggaaaacagcacagggctatagcgctcctgattttgatcttccacttgaattgaatgaccaaatatatgaacatcacattcactcattcaacaaatatttactgagtccccagctgcttctgactccccacagggcaccaatcttttggaaatctgtcacggggaaaaaccggtccagaaagcctgcctcactgcaaactcttctaggaataaaatcattcctcagatgcttgcgctaggcatataagagacacctgccatcagcaaagtcagagttgagcagaagagccaagacttggatgcaactgagtaggacataaggcgccccccagaagaatagtgaagggcaatggtcatcgtaggtgccatgcaaaaaaacacagatgttggaatcagtgacataggtttgaatctagctccccaacatcctgcctgtgtgatcttggataatttaagttacttaagttacttaagttagttaagtaacttaaatttaaagtaagttacttaaatcctgtaagcctcaatttccttatttgtgaagtggaaataacaatacctacctacctcacagggttattgtgagaattaaaagcacccagctcaacgtctgccatgtaatagatataatagatgtttgataaatggtacccatcactatttttggttacacccttaagcataacaagagtcaaaacatgacttagctgactgtaacagtgtgactcataggtattttcattttgtctttactcactgtgctggtccttcagcatctcagagtgaaataaggtaatataaaaaggtctccatgtccaggcatcaaacgcttgatcctgggatgtgggggtgggagctgagctcactggaacatggggctcaagaatctaaggggccgggcacagtggctcattcctgtattcccccggcactttgggaggccaaggtgggcatatcacttgagcccaggagtttgagaccagcgtgggcaacatagggagacctcgtctctacaaaaaaaaaaaaaaagaaaaaatagaatctaggggcctggaacccagtccaagcctcctccctgtcctctcaactctgggtcctcacagacttccactccaccccaccccctcttcccctcttcccttcagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtgtgcctaccttcccacttcttactggcttccaggagtcttggagttcatagccccccgagcctgccttaaaggggtgtcctccaccccccacctacagcttcacaggaggggagaaggcatccagtgctaggagtagaagtgtctccagctctgttctcttggggccctgggtgaaggtggggtctggggcttatgaaataggtctgggctttgaggaggatggagcagcctcattatgtggggaagatggggcctctggggcgtcactgagaccacaggtggggccggggctggaccgcagctgtcttgggtgcctgtgcctacacccctcctcaccctagagacggaagatgtgcaaaaagaaagaaggaagggcaactgcattccagccccacactgtgatgactttgagcctgtcctttccctccttgagcctgtcttgcttgtcccctgtaaaatgaacagtccccctctcccccaaatagtaataatacatgtttcaaagggtgaccatttataaagcatatgacaaaccatatcaataaatgtaactcattcttttaaaaaaatgaagagcccagatctcatcccgctcacctgtggcaggggctgaggggcaggggtcaggggaggtttaagaaaccagccaggaagctccccaagcaggtcgccccaggggcctgggcaggaggaaggtgctatggggccaaccctaggtgccccaccccgaggtccagggcccggcctgtagggaagccagccaaggttcacaggcaggagcggctgtctgaggattgggtttcaagggcaaagtttccatgaggtctcctttgtaaaataaaaacaaggcatatacaacctgtacaggagatcatgcggggctggaagagaggagacagggcagggagagacacaggcccagccctggagtctgctgctgaagctgtcactcttggtctcactctcctgagtgtccccagggaatgggcctgggcctctgagctgctcctgggctgcccccaggccagggcctcctcctgaccttctcagagctggaggagacccaagccagagccccaagccgggtaggggggtcatgggctgcctccgcagcatcagcagcaaggcccacgtcagcactccgccctccggggccttctgcctaatgggattcgacagaccccttccccctcagtgcttcgcagggccgagaaggagaggcaggggtggtgggcagtgggggctggggaacttgcactcgctgaaccctgtcaaagcaaggctggttggaacctggattaaaggtcgggagaggggtgagcccccacattagtttccccttcaccctgggagcggaactccaagaagccctgaccagtttgcactatccctggaatggggtggaggaggctgtggggctcagatagagatggacaatgagggtaggctgaggggtccctggctctgttgggcatgcctggcctcccttcttccttccccctccccatcagccctgcaatctgggtctctgtcagtctgcacccctctcacctgtgtgccctcatgccctgctgctctgctggctcagtgcctgtcctgtatctgcccgcagctgggggctgacttggcccaactggagctcttctgcacctgccccccaactcccaagccctcgagccctgaatacatcaactactactctcttcccaagctgttcccaccctctcttatttagacaatccaatgtctaactaggatatttacatatttgtcctgtgactggtccacccacctggtgtgatgtgagggccacagagtcatttgccaccaaaacttcccatttcaccctctgcctagaaccccgttagtaccccgtagttaggactctgatgtttcaggcctgctccttccttccctccctccctccttttcccctttcctttctccttcatacccttgcaggcagtctgagcatacaggaaatgttaaaaggtagttaagagagcccctccaacttccccaaaccccttcagcaggagggaagaggcagagatggttgcctgtcccaccacctttcaccctcaggggctctggttccacaatgcagatttcagggaaaccctgcccaaggagcctgcagtcccctgctcctaccttctacccacccggacagctcaggcccagttgccagcaggaagagggtgccaagagaacaagtgactttcccaaggccagctggtccccaggaaggaactggggagggtgaccagggtttgcagcatggaggatctcctcttccctcaacagccagatggttcctcctcagacaccggaggccccaggcaggcgctaaggacacctgggacatgcttgttagctgagccgagctgctgacattgcctgttgacccagctgacactcagccgtgaggctggagcttctgtcctctatcccacagacctgaggtggggctgggggtgtagttacagggtccactgccatgcctccaacccaatgcctgccaggcagagctgtccccagaggccatttgaggtttgagatcaggggagcagcagcagcactgaggcagcctcagcctcattcagcaggagctgcgcctgcatgtgtgctcatgagcgtgtgtgtggggcctgcgggggtttgtgagcctgcacacggctgtcttgtgtctgtgggatctgctgtgtgtaggtgtagtatgagttcctctggggaagctgtcattggtgtgctccttcccttgggccccagcctcggtgttgggccattgccctttcagggagggctgggacagcaacccggcctctggggacaaaagcccttctagatgaccttccgcaggaacaaaggtcctatgtcctttcccacatcccaggtaaagagggtaaagaagggccagctggacacctgggtccctctatctgcttctgaggcccatctgcatcttccagggctggccccgtgggagaaggcttgggtgcttcccccagcttggcccagggctggctctgtgcttgggtgactgggatggaggtaggaggacagggcagtcccctgaacgttgctaggaggtagccatcctgctttgggcacctacagagtgttgaaagtgagaggcaaaaacaactctgcctcctctgaaggaaaacatgacctttagaaagtggatctgcgcatttcctacaggcctctgccgttagaagcaagccctgcccccctcgccccagcctccggactgcgctgcctccctgcttggcaggcggcttggacacaggaccaacctagagaccatctagatgttttattcaagaagggccccttcccaggggctcctccagcagcctcagtccccaggcctttcgagtactgaatcctccctgtgggggcccactgctctccacacctacctgcctaagaacttcaggcctctgttctcagccagccaatatagtgatcacaaataagcaactggagtcgatgggccaaccctttctctattgcccttcaattctctctagtcttccatctcgtctttcatttccactcttcctcccatcttctttttttttttttttttaagacagagtctcgctgtcaccaggctggaatgcagtggcccgatcttggctcactgcaacctccgcctcccaggttcaagtgattctcctgcctcagccttccgagtagctgggactacacgcgcccaccaccacgcccggctaatttttatattttcagtagagatggggtctcaccatgttggccaggctggtctccatctcctgacctcgtgatccacccgccttggcctcccaaagtgctgggattacaggtgtgagccaccgcacccagcccctcccatcttctcaattcatccactcaaccaggtccattcattcccctcctgttccctcactttatatattgaggcttttttgtctggcccatttccagagataatctgaagtacctttctctccttagatctgaaagtcacattttattgtattcttactgtatgccatgcccatgtgcaacatctcattacacatggggcccttatcctcaacctcattctatgaagaaataggctcatcgatggatcctaaacttcaaggccaagtagcagagccagaattctagcagttcctcctgccctctgggacactgctccacactgccccccgatggccaggccaggggcttcagggagaatagttcccagggtctgttcccatccaggtatgggaaaccctgggatgactgagcaacccgggggcatgggtaagtctaaggaactgctcccctgctggctgccaggggatgtgctcccctcctactcccaacaagtgctgatcagattgacacctggggtgtacgtggggttgggggaaggccagggtacagagcctgctggaaatggagaccctgggggctgggtgtgagcatgatacctcaaaacatgccctttcctccagtccagctcactgctccctcagtggcccagggtaagggagggaaggaagccaagagatcctgtctggggtgagacagtgtgcggtgtggagggcagagcatggtggaagattgcactcctggagctgagccttcccagctcccaggcctgtgctcctctccccaccggtcgcctgggtgtgggcagcaatgaccctggtcagcccttctcctggatctctgggggctgagggcagatgtggctatcattctcagcattcccctccatctcgcgacctctccggccctacctcagcttccgcagcttttgctgcagtccttcttgccccagcctgtgggcagcggccacctctcctgtcgttcttaaggcaagaagagacgcgcaaatagagaaaataatttaatagagaaacaatgaatgatactctttacactcagcctcctgcagggaggacagacagctcttgcccaaggaagcatttaagggcagaagggctacaaatcaccaacacccgctgattatttaaaagaaactctcaaatacattcttttccaggttaaattcactttgtcctcataagtgcccatgctgtgggctgtgaaggtatcagccccattgaagagatggggagacccaggcccagaaaggggaaagagcttgcccagggctccacggcggcagggcaggcctagaagtgggtggcctagagggcactgggtcagactgtctccaagcctccctctccctgtcccaggctcaaactccagcacaaggcccgcgctgtggctagtgtggggcccagagggaacggaggtgggagagatgaggaccaaggaaccctcctgagtgctccctaggccagggcaggaacaaggcttgggcttcttaaaccccaaaagatccagctttcatgcttgagggattaacctaaagtaccaagatggcgggcaggtgtgagttcccagaaagactggtgggttctgtggggctgagtgcatactgtggggagggtggtccctgaggggtgttggagtgccccattccagtgcaaagaggagctgagttggaataaggggtcccgggaagggcaggccaggggcacagctgcctgctggcagggcgagggcaagcacagaagtaccctgcgggggccccttgccctcttctcggagccaaaaatgatagagggctgcatgccccaaaacggacaggcacaggacccagtaaccaccgagtaacaaaggtctcatgaaagaagtgctgttctcccagagtcctgccctcccctccagtatacagcacagccatcaaaccatctgtggggtgcagagtaacctgagggaggctggggactctgggatatgggggtctcagcactgtccatccaagaagcctgctcgccagggctgcagtgggccacttcattcttggcgtcagcctgggttagtgcccctctgctccagatggctcacatctgtccaatcattcttctagggtcactgaagggtgcaagctacgggggtgagggggacaatgggggagggtcagtctcaggtctttggtaagggaggcagaacccagggcccccagccctcacccctccttggatggaggatcgaccccagggcaggactcacagctacgaacagattccgacagtccctctttgtccagggtgtcagcttcccagcgagattccctcatctgtgggatgtgaaggcagcacaagggatgagaggcagacacacgagccacagcgcagtgccgagcaagtgagagagtgaaggacggggacacgagccacagcgcagtgccgagcaagtgagagagtgaaggacggggacacgagccacagcgcagtgccgagcaagagagagagtgaagggcagatacagggacagggaggcctgcagaggaggcgagagagcagacatacaccagcagggggggacgacagccacaagcagagagcaacagaacccacagaccctagccccagcgtggcccccatgtgcccaccttgacctgctccttcaagtattcagctcgggccatgaggttctgaacctgccaaggaaagatatgcccttgggtgtgggggagagtggcggggggtggggtttcaaagggaactcctcctcacccctgatgctctccagaaccctctgccccatcagaacaacttgcctcctgagtcccttatctgctccttcctccaggaagccttcccagactttttgctgctgggttcccagatcccccactgccctgtctgagcaccccagccctatggtttgacttccagacttggaacaccctgacagtgggacattccagagggaacccaaagaggtccccacaggtaagagcagagaaaggggaagaggaagccccccaaccctctcaagctcagtgggcacctcagtgtgaagcagctcccgcctccggcccgggggctccgctgtaaagagagggtgtgtggtgaggacagggtggccagaggccctgtggggggcataaatgggggccctcacctgccagcaacagcagtagctcccccaggctgtgctggtacaggtccagggcatcctgctccccgccggcggcctcctcctgcagccacaaggacaccaggctgcttagggtcatggcctgggtatctccctgccctgccccgacccacctggacccctcccactggcacaaaccttggccatggcagctgaagccacttccagggcagctaggaggcgtggcttgtcccgggccatctctgagatgaggggaaaggctcagggtgagggaagcaacctgcctgttcgctgcaggatgcctctccccacccgcctccccctcaggctgtggggaggtttgctgggggccctggggtcagccagaaaccggagtctacctctgagcaggtctcgggcagaggtcccctgcctcagcagggcctgattggaagaggagacgatggccttgagctcctcagcccgggacacgtactgccccacctgtagcagggaaagggcctgaggaggggctgtctcaccagctacccttgccagaacccacctccaagttctccctttgcattgttagtgactgcctcaagctataaacatgtcagggggcaaatgtggctggcctgacccattcccagctctgtgttgcaggagaggaagttccaattctaagagagccattccccagaggcccccgagatctccgggccttaccccctgcccccccacttcctcatggggactctcacccacctttgccttaattgcctccttccgctgggcatccacttcatctgcagaaagtgaggtcatatgaggagtctgggcgaacccctccctgccccacaacgaaccctctggaatccctcaaaacacaatattccaggtttacgctctgctttatcgcctacaaaattctagatagagaacttctggaatccacctactgcagccacagatgactcccatccctgctgcacccacgggcttcaggcatggcctgggactcacagtgcagggcaggtacaaagaagtccagagccttgcagtagagtgataaggcagctgctgaatccccctcctggtctttcttcacagcctgcaccaccagggcggtctggggatgggcagatcaggggtcaggtccacctccctaccctcccacactcaccaagatgggagatcagctcccctgagcccgccctctgtctctgttgggtgagtcaccaattcaccaccaacgggggcaaggagacctccagcccaccctcagcccaccccagccccagccgtctgctcactgctcgccccagactctccccactgggcatgtgctccaggtccacccaggggtgcgcaaaaaagtcctggaaggagatgcgacggctggggtcccgctccaggagccgctgcagtaggtcccggcagtctcgggagagcaggggccgcaaggggagctgcagggaagggaacggcagggacagatcacactgggctcctccacccctacccctagcccaggggtctgcgaggaaccccagaggtacgcgttggacaggtggggaatctgagaccgaggaggaacaggatgggtcaggatgatggagccagcggggagcgaggcctccatccctgggctcccggtgcaccctcgctggagccctgagctgagctagaatcgtgtttctgggtccttatttccctccctggactatgctcctaggaaggctgggcctggctctgctttgcattctccccacaagggcctgcaaaatgggcactgtgctgccagctgtgggctgacctgaggccctgggacagcctggcacctcgacttccagcctagaacctgcccctccaccacaaaggcagcctggagcccatactccagtctctgcaggtcagaacgaggtctaaaccctcagggccctgactccctctgccccccagtggtcgctaaggccctgctagacacacctcgatgacccggttgctacggatcttctcttccagctccgagaacgacctggaggcaaaggggggctgcccgaagagggcttctgtggaagggaggcagagcggaggctgggagggaatgggtcaagcctggcctgacgcccctcagcaggggccctgggccagcagtcagttttcatcagaacccttcagaagtggcccagagaggccttgcctgaggaaactgtaggcctcagggtgagaagcagggaaaagaggtctcaccatacaggatgacccccatggaccagaggtccacgcgggcgtcatactgccgctggcacaccatctcgggggccatgtagaggggggagccacggagcacgtgcttctcatcccacggggacatgtgttgtgcgaaaccaaagtctgcaggcaagaggagaggcagcagggcttgaattccagctgcttcagctcctgacttgtaaagcctcaccccaggctcctctccaccctccagacccgccaggatcaaccctatttccaagcctctgctcatcattaggctggaacaccctcctatatctgcctctggggtataaaacctacccatccttcccagctcccttgggcaccttttcctaggaagcccacctgatcacaccagctacctgcataagcccccaccctctcactgtccccccaggcttaggttctatcacagtctctggcctccagtgtcaattatccaaatcttatcaagggtcaccacctcctactcccccaccacacccctcctatgtggccacagatggagtcacagacttgagccccaattctgatgacagaccaagtcctgtccctgcccacagagggatccctgatgcttgtcacacgctgaaccctggcactgttcccagattgacccctaaacctggacacacagtgagtcccaactctggccacagactgagccctaactccacccattatgctgctggacttgagcatgggtagcctgagaaagcttccaccttttgatgacagggcccaaccccagacttcacggcctgtcactctttgaggactctatagagggctccataagaaccagggctgctgagtgagcccaggcagagggaggcctctgcactctccaaacctcatccctgctgtttcagacacagacctgccagttttaggtggggcttctccaaggagctcagtagaatgttctgtggcttcagatccaggtgagagatattccgttcatgcaggaattgcagggcgctagctgaggagcaggacccacgaagagagacagttcagagcccattcccgcctgcctctcgcctccccggctcacatctgcctcctcaagcctgcacaaccccagttcctgcctggctggtctaatgttttccatataagcaccaagatcacaccacttctaggagtttgccaccccacccgagtgcccaccctccttccctctgccccttcacaagtctccccacctctcagaagcttctctggatgccccagcccttgagatcctgctcttttccttggcacagcacttgagtcctacctacaggactctggaatgttctacaaggtccttatattatgttctatgtatggaagcctgaacaccccacagaggggttaccccctcatctctcccacagcgtccttgagcaagggttgagtgtatgagataaacaggaccataaaatttcaggctgtgcaggaggcagctgcaatgcgtgccaaggctctaagcctgggggaggggtgggatggtggggggcagagaacaagggacagagtgtcaggctggtgtcacaggcctttacctaattgctgcatgaagacacgcgccaccttctcaggcagaatcctgcgggtatggatgaagcgagacaggtcgccccctgcgcaaaactccatgatgaggtagatattgtcactgtcccactgtgtttagaggcagagaggcggcctgaagagagtgtcccttctccagctccctttggcagcggccccgccccaggctcacacctgaaagtctttcagctgcacaatgtggggatgtcgaatgcccttgaggatctcaatctccgtgaggaggttctccaccgatgccttgttcagacttttcttggctacacactttatggctaccacttcacgagtgtccttctgcgagacaggagatttggggactctgccttgagggggccaggacccttgtctgactggaaaggctctatctggttccctctgttcccccaccccgcccctccccgggtctacctactgcacaccagcaccgggcttcccagctttcccttgtgaggccagtgaggaatgctgattctggaatcctggcttcccgacacagcctcagcctggtcttctccaaccctcggctagctgatccatttctttgcattctggagtgctcccggcagaggcatgtcactcagggttctagaaccgcccactctgcctcccaactggctccagtcccagactcctcccagcccaccaggtaacctgttttgagcctgttcttcagccactgaccctgcaggtgggtgcaggtgcgctctttaagacctaagcgtggcagtcggctccaacctccgccgagggtcagctggggcgaggccggcctcccgcccctaactattcccacactgtcgctaacctctcagagtctccccggccggcaccagccgagctagctcgggcgggcacggggccatcggccggcacccaccttggcgtaggccttgtacaccgtggcgtacgtgccgctgcccaggcgctcggtgaggatgaagccgtccaggcgcgggggaccccagccgggccccgccattccggccgcctgcgcccgcgcgggcgcttcctcgctgcgggcggcggttccggcgggttgcggggcgggccgagcactgggtggctccacgctgcccccagcgccgcccgccggaaatgcagcgcgcatcggggacgcggatccgcccggctcccggcgcccctcccctgtctctgggcctcgccgggtcacgcgccccgccagttcctgcagggcccacgtggggatacggaggccccgcgagcctagaagttaacaacggaggacggccggcgtggtctccggggactcctagcgggcgcagaggcgtctagagatcgcccacgtgagggcgcgggcggcggagcgggcgtgtgtgggggcgacggcgtccgggaggctcccagggcccctccccaggacccgcagctctgaaaggagagctactggcacgagaaggcgcctttggaagaggccgcgttggcttcccaggcctcccagctgcttttcacttttctgaggaagggccttgacctatttattgcatcttaactgtccccgctctccaatcttagcagcggcgcccagcccctaatcctgtgggctgccccgtcctcccaagtccaccagacatgtggacccgtgttgtctgaaaatgtttttatttttacttaagcacaaaaattgagacgtaacatatacatttgtacatagaggggaaaaaataccagaaaggagttcataaaaccccagccgctgccagtatcattcagtggctggggcctgcggctgtctcgggcccagagccggaggctagttttgtgggaaggcaccccagtccacacacccactcggcagcctcgagggacagggtgctggttttaagggtggactcctacgtgtcccatcacagtgacacaccccccagggtgtgaaccagactccactgggtattagggggccctccgagagatggcttatcagtccctgctgagggatgcggttctggactggctggccctgcccttcctgaaagtctggatgctgctgatggggagcatgggcggggcaggtggcatctgaggcagagacaaaggcagccgtccctcggttcggggaggggggggggtagtcacagcaaacagggccaaaccaaccacaccaggacaggcagaccccaccctcctagaagacgctggacgctaggcaggacagcttggggtcagtgtccttggtcccttccagtccccaaatcccaaccaacggcattgtacattcagaaagtctgaagagagtaaggctcagcaaggggagggctccagagggctcaaagtgccatcccctgcaggagggtgcagggggataaagggctattaatccgtttctcaggaacacgaggcagggaagagcttaaggcaaccagccttctctggatccgtttatgaggcagagaagagcttgaggcaaccagccttctctggaagcctggagaccactggagtgacctggggaacagatctgtccaccagaacctgtgagaggcttattcccagcccaggcaggaaggactgggctgtgtctaagaagccagattcaggccaggcctgcagggtgggggagtcaaggcccaggaccctggcagaaagctccagctgggatgggcccaggtcagcctgtgatcccaactgtgtgggggtgtctgtgtgtgcacaggacgaagagaacttcagtcccactgcttccagagacaaaagaatcctaccaaaccatcaccagagaaggaaagagagctttgtttttttttgtacatagagggggaaaaaattccctgtccctcccgttccagggagagctggtcgctgagggaggaggaagagccacggcaagaaccctgccaggtctgtgctgggcacaaccaccaccacataaggcacccacggaaagtgcagctcagaaggcaggcgagagaaaggctgagggggagagaagagaggaggactaattcccctggaaggctccttgggcagcagatgaagcagctctgtggaaggttctgctgctgaagatgccctgggaaaactcctcctgggcctgctggaagctggcccctgtccgtcggtagagggagtgcacctggcgaagaggggtggggtgagagaagcctgtcctttgggcccaccaggaagccagccatccaggttatactcccaaaggggtcaccagaagcctggcactgcctgaccccccacccagatccctggagaaaggtactggacctttgggggcctaggatgcccaactgcagtggtgaaaaacatctcgtggcaagggcaggaaacggttgcctgcctcctcccatttgctgtcagccctgcccacaccactcacccgctgcaggaggaagactgagagcacggcacagagggtgaagaagccagccaccaccatcatgatgactgatatggccagggaatgattatccagtgtagacagggctgcaatccaaccgctataaagggaagaagaggccagagggagcaaagtgggagtgggctccaaaagtcagcataaggggctcttctccaagtggctgctgtgtcctgaccatcaccttggcatctccccacagcacagggagccctgtgagccagaagcccttggcctgtgaggccagacctccgtgaaggctgacaggcccacactaccccattcacaaggggaatcttctggttatgtgaggtctgaaagggaggatgtggttgctgccttcacagagtcagaagtagcaccgggctgggtgctatggctctcacctgtaatcccagcactttgggaggctgaggcaggaggatcgcttgagcccaagagttcaagaccaacctgggcaacagagggaggccctgtctccataaaaaataaaaaaaggccaggttcgtgcctgtaatcccagcactttgggaggccaaggaaggcagatcacttgaggtcaggagtttgagaccagcctggccaacatggagaaaccttgctctactaaaaatacaaaaattagctgcgcgtggttgcacacgcctgcaatcccagctactcgggagactgaggcaggagaatcacttgaacctggaaggtgcaggctgcagtgagccgagatcatgccattgtactccagcctaggtgacagggcgagactccaactcaaaaaaaaaaaaaattagctggctgtggtcatacatgcctatgctcccagctacttgggatgctgaggtaggaggatcacttgagcccgtgaggttcaaggctgcagtgagctgtgatcacgccacggcactccagcctgagcaacagagtgagaccctgtctccaaaaaaaaaaaaaaaagaaaagaaaaaagaaaaagggctgggcacagtggctcaagcccgtaatcccaacactttgggaggccaagatgggcggatcacgaggtcagcagatcgagaccatcctggctaacacagtgaaaccccatctctactaaaaatacaaaaaatgagccaggcatggtggcaggcacctacatagtcccagttactcgggaggctgaggcaggagaatggcgtgaacctgggaggcggagcttgcagtgagcagagatcgcggcactgcactccagtctgggcaacagagactccatctcaaaaaataattaattaaaaaggtagcactgggccgggcctttttctgctgctttgggggtggggagtatggaaagcgtggctgctcactcctgaggacccaccttctgtgaaggaggatcactggccaacttgctgtcacctgtctgagccccatgtcctcatctgtaaaagggatatcctcatatttcttgacatcaaaacttactacaaagctacagtcactaaaatagtgtaggactggcataaacatagacatatagatcaatagatcaatggaatagaactgagattccagaaataaacccatacacctattgtcagttaatttttttttttttttttttttttgagattgagtcttgctctgtagcccaggctggagaacagtggtgtgatcccggctcactgcaacctccacctcccgggttcaagtgattcttctgcctcagcctcccaagtagctgggattataggcacctaccaatgcgcctggccaatttttgtactctctagaaacaaggttttgccatgttggccaggctggtctcaaactccttcctgacctcaggtgatccacccgccttggcctcccaaagtgctgggattacaggcatgagccaccgcacccagccaactcaagccttctgattcccagtacaggtgcaaacggcagtcatgaatcacagcttttctaccagggtcttacttaggtaaggagtaatgaaattgggtcactggtcaaaagggaccagattaacaacagcagggcaagaagcatgaggggtggtgggagggcagcgtgcacttgtttggagggcaaggggaggcaacctttctctccccactgctctggacttgccagctctgccagagggaggggaccaaaatagcaccgcccttccaggctcaggctgtcagccaagtgccagtctgacctttctgcaatgctccctgtgcactggggcagaaaggaaaacatcagccatcagcttttcttttgagattaattttgagctgaggactgaggtaccctggaaactcaaaccagccgtatgctcaaagagggcagccagaagaagcctgtccaggggaggtgagggaaccgtctccttaagttacaaggcatctggaaaaagttgcagctcagagtctgcaaaggcctgggcatccatcagctttcaggagggtgtggcaggagaaaaggaagaggctgcaatccagtgcaggacactgtcatggtagcctaaagagtcaagccaagttcacccacaataccctggaaagtggagagcaagggaagatagtgtcttttttttttttttttgatacaggatctcactctgtcacccaggctggtgtccagtggtgcaatcatggctcactgcagcctcaacctcctgggctcaagtgatcctcctgcttcagcctcccaagtacctgggactataggtgcatgccactgcaacaggctaatttttttaatttttggtagagacaaggtcttcctgtgtttcctaggctgtctcgaactcctgggcttgagcaatctgcctgcctcggcctcccaaagtactgggattccaggcatgagccactgcacctgaccaatagtgagtgtcttttgatgcctttagtatcaaggagaaaaaaaaagtgagtggctactgatgaagaactggagagaaggcccaaagcagatccgagctggcccactcacccactccccgccatgggaaaagcagggcactggcggggctctgtgggagctagaaaacagggcaagagaggctgagtcccatatccaaagcctaattccctctgtgatgcccaggtctcacctgtcccccaggccagggatgccaaccaactggatgatgtagatccctatttgacaaaaaaatacaaagaagaacacaaagaagctgaaagagttgtcggacctgtggagagagagggaaataagtcacaagagggcttgggctgtgttcctcagcatccttacttggtgtgacatccctcctcactaggagccaggaggcagcatgggcaagagacagagctccaggggcccagccataccacccgtaaggacacgcacacaccccccaccataatcaagaagagcttgcctttcactgccttccaatttaaggggtcagtgcttgaccccttcctcaaagagctgataaagttgctcccccaaaggacaatataaagagcctaacactcctgcagtgagccaagatcacgccactgcactccagcctgggtgacagagtaagactctgtctcagaaaaataagtaaataaaaaacaaagaacctaacactccatctcctggagtacttgcgtttcataacaggcaagaaaaactaagccaatctcttaataataagtaaatctctatataataagtaaaatctctaataataagtaaaactaagtaaatctcttaataataaaactgtatgaggccaagaatttgagaccagcctagccaacatggcaaaaccctgtctctactaaaaacacaaaaattagctgggcgtggtggtgtgcgcctgtaatcccagctacttgggaggctgagacaggagactcacttgaacctgggaggcggaggttgcagtgagccgagactgcgccattgcactccagcctgggtaacagactgagattctgtctcaaaaaaacaaaacaggctgggcacggtggttcacactcgtaatcccagcactttgggaggccgagacaggtggatcacttgaggtcacaagttcaagaccagcctggccaacatggggaaaccccatcgctactaaaaatacaaaaattagccaggtgtgattgtgtgtgcctgtaagcccagctactccggaggctgaggcaggagaatcatttgaacccaggaggaggaggttgcagtgagccgagatcgcatcattgcactccagcctgggtgacagagcgagactccctctcaaaacaaaaacaatagaacttgaggatacgtggtaacaaagaacaatgagaaaaaaacaaaacctgtacatctgactggaagaaaaaaatatttgggaaacaggggacaccagacaaaactctctcacgagctgaggacttccatctctgtgtccttgagggctagatcacagtgagggttcagggcctccagtggtacagggatggttcagccactaccctaatccctcttcccagggcctgctgggctcccagccctgaaagcataaaccctgaggtacaattccagaacccctgggggtctgtaaggtgtatccagctatgttcccagtatctagcttaggtgttggcagtctttattgggaagcatcaatagtcatggagaaagagccctggagagcactcatctgatactaccagagaagcacaccttagagcctcagaagggagttcccaaagagcgtcccctccctcttcccagtaacggcatcagccagactgggagcagtgggatgggaggtcccttctctaggtctcctgtgcctggtccaaggacagggcccagagcagacctcaggtacagaaactgaggaacggggcccccaatctctgctctgggtgggaacagaggaacagaatgtagggaaagtggatttccctacattctattctgctctaagactcagatggggtcccagggcctatagcccttagcctgctacctgggatgccagccataaagtctcaccccttgccccggcctcactcacctaaaggccttatagatgggtcggtaccaacaaaggaaggcacagggagtgaagatcagaaaccacaggatggagaggccaaagtccactcccttggagctgttgcccgagaaccaggccaggcaggcaagcaggttcagaaacagagtcactgaatgcactggggaaggggacaggacagagttatgacttgtgccacagtggctgaggggctccaatgtggcagccactccctaggagaggtgaggttcatgctgcgaaggcagctgctgaaacagaggagcccgctctgtacctaggcagggatagttcccatatcctggttttctgggacctcaaaaccagggatcaaactacgttcctgagaggtgatgggacagcccgggtatctgaggggtgtggagggaggatgcagacccagggctggtccttggggaaggaagtctttctcttagcaatgcttttccctggccctggatggcccctgatggagctgcagggggagtctccttcctcacccctcagagttcacaggcctgtgggcagggaaggccttcacctaaggagggccttttagtgcagtgagctctgaaggaacttggaagcctctagttagtcccaccctccctgatcggtggtctggactgcccctttcaaggaggtttccagacagggggcagcctgtgggcagaggcatctccccaacccagcccaggcactgaggaaggctggagtctgctgaaagcctgtataccagggaggagcagccaggaccaagatggggctctcaagtcacacccaattcgcccttgcgcttggaaggcaggagtgggactcacacatccacagatagtagagcatcttgcatatccgctggtagtcggcagggatctctgtggagaaatcctgatagaagcagggcttcacagggcaccacgagggcagagggggccagttgttctgtctcactgggtagggcaaaaagagtgacgaggtaagggcccagcctcagaaggggcatcaaggtgcatgcacgccagcatagtgtatgggccaaaccagggttcccagaggggctccagcaagcggggcttggagtctgcatggagcatggagtgggacagaacaggataatggaacccaaagagataccaacaagctcacatggagataaaagaccccaaatgcactgggaaatacagacagctaaatggcctaagtgattatttttattaacaagcagcccataagtgtgagaactcagttcatcatcattagcaaggaattgtgggaccaaagcccctatgctatcaaagaatcaaggaatttgagagctaggaaggagtgcagaagtaatctacagccattacaactacactgcaggtctcctgacttgcaacttactgctcttcccaggaccagcatcctgtgatgagaagagccccacaaaactctaaggcagctcagggtgaatgctgggaggccctccgcacaggtttcaggacactcttctatgccaggcagggcagccccaggccccagcagcctcccttaccatgcaagttggctacagtgttctgcagctcccgctccttgcgttccagctcggcagctttcctgtccagttcttcctgctgccggagcaggcctgcctgggctgcagacaccacggcctggagagaacaggggaggtacagggacagccagacacaacaaacagaaacagtgtcagcctgggtaggcaggcagagaggccttgccccaggcagggacagccatcaaggagtcccagaagcagtccccgccccacagagtgtcttaggtaccagagaccaccttagagaggccaacctgtcttccactgcccccacaccttcctgaccccttggccatgactaagctgtcctctcccctcatccctaagcttgagttgggaaaactacccccattggcttctccacctcttccccatactgggtcaaggcagcgctcagtgattgtgacctttgggaaaaagacctcacaagaaactaaactataataagaaacccacagacccaagcctcatttgaagagcctggtggatgtgtgagaaggaaaacagtgcaagcctgctaacagtgagtggaaaggggagacacgtgaaggcagatggcgtgtgcctgagcctcaggatctgtacaagcaccctgccccatggcctgcccccaggagctgcctcctgaggtccccctaaactgcaattggctacaccccaggacagccccttaggtgtggccctgccctgcctggctttagtggcatgcagagtccacacttatctcctctccaggcggggtagagcctctgagtaacagtaagggactgactgtatgtgaggctgaacagacctggccccggggccctgcacctgctggcagctgctgccatttgggccaggttcctcctgaaggatgagactacagtcctttttagggagagatctcaaactggtcatttcacaggatgacaaaccaggcacatgtgtacacacacacatgtatacacacaccaacctctccaaaagctcttcaaagacctaaggctgacgtggagagccaagtttcaggcactgggggcggaagcaggagcagaactgaccccgctgtgccacgctgggggtcttgacctcctccaagtctgtgacgccagctgagaaggacccagctccctacagcccaccacccagctgcacagaaaggcaactccgcatgtaaggcctgcctcacctccacagggctctggggcctgggaggggtgtggggcaggctccgggtgccctgcccttcctcctgctcatctacattaggcctaccttcggaagctttcgcatgtagctgtctctgagaatactttctcctcctaggagcatctgcctctctgagagctcgctcactgccaggaattgggcaggcgggaacttgctggcctgtctaagcaggagctgcaacacacaactccaccatgggtcacgctcataggggcagcgaggggtgcagcgggagggcagtgaggcggcgcagtggagcaccaggcacaaagcaggcaagattcacagtatttggtgaagggacaaaggaagacaggaaggaaggtgagaattaatgaagttaaaaaaaagagagagattctgggccccaaggaagagagaacaagccaaaggcccgaggaggacctggaggggtacaacagggacaaatgccctctctggaggcaccgaggagcccggcctggtgagtagagcttatttctcagtggtggtggtgggtgggatggagggagtaaggatattaattggcagagcagcccctctacttgtaggtgaccagctccgaacaaattagcaagagggcccttagggggccaaggctgaaagctctctgcttgcccccagcctcagggctcagctactggtctggatgattccctcactggagagaaaaggccagagttctttgtcagcactacctggggggtcggctgggttggttccactgatggctggagaaccgctggctgtgaggacccagggagttgggtgacaggaactgttgtcgctgcatttgtctacatggaacaaatcaaaagacagaattgagtgggactccattagctggtgacgagggggcaaacccacagcaggatgagtgatgtgcccctgcctgtgaggggactccctcggggcctgcactgggccttcccctgtggcttcccagccaacaagcctcaggttcaggccatctgatccctaacccggcacccctgggctcgctgggtccagcacacttgggcactgccctgacctccttggggaggggccccggtcacagatcccaaggggagaattttacagagcgtttggtggctttgccatccttaccctgcctcccgggttcatgttaggactgtccctttgaggactgccgcttctcagagctgcttctgtccttgccaaggatccctgccccggacaccccagcaccaccctagagggccatgggacttggaaagagggcctgctcaccaacctctgagaaggggttgaattccgccaggccgccctgcggggcgttggtcagctgggtcacagagggatcctgagaaggtgaaaaaaagcccttagacacagtggagaaaatccgggccaggggccggcaggcgagccggtgacgcctgactgaagcagggcagctgatcaccctcccgggaccctgagaagcctctctggaagggtcctgtgcctgcctctgccacaccacagctgcggtcccttctcccttcccccttcctggaaaaggttcagcccagaagagacccagagcaagctttacccagaagcttgagagtacacaccacacaggctcctgttggtgccctatacagattcaaaatggttcatagtatttacctctagggagtgggtttttttttttttttgaggggtggggtgctgaggggcaagtgaatggggtggtgagggtagagacttactattgactttataacctttctgtactgttttacttattattcatttattcctctttttttatatttttttattttttcgagacagagtcttgctctgtcacccaggctggagtgcagtggcgcaatcttggctcactgcaaccttcgcctcctgggttgaagcgattctcctgcctcagcctcctgagtagctgggactacaggcggccgccaccatacccggctaatttttgtatttttagtagagacagggtttcaccatgttggccaggatggtctcaatctcttgacctcgtgatctgcctgtctcggcctcccgaagtgctgggattacaggcgtgagccaccatgcctggccattcctcttattttgtaaaagacagtctaaggtagccgggtgcagtagctcatgcctgtaatcccagcactttgggaggctgaggcgggtggatcacctgaggtcgggagctcaagaccagcctgaccaacatggagaaaccccgtctctactaaaaatataaaattagccaggtgtggtggcgcatgcctgtaatcccagctactccggagactgaggcaggagaatcacttgaacccgggaggcagaggttgcagtgagcccagattgtgccattgctctccagcctgggcaacaagagcaaaactccatctcaaaaaaaaaaaaaaaaaaaaaagtagtctaagtttctagaacaaaaacatgctgctggctgccagtactgattttattaaatcgggcacacttgctaagagcagagatatgatgagctgaggtgaaaattcaagaaaatgtttctgggtttcgggggttttttaaagtcttttcataaaatccaagaatgtcctcagaacacaaccttgtctccctttcccatctgatctctgcatggggctctgccatcctctttactgtgcccctgctggcctggaacagttgtcttcaccctgccctgccccaagaagagctcctccacaccctccccttcctagtaacagatgcagggctcaggtccagcttcacagccatgcctgggctccatgaggaacagccctgagggtggccaaattcagggctgttcctgcctgtggagacaccgcttgggttccacacctcaccccacacccctaattattaaaccagatgctcccaaacttcaggcccagcctcacctccactggaagcctctgcagagccagttcttttttttttttttttttttttttttttaagacagagtcacgctctgtcacccaggctgaagtgcagtggcatgatctccactcactgcagcctccgccttctgggctcaagctattctcgtgcctcagcctcctgagtagctgggattacaggcgcctgccaccacacctagctaatttttatatttttagtagagatggggtttcaccatgttgggcaagctggtcttgaactcctggcctcaggtgatccgctcacctcagcctcccaaagtactgggattacagatgtgagccactgcacctggcctccagttcttttttttttttttcctttttcttttttagagacagggtctcactctgttgcccaggctggagtacagtggtgcaatcatagctcatggtagcctcaaactcctgggctcaagcattcctcccacctcagcctccggagtaaccaggactacacacatgagccaccaggcctggctgatttttaaagtttttttgtagagatggggtcttgctttgttgcccaggctggttttgaagtcctaagctcaagtggtcctcccaccctgggctcccaaagcactaggattacaaatgtgagccaccttgccctgtccagatccaattgttaaatacaatgctaatattagacatagccacagagtgaccccctcagtttacagatgtagaaactgatattcaccatgatcctaggacccaaaatgggagctctctccttactctgaatatttatagagctgagggtcagcattgaatatgttctctggttttatcacagatacttcctcttatctcttatcttcccacctgagccaccagttcatagagggtatgaatgtctgactgcctccaggcatacagccagaactcactgtgtctggacgggcctcatactacagcctccaccccttccaacctcctctgcgacagactgtggctatgttcttcctgctgaacaccacctctgccctgatggctcctgcaacttggacaaagtgacaaggtgaagttcaggaggctctgtgttgctgaagaattggccttgaggttatttcatgcctgaatgaccagtggtttactaccagaatcatctggcttcctgcaaggaagatttggggcttggtatctgttcccctctcagactcagcagacacctagccaccgctgaagtcactgaaatcggatctaccatccacagaagtggctcctcgagtctgagtcaccagaggacagaggaagaggggccactctggtagcagtttcaggtaatggcaaacagacatctggccaaggtgcacatgtttaataggtgatctccaggcccacaaagagatgccatttcctttatgaatggcagacagaaggggactgtgatggggatcatagggtgactgccctgtccactctgatccctccctttttcctaaaatcttaaagacatggccttggactcctcaccgggctcctcataaacaaatctgatctccatgattaagttagaagctccctgcagccatgtgcatctgtgtctggttcatattctagttccttggtgcttggtgaagggcctatggcagcacagcagctcagcggtttgagaagacacgcagcacgctgtagggcctccctctttttagaaagcactgcccaagtgccagggcatagcaaacaggaggcacctgcatcacagcagtagcccaagggcctggaagcacgttgcctaggaagagcaacctaaaacgctgagacaagtggatattttcccatctaagaaaacctaggctctttctgaaagatgtgcgtggcttcaagacaagctgagccctggcaagaaagggagggaggaggagggactggggaaggaagctgacatttacttagtgtctacggtgtgccaaactcaccacacaatgatgctactgtgaaattctagtcaccccagaactagccactgtgtcgagttgtcagaaaagagggttttactggccttccttgacctggttcttcaaaagacttatgaccccctaatccactatttataatgactttactgctctcctggtacctagggtggtactagttatactccatacttgagagagctgagagagtcactccaatcagcttctctgttctgtggctcagctcgggaccctggctgagaaaagctacaatacagctcctcatttaaccctcacaacagccttatgaggaaggaatatttatattttgcagctggaaaagctcaagctcagagaggggaagtagcttgtcttaagatctcaggggtagtggctcagccagattttcaatccaagtctgtctccagggacacaagatggtaaagctgagtggggcaaagcatctcgaagcctggtacggagcctgacaaattgaaggcgctcagtgaatatgtggcaggatgaatgagccccactccaggaggacactgacaagggcttctgcttgtttccttgcttccttctttccttcaaagagctggttcttttttttttttttttttttttttgagacggagtcttgctctgttacccaggctggagtgcagtggcgcgatctcagctcactgcaagctctcccgggttcacaccattctcctgcctcagcctccccagtagctgggactacaggcacctgccaccacgcccggctactttttttgtatttttagtagagataggtttcactgtgttagccaggatggtcttgatttcctgaccttgtgatccgcccacctcagcctccgaaagtggtgggattcaggcgtgagccaccatgcccggtcctaactggcttttaaatgggtcaagtaggatggtgagggctaagtttcacctacaaggaggaataacctaaaactcccctgcagtgccactcagagtggctattgccctttactgaatttgtaacaaataaaaggctcttaacctcagttcttttcattcagcaaccagctacagtgtgaggaacataccacaatgcataagacacagctctcacccttctggagtccacaatctggtatctgagacaagtgggcaccccctgaaggggtgctggggaccacggcaaggtgcagagcaaaaaacaggaagaaggggagacacctcggtgggcttcaagaaaggccaggttgtagaaggaagacagacagcaaaggcccagatcagtaaggccccccaccactgcaaggcaggggggcacttccacatagctggggggtaaaggcagtgagggaagagaggcaggcagagttaggctgcagctctcccaggaacggccatgaaaaccacacttttttttttttttttttgagatggagtctcgctctgttgcccaggctggagtgcagtggcgcaatctctgctcactacaatctccacctcccaggttgaagcgattctcgtgcctcagcctcctgagtagctaggattacaggcacataccaccacgcccggctaattgaaaaccacacttgtcactggtttggaaacctcataccatgcgtttcacaggtgctggctgtctgagctctctgtgacttttccttgccttcccttcctgtattccacccaggctcccagtgtgaggtttatttcaggctccaaataaacacattaaataaatatcttatctcacggactaaaaaaaattcagggccagccgggcacggtggctcaagcttataatccagcactttgggaggctgaggtgagagggttgcttaaatccagtttgagatcagcctgggcaacatagcgagaccctgtctcttttttttcatagtaaaaataaaaaataagtttaggcctggcgcggtggctcaggcctgtaatccctgcactttgggaggccaaggcaggcggatcacctgagaacaggagtttcagaccagccaatatggccaacatggtaaaaccccatgtctattaaaaatacaaaaattggccgggtctggtggctcacacctgtaatcccagcactttgggaggccaaggcaggaggatcacctgagaccaggagttctagaccagccaacatggccaacatggtgaaaccccatctctattaaaaatacaaaaattggccaggcgtgatggctcacgcctgtaatcccagcactttgggaagctgaggcaggtgggtcacctgaggtcaggagtttgagaccagcctggccaagatggcaaaaccccatatctactaaaaatacaaaattagctgggcgtggtggcaggcgcctgtaatcccagctacttggaaggctgaggcaggagaatcgcttgaactgggaggcggaggttgcagtgagccaagattgtgccattgccctccagcctgggatacagaggaagactccatttaaaaaaaaaaaaaaaaaaaaagccaggcgtggtggtgcatgcctgtagtcccagctacttgggaagctgaggcaggagaatcacttgaacccaggaggaggctgcagtaagccaagatcactgcgcagcactgcactgcagcctgggcagcagagcaagactctgtctcaaaaaaataaacaataataataataataaataaattctggccaggcacggtggctcatgcctgtaatcccagcactttgggaggctgaggcgggtagatcacctgaggtcaggagtgtaagaccagtctggctaacaaggtgaaaccccatctctcctaaaagtacaaaaattagccaggcatggtggcgggtgcctgtaatcccagctactcaggaggctgcagcaggagaatcacttgaacccaggaggcagaggttgcagtgagccaagatcgtgccactgcactccagcctgggcaacagagcgagactcaactcagggaaaaataaataaataaataaattttaaaacattaaaaattcagggtcatgctgagaggcagagagtcagcaacactctggaacctctgtgaagtcctattggctttggagatgaggctgagtgtcacagagcacgaaaaagcaatcacccccagagtggctagctgggtcccagtgcacaaagagccacaattgaccttggtgctctctgacctgatacctgagaatctgtcctaagaaaatatcacaaaaacatgtaaaaatctgtacctgcaatgatattcataggaccaggacttacaataggagaaaaaagcacgaaacaaacatccaatgacagagaccacaggtatgttttggtacgcatccccttgaaggcccacaacgccactaagcatcacagctatgaagatggtgcagcaatacagaacaggctttctggtcgggcatggtggctcacgcctataatcgcagcactttgggaggccaaggtgggcagatcacgaggtcaggagatcgagaccatcctggctaacacggtgaaaccctgtctctactaaaaatacaaaaccaaattagccgggcgtggtggcgggcgcctgtagtcccagctactctggaggctgaggtgggagaatggtgtgaacccaggaggtggagcttgcagcgagccgaggtcacaccactgcactccagcctgggcaacagagcaagactctgtctcaaaaaaaaaaaaaaaaaaaagaaagaaagaaaagaaaagaaaaggctttgttacatcaatactaaattatgggccaggcccggtagctcatgcctataatcccaacactttgggaggccgaggcaggcggatcatttgaggtcaggagtttgagaccagcctggccaacaaggtgagaacccgtctctaccaaaaaaaaaaaaaatacaaaagttagccaggcgtggtggcatgcgcctgtattcccagctactttggaggctgaggcaggagaatcgcttgaacctgggaggtagaggttgcagtgagtcgagatcacatcactgcactccagcctgggtgacagagtgagactctgtctccaaaaaaaaaaaaaaaaaaaaaaaaaattcctggccaggtgcaatggctcacacctataattctagcactttgggaggccaaggtgggcagatcacttgagatcaggagttcaagaccaccctggccaacatggtgaaacctctcactactaaaaatgcaaaaattagcagggcacggtggtgcatgcctctaattccaggtacttgggaggctgaggcaggaaaactgcttgaacccaggaggcagaggctgcagtgagccgagatcacaccactgcactccagtctgggggacagagtgagactccatctcaataaataaataaataattaacaatggttgcaaatgactggtagaaatatggaagacttattttctgttttccaaattttctataatatggtcatgttattttgattttaaaaacacatatacataatcccagctacttgggaggctgaggcaggagaaccgtttgaaccagggaggtaaaggttgcagtgagctgagatcgtgccactgcactccagcctgggtgacagggcgagactccatctcaaaaaaaaaaaaaaaaacaaaaaacaaaccatacacacacacacacacacacacacacacacacacacacacacacatatttttaaaaagagaaagaaaaaaaaataggctggacacatggctcatgactgtaatcccagcactctaagaggctgaggtgagagaatcgcttgagcccaggagttaagaccagcctgggcatcatgatgaaaccccgtctctacagagaatacgaaaattaggccgggtgcagtggctcatacctgtaatcccagcattttgggaggctgaggtggacggatcacctgaggttgggagtttgagaccagcctggccagcatgatgaaacccagtctctactaaaaatacaaaaattagccgggtgtggtggcaggcgcctgtaaccccagctacttgggaagctgaggcaagagaatcacttgaacctgggaggcggggagattgcagtgagtcgagatcactccattgcactccagcctgggcaacagagtgagactccgtctcaaaaaaaaaaaaaaatcagccaggtctcgtcgtgggtacctgtggtcccagctacactggaggctgaggcaggagaactgcctgagcccaggaggtcgaggctgcagtgagccatgattgcgctactgcaccctggcctgggtgacagagacagaccccatctccaaaaaaaaaaaaaacagtaagtgagcaaggtacactcaggcctcgcttcctgccaccggctgcaatgtgtggaacccttcagaaaagcaagtctgagtcacctggccgggcattcaaggccttccaggacctggcaccaatcctctaaaggaatctaccctcaaaatgggacacttactatctcctcgcacctctgtgtagtctctccatacacaaaccattccatgccaagcactgggctagggaaaccaagaaagaaccttgattcctgcctttgagaagcaaatagtacagagaatcacacagaagccagggcaagaggtgatggcacatgatcagcactgtaacagggtgagggcagacacagggtgagacacagtgtgatcatagaggagagagtaattaagctgtctgggagagtcagggaaggctctactgagctggaatctgagttggatcttgagagatgaaagaaacctagcaaacagtaaagaggaaggcaagaaccacacttgcaaagccacaggatctttatttatttatttattttatatatgtatatatttttgagacggagtctcactctgtcgtccaggctggagtgcagtggcgtgatctcagttcactgcaacatccgcttcccaggttcaagtgattctcctgcctcagcctcctgagtagctaggattacaggtgtgtgccaccatgcccagctaattttttgtatttttagtagggacagggtttcaccgtgttagccaggatggtcttgatctcctgaccttgtgatccgtccgccttggcctcccaaagtgctgggattacaggcttgagccaccgcacctggccgagaatctttaaaaagagcttgcatgtgttcagaagagagaaggttatggaggctgtggaggggtgtgtggagagaagagtctggagtatcagggaaccagtctgaagagggtggggccagattgtgggactttggatgttgctctacaggcaacggggaacaactagagatttgcagtcaggggtgacatgatcattctatcagcagtgaagggagtgcaacagcatggtaggacaacagcgggaagactggctaggacacaactgtcaacatgggtgaagtgaggaccaaattgagggacagcagctggggatggagaagaggaacaagagggacttcagagaccttcctcacatcaatcccacaggctcagcaactctctgggttggcctgggaatggaaagactacagggcaggaaagggaagggaaagaatagagttgaggccaggcacagtggctcacgcctgtaatcccagcactttgggagggtgaggcaggtggatcactagaggtcagaagtttgagaccagtctggccaacatggtgaaaccccatctctactaaaaatacaaaaattagccgggcgtggtggcacattcctgcaatcccagctactcaggaggctaaggcagaagaattgcttgaacccaggagaggtggaggctgcagtgagctgagatcacaccactgcactccaccctgactctatctcaaaaaaaaaaaaaaaaaaaaaaaaggccaggcacagttgctcacgcctgtaatcccagcactttgggaggccaaggcaggtggatcacctgaggtcaggagtttgagactagcctggccaacatagtgaaaccccatctctactgaaaatacaaaaattagccgggcgtggtggcatgcgcctgtagtcccagctacttgggaggctgaggcaggagaatcgcttaaacccagggggcagaggttgcagtgagccaagatagcaccactgcactccagcctgggcaacagagcaagactttgtctcaaaaaaaaaaaaaagaaaagaaaagaaaaaagaaagaaaggagtgcccaaaataagtgactgtgggagaggaggaacaggtttttcaagggtgggtgtggtggggtagggagaggatccgagaagatattgagtcaggttggagatagctgtggaatatttctggttggaaggattgggaaggtgcaggtgtgagtttgaaatagtggtctgagctcaggaggaagctgagaactagagatctagatctgggatcgctgaaatgtggatgctattctgaagtcatagaaatgaaggtataaagtgagaacagggtaaacccagcactttgggaggttgaggcaggattgcttgaatccaggagttcgagactagcctgggcaacaaagtgagacctcatttctccaaaaaaaaaaaaaaaaaaagccaggcacgatggtgtttgcctgtagtcccagctacttgggaggctgagatgggaggatttctggagcctaggagattgaggctgcagtgagccgtgattgtgccactgcacttcggcctaggcaacacagtgagactctgtctcgaaggaaggaaggaaggaaggaaggaaggaaggaaggaaggaaggaaggaaggaaggaaggaaggaaaggagggagggaggggaggggaggggaggaaaagaaaagaaaagaaaaaaaagaaagacaaagtttaagttctgaacttccaatagcatgaataaaaacaaaaaaagaactctggaatactcctaaatgtatgagacaggaagtgaaaacaggctgaggaaggtgagaattatcaggataaaagaggccaaggatggagagaatttcaagagactggccaaacaagcatgtgagtcacaagcagcagacgcatcccaggctcatgactccctaagagaccattaagatctaagagtgaggacatgcctgggggtgcaggggtaagagtggacacaggagtacagggatgacagcaagcaggagcgacttttggttcttggcactacttcacccaaaaatactctgttttctggccgggcgtggtggctcacacctgtaatcctagcattccgggagaccgaggtgggtggatcacctgagatcaggagtttgagaccagcctgaccaacgtggttgaaaccccacctctacgaaaaatacaaaaattagccaggcatgctagtgcacgcctgtaatcccagctactcgggagtgtgactctgtctcaaaaaataaatgaataaccctgttttcccatctgccaggctttctgctttcagtccaagccctctgtgccacaggtctctgcccttcctcctgagagccctcccagctcctttggacactgccctgatcccacttgtgatgtgctgtcactctcagtgagcatttattttctttcttttttttttttttttgagatggagtctcgctctgtcatgcaggctggggggcagtggtgcaatctcggctcgctgcaacctccgcctcccgggttcaagcgattctcctgcctcagcctcccgagtagctggaactacaggtgcccgccatcacgcctggctaatttttgcatttttagtagagatggggtttcaccatattggccaggctggtctcgaactcctgaccttgtgatccgcccgccttggcctcccaaagtgctgggattacaggcgtgagccactgcgccccagcctcagtgagtatttcttagctctcctgccagaagccattgatcacatactgtgctcatttaccatggtctcctgcacaggcctgcagagcagcatgacctcagtgatgtgcactaacgtgaacatctcaaagcagcacttgctggatgggtcacagtttgcaaatgtgcacagcactcttctctgaatgaacagcaagtaccccttgtttgtcctggttaaatattaccatttctctgaaattaagattatcttaccccaagtgtttccaaagaagacttaacggaagagtcaaagttcacctatctctctacccaagttttaacacccagcctggctccaggtgccaaccataaaggcaggaatcctatctgggcagctgtctgtagtcacagtgaagctgtaagaaccctgccattttcaaatttcttgagacaatgctctgttacacaggaaagttctaccaggtccatctggttattccaagaattcccaaagttatggtcaagctggggccaaccctctctgggaaggtcccactgtctgcacagggaaattcaagtaactttgttcacacccaaatcacgtttctgccaccacttcttccttccacaggagagaaatatttcaaatccttgggaagcagccacaacactgagattatcttttaactgcaaggaggcaatgtgtgaaagtgatattgtgtgacttggcaacttacaaacactgaaaggttttctctgttcaatgccaccacctattccacttcctctccttgagatcaatgctgtctgcctgggataatctggcagaagtgctgagtgggaaagcagccctaggcacttgcctgggtggtctgatttttagtggactgctgaaaaatggacagtacaatgactccctttagctttccaccccttcatcacctgacaagacttaatgagaaacttttgggagcagacaccctggatcattccaaagcagagaccgaaatactcagagggtacaaagcagctgccataaccaacagaggaattagggtgtgccagtggaggctgtgaaatcaacaacacttggcttgcagtttcctgcttcctcctaggaggtgggcaaacctctgtggcacactcatatcttaacttcccattcacagctctttctgtgcaggaagttttctaatcatcccgatcataaccacacgcaaggaagaggtcataaaagcacatgcccacagtgcggggtggaagcaggcacttaataaagaaccttggatgaggaagtcaactaaatggtgcactgggagtttcaaaggatataacgactgagcagaaaacagattccatggtcgaataaccttgagaaatgctgggtcaaataaagctgagccaatgtctttttgtaggatttctcagagcctttaacaaactaacaggccttgtgaatctttattttggtttgtttgttttttgagatagagtttcactctattacccaggctggagtgcaaaggcactcctcagctcactgcaacctccacctcccaggctcaagtgatccccctgtggcagcctcccgagtagctgagcccacaggtgcatgccaccacacccagctaattttttgtatttgttgtagagatggggttttgccatgttgcctaggccattctcaaactcatgacctcaagtgatccacctgccttggcctcccaaattgctgagattataggtgtgagccaccatgcctggccaagccttgtgaatctttgaaaaaacaaacaggctgggcacagtggctcacgcctgtaatcctagcactttgggaggctgaggcgggtggatcacctgaggtctggagttcgtgaccagcctggccaacatggtaaaaccctgtctctagtaaaaatacagaaattctgagcgtggtggtgggtgcctgtaatcctacctactcaggaggctgaggcaggagaatcgcttgaacccaggaggtggagactgcagtgagccaagatcgcaccattgcactctagcctgggcaaaagagcgaaacaccatctcaaaaaacataaacaaagaaacaaaaacgaaataggtagcaattcccaaacctatttgaccacagaaccatgagcacctttcaggactggcattactcagaatatatattgctttaaagaactgtcttaaaaagcccaagaattgttctccagtggaaaaaaaaaaccaataataaaaaataaaaaaattaaagaacaaaagcacaagatctgtattattccatcccctcacactggagaaaaaatgtagcttagctaatactaatttgttactttcaccactcccagtactctcaagaatggtgacaactgtgatgatgttacattccattctttccttagccagcctaaaatagccccagtgcagtttaacaccaatgtctgagcttcaaaacctttaaaacagccctgtcctgggaatgagacccaggtcagcaccttcctgctgctaaacaactgatgactctggcacataccatcctcattgaggtcttggtttcctcatctctaaactgaagaggttagaatagagttctaagaatgttctcagctcttaacagtcaactatgagctctgaacactaggtatatttttgcaatccaccatttctgtcactgcatgacggaaataaaaacgactgttctggagtgtgactaggtgtgacagtttctgagtctatcgcctctccacctgctctctcctgagcttggtgccaacaccctgagtaaatgaagctgggctcacacccaggcacccaagggctacacctcccaacgtcctagccctggcagtcaaggaagcagacatcaccatctcaaggaaaaggtgggcagctctgaccaggagaaggttcagaggcctcacatccaaagctgtttctccccacaccactgtgtgccaagaggaaaagcccagcccaggatgaggaggagcaaatcgcagccagccagccagctttcttcttcccacccaggactccccaccagatgtggctggttgacaggaccacagctgcttcctgtcatgccatatcctggggcttcctgatggacagactgtctcgctagaatgcagaagttacttctaccacagtttgcacagtcatttttggagccagagatgaggtttaagactttcaagcagctattaatacagggtagaactatcttgccctctgctaacactggagcaaagctctctgcatttttagacaactgacttcctctctgtcagacagcagcagactttttatttctgattctgagaggacaaaaaaacacacataaaaaatggaaaatcatcacatacaacatacaccataaggctacaagatcctactaaaacccaaaccccagtattatacagcagttttgtaattaaagtctgttaccagaagacattggcagaaaaaaaaaatgcaaatcttctttctttactcaatagagatgactgtttgccttacataagagacaaggtccttgcaaacgctctgtcaagaaacattaagctacgagaggaatgttcagaattccctgatgttctaaggaacaagctatcagaatttgccctgagggctcctgttggctaagacaccttgagaccaagaaagaagcaaaacattttcactctcctgacagcgtataattatttagttcaagtctcctttgattttgctctgacccttgaagcgattcaaagtgggaaaactcatgctgtgaatgacaggaaggactccttcaaggacttctctgacacctgcaggaaacttaaaagctgccaatgaccaaaataaaggacaagcagggtgagttaatgtgcctggtgacatcctgacagagcagaatatcagggctcataattcaccagtcagcacaaacaagcttccctagaacgggttttgagcagacgtgaaacaagaggcataggagctctggaggtaacagttcagcccctcatggtggaaaaagatcatccctgtgctctcagctgaaaggcagaaaggtgtgggctttaagtaggaagactgtcctgtggctcatgcctgtaatcatagcactttgagaggctggggccagaggattgcttgagaccaggatttcgagaccagcttgggcatcacagcgagaccccttctctacaaaaattttttttaaaaggagtcaggcccagtggcacattcttgtagtcccagctactcaggagactgaggtgggattcaaataatcatttgaatcctggaggtcaaggctgccatgacctccactgtgctacagcctgggcgacagagtgagaccctgccttaaaaaaggaagaaagagggctgggcgcagtggttcatgcctgtaatcccagcactttgggaggccgaggcaggtggatcacctgaggtcgggagttcgagaccagcctgaccaacgtggagaaaccccgtctctactaaaaatacaaaattagccggtcgtggtggtgcatgcctgtaatcctagctactcaggaggctgaggaaggagaattgcttgaacccaggaggctgaggttgcagtgagccgagatcgcgccactgcactccagcctgggcaacaagagcaaaactctgtctcaaaaaaaagaggccaggtgtggtggctcacccctgtaatcccagcactttgggaggctaaggtgggtggatcacttcaggccaggagtttgagaccagtctggccaataaggtgaaaccccgtctctactaaaaatacaaaaattagccgggtgtggtggtgcacacctgtaatcccagtttctcgggaggctgaagcacgagaatcacttgaacccaggaggctgaggctgcagtgagccgagatcgcgctactgcactccagcctgggcgacagagcaagaattgtctcaaaaaacaaaacaaaacaaaacaaaaaaaaaggaaaagaaagaaagcaggaagattgtttcttccttgattgctgttcaaaaggtcaggccaggcgtggtggctcacacctgtaatcccagcactttggaaggccgaggcggatggatcacctgaggtcaggagtttgagaccagcctggccaacacggtgaaaccccgtctctactaaaagtatgaaaattagctgggtgtggtggcatacgcctgtagtcccagctactcaggaggctgaagcaggagaattgcttgaactcgggaggcagaggttgcagtgagcggaaatcgtgccaatgcactccagcctgggcgacaaagcgagactccgtctcaaaaaaaaaaaaaaaagtcaggccagctcacacgtcagtgcatctcaactatgttgccaccacacacagttccatcagacaaacgttccctgtgggtccagaatttttcacagtcccccgcacctctcctctctccctaacccgggctctcctatctggtcaaaacccactccaaactagacccatggccaaaatgtggaattcttatcaaggccatttttcaacttgggctaccttcccgccctctcccatctttctttccctgacaaatctcaggggctctcctgtactttatacactagtttggctggtggtggagcggtggcaggtgtcctgggcttttcccacatttttcccctccaccagaggcttcaccacctcctcatatgttgctgtcaccccctcttctaaagtgactcaagacaggtgtctatccaagaatgagggaatgcgatagccacatttcgcttctccctgacgctaggagacttccggaagggtccgaccgtacctgctccagtccccttccctagcacagcccagcctccgggtgctagaagaccccactgtctccaacacttcagcgccccgcctcctctgcagttccacctgctgctagtcgcgcccctcacgcgttacgataggccagacctcaaagcccgctctcccattgggcagatgacccgtccctcctacgccacgtctcccggctctagcgagaggcccgggcggcggccgtgggccctagggaaatctgagagctggatggcgggagaggggctctacctggaaggggtttacatccactgggtccgcgaaggggttggtgtcgaaagccgacatggtgatcgggggccagcgggcgaactccgcgaacgctgctgcctccgggcacccagacccagcggcgcttcgtgtagaccctccacttccgggagcgaggcagcggttctggcgcaggcgcgatgccctcccccgagggcgtggccctatgacggcaccggggtcgctccgccccccccccccccccccccgcccagcccacaatagtgcggtgggtgggcattcggcttccgtccacatcttcgctctgctggggattcaggggtcttggctgcgcggagcgtctacggagccagaggcgtggccggagtccttcccaactgcctatcaatctgacaccttccaattttatgtttctaaagcaaactctcaaaagtgggacaggaaacagccccttcacttctctgtagaccaagtttgggaagaagtccaaactgatccctgggcaaaggacaggggtgacaggtgaggccagaggccttgggagaactaggaaagcgcttcttctgcagaacgtgctcggggaaagagaagtgccaggaccatccagcagtcctccacccgagctgagcctgcttcttctagggctgctcgccctctgatgtcgtttcatcgttttagggacgagggttcctgggcccatcagctttgggacctgagttgggacttgaacctggacatcaaacatttatgaagtgactcacggaattcagcaacacagcctcaatcatgggggaggtggctgcttcactctccacagctccgctttcccccgcccccgccccccacagggtctcactgtcgcccaggctggagtgcagtggtgcaatcatggctcactgcagcctcgagctcctgggctcaagcaatcctcccacctcagcctcctgagtagctgggactacagctggtcaccaccatacccagctaatttatggattttttgtagagatggggatctcactatattgcccaggctcgtctcaaacacctgggctgaagtgatcctcccgccttggcttcctaaaatgctaggattatactcatgaaccactgtctggccaaatccaccttatttatttggatctgtctggtattattcatctctgctgtcaccgaatcccagccactgtcatttttaccctgaactaatacagtgctgttaattggtctattgttcttcatgttgtaatcaaagatatgtttaaagggggcaaaattatcacagaactttgttaaaatttttcaattaatttccataaagggctgggtgcgtggcttatgcctgtaatcccagtactttgggaggcagaggtaggaggatcacttgaagccaggagttcgagaccagcctaggcaacataccaggaccctggctctacaaaaaaaaaaaaaaaaaaaaaaaaatatatatatatatatatatatatatatatatacatatacatatctcacacacacacgtaattagctaggcatggtggcctgtgcctgtactcccagctacttgggaggctgaggcaggaggactgtttgagctcaggaggtcaaagctgcagtgagccatctttgcaccactacactccagctgagtgacagagtgagaccctgtctcagttaaaaaaaaaaaaaaaaaaatcaggccaggcaaggtggctcatgcctgtagtcgcagcactttgggaagccaaggcaggcagatcacctgaggtcaagagttcgagaccagcctggccaatatggtgaaacctcatctctactaaaaatacaaaattagctgggtgtggtggtgcacacctgtaatcccagctacttgggaggctgaggcaggagaatcgtttgaacctgggaggcggaggttgcagtgagctaagattgcaacattgcactccagcctgggcaaaaagagtgaaactctgtctcaaaaaaaaaaaaaaaaaatcataaaggcccaaattcttagtttgtcttcaaggtcctaaaggatctgcccctacgtttctccccttctgaccccttctagcccccaacccccacccactgttccagccatgcaagttcttttcagttgctcaaaccttccttgtgccctcctgtctcagggcctttacacatgtgttccttctacctggtatgcacttaacccatgccccactatcatcctctggttaacctctccttaccctttaaatgcaagttcagatgcctttcttcaggagtagcttcccttcactctcttggttacatcatcacctcatacccaacataagctctcctattgccctgtacttttccttcacaatacccattgcagattgtaattaatactagtataggtggttctttatgcctgtatcctccgctagactgaaagctccatgagggtagggctgaggtctgttttgctcactgttgtgtttctgtcactaacatagtataaagcacatgatacacatttattaatttattttttgtgggtttggggttttttttttttccagacaaagtctcactctgtcacccagggtggagtacagtggcatgatctcagctcagtgcaatctccgccttccaggtccaagagattctgctgctttagcctcccaagtagctgggattacaggcactcaccaccacacccagttaatttttttttttttttttttgtaattttaatagagactgggtttcaccatcttggccaggctggtcttgaactcctgatttcaaatgatctgctcgcctcggcctcccaaagtgctgggattacaggcgtgagccactgtgcccagcccacatgcatcatacacatttagtaactattttactgtttccctgcatccatttattttgtttgtttatttagaaacagggtgttactttgttgcccaagctggtgttgaactcctggcttcaattgatcctgccacttccgcctcccaaagtactgggcctacaggtacacaccactgcgcctggtcatctgtttctttcaccttcctctcccatctaaatcctgactatcctttagggtttagctcagctttacttcgggaaatatctgcacacaagtgggaggatggggaaggatccattttgtatccccttagaaattgcctgtccccaagcctctatggccacccctcaagggcagcagacagatctttgctgtctgctctctgcagcctcagaggagaacagtccacaccccacaaggcagtcctgcctgctctgggtctgctgcagccaagtacaatgctgggctggtgaagaaagaatgaaacttaattacaaccaatgtggtggctgcccatctatctgtctaattccctacaagagagacatcattcatttattctacaagagaggaggtatagagaatgcagctctttgcttttaaaccagttatttcacctctccaagacccatttttctcatcttgatcttgaaaccacctttgcaaaaattataactgaggaaattatgacagtgggagagattagacctaacctactccatcttgcttctgacctttaagtggtccttgttcattcctgggtgtaggctgaactaaccttgggaaggaatttatagtttaactctgaaacaaaattgattatagcccttttccaaaaaaaaaaaaaaaaaaaaatcccttcttgcctggggaccagtctgcctttctggactaataaattagctacaagattagaaactatggtttagggaccatgcagccttcagctgtgagtctgaacctccccagattgctcctgagaataacatcactattgtaaaacctaagatcagtgcttgagatattttgcagaccttgcacttgatggatctgctgacaccacctccaacagtaatgtagctcagacagttctgccatcccactcaggaacagaagacagcaagaaaaactcacttcgaccccctatgattccatctccaacccgaccaatcagcactccctacttgcctagcccctaccagccaaattatctttttttttctctctttttttctttttgagacggagtcttgctctgtcaccaggctagagtgctgtggcacaatctcgggtcactgcaacctccaactccccggttcaagggattctcctgcctctgcctcccaagtagctgggattacaggcatgcgacaccatgcccggctaatttttgtatttttagtagagatggggtttcactatgttggccaggatggtctcgatctcctgacctcgtgatctgcccgcctcggcctcccaaagtgctgggattacaggcatgagccaccacacccggccaaattatctttaaaaactctgatcccagaggctgggcgcagtggctcacacctgtaatcccagcactttcggaggccaaggcaggtggatcataaggtcaggagttcaagaccagcccggccaagatggtgaagcctcatctctactaaaaaatacaaaaaaaattgctgagcatggtggcagtcgcctgtaatcccagctactcgggaggctgaggcagataattgcttgaacccgggaggtggaggttgcagtgagctgagatcgtgccattgcactccagcacaggagacagagcaagactccatctaaaataaataaataaataggccgggcgcggtggctcacgcctgtaatcccagcactttgagaggcctaggcgggcagattatgaggtcaggaattcaagaccagcctggctaacatagtgaaaccctgtctatatactaaaaatacaaaaaataagctgggcatggtggcggggcgcctgtaatcccacctactccggaggctgaggcaggagaatcgattgaacccgggaggcagaggttgcagtaagccgagatcacaccattgcactctagcccaggcaacagtgtaagactctgtctcaaaaataaacaaacaaataaattaaaataaaaactctgatccctgaatgctcaggacgactgatttgggtaataataaaactccggttttctgcacagctggcgctgcatgaatttactctttctccattgcaattcccctgtcttgataaattggctctgtctaggcagcaggcaaggtgaagctgttaggtggttacaatctcacagggttgtcttgagagttgatgaaaaaagcagtgtttttttctccctcacaactacagactccctcaacagtcattcaacacaatacttctgacacctgacgtgtgtgggttgtttctccacacatcaagcaattctgcagcagacactaactgggtgtccttcaatttaatttaattccaacactttctacctggagatagtgtcagattgtaactgcagtaagttcattgccagatgtgcaaatcaatacgctgaggcaccgggttgcagcaaagaaaaaggtttaattgtagggcgacctaaagaggggatgggagaaaaccccaaatctatttccccaaggtgtttagggttagggatcttttttttttttttttagatggagtctcactctgttgcccaggggcgtgatctcgactcactgcaacctctgcctccctcaggttcaagccattctcctgcctcagcctcctgagtagctgggattacaggcgcctgccaccatgcctggctaccttttgtacttttagcagagatggggtttcatcatgatggccaggctggtcttgaactcctaaccttaggtgatccgcctgcctcggcctcccaaagtgctgggattataggcatgagccaccgtgcccggccgggttagggattttaaaggttttttttttttttttttgagacagagtctcacattgtcgcctgggctggagtgcagtgtcgcgatctcagctcactgcaacctctgcctcctggcttcgagcgattctcctgcctcagcctcccaagtagctgggattataggcgcccgccaccaggcccagctaattttttgtatttttagtagagacggggtttcactatgttggccaggaggctggtctcaaactcctgacctcgtgatccgcccgcctcggcctcccaaagtgctgggattataggtgtgagccactgtgcctggcttggtttgttttctgttttttttgagacagggtctttcttgctttctggcctaggctgaagtgtagtgaagcaatctgcagcttcaacctcacaggctcaagagatcctcccacctcagactcccgagtagctggaaccacaagagaacgcccaccatgcatggctaatttttgtattttttgtagagatggggttctgccatgttgcccaggctggtctcaagctcctgggctcaagcgttccaccttcccaaggtgcgtgagccactgtacatggtcaggagtctttaaactgtttggcatcacttgttcccccagaattaaggatctgaaaaacatcttaagcaattcttttttttttttttttttttttgagacgcccaggctggagtgcagtggcacgatctcggctcactgcaagctccacctcccaggttcacgccattgtcctgcctcagcctcccaagtagctgggactacaggtgcccaccaccacacccagataatttttttgtattttttagtagagatggggtttcaccgtattagccaggatggtctccatctcctgacctcgtgatccacccacctcggcctcccaaagtgctgggattacaggcgtgagccaccgcgcctggcccatcttaagcaattcttaaacaaaagctttatgattctaatgtcagacatcctatttataggaacagtgtggatgcagatggtcagtatctagggctacggtgacttttggttacagggaggtggccctaagtgcagactgagtaatgcttaattttattttactttatttatttatttattttgaaacggagtctcgctctgtcaccaggctggagtgcagtggcgtgatctcagctcactgcaacctccgcctcccgggttcaagtgattctcctgccacagcctcccaagtagctgggactacaggcgtgcaacaccacgcccagctaatttttatatttttattagagacagggtttcaccatgttggccaggatggtctcaatctcttgacctcgtgatctacccaccttggtttcccaaagtgctgggattacaggcatgagccaccgcacccggcccagcctgattaatgcttaattttaaatatatttgtcttcttttttttttttttttttgagacggagtctcactctatcgccccagctggagtgcaatggtgcaatcgtggctcactgcaacctccacttcccgggttcaagcaattcacctgcctcagcctcccgagtagctgggattacaggcacacgccaccacacccagctaatttttgtatttttagtagagatggggtttcaccaggttggccaggctggtctcaaactcctgacctcaggtgatccacccaccttggcctaccaaagtgctgggattacaggcgtgagccaccatgccccgcctaatgcaaattcttggtaaacaacataggaactgcctcttcttttcctttaaaaacccattagtggctgggtgcggtggctcacgcctgtaatccctgcactttgggaggctgaggtaggtagatcacctgaggtcaggagttcgagaccagcctggccaacatggcaaaaccctgtctctactaaaaatacaaaaattagctgggcatggtggtgtgtgcccgtaatcctagctactagggcggctgaggcaggaggatcacttgaacctggaaggcggaggttgcagtgagccgagatggcaccactgcactccagcctgggcaacagagtaagactctgtctcaaaaaaaaaaaaaaaaaaaccattagtaactgttgctaattggagcatatattaagggcaacttgaatccatgctcctgatcacaggcctcaaatttggcccaaataaacactacttatattaaatttgtctaagtttcttttctctttaggtcaacaaaagatattacaaatgatacagatagccagatggaagagatgcatggagcaagacccgtgggaaggggtgtggtgtttccatgccctttctggaggaccaccctccagtgacctccagggaccatgtgttcagctatctggaagcttttttttttttttgagacggagtctcattctaggttcaagcgattctcctgcctcagcttcccgagtagctggaattgcaggcacgcaccaccacacacagctacttttttttatattttagtagagatggggtttcaccatgttggccaggctgctctcgaactcctgacctcaagcgatccatccgcctcggcctcccaaagtgctgggattacagggattacaggcgtgagctaccacgtccagccttggtggttttttttttttttttttttttgagacagggtctgctttgtcgtccaggctggagtgcagtggcagggacatggctcactgcagcctcgaccttcctgggctcagactaaactcccacctcagcttcctgagtagctaggactacaggcatgtgccaccatgtccagttaattgttgtatttttttgtagagctggggtttcgccatgtagcccaggctggtcttgaactcctgagctctagtgatctgcccacctcagcctcccaaagtgctgagattacaggcgtgagttaccgcacctggctgacatatgcccttgagttgtcttccagaaacccagacccctagcagatggaaaacacccactgctgtcacatagaccccagataagggggaactgaggactgaactctggccttacccagtgtataactgaggcgggatttttctcagcccctttgtcagccggaggtcttcagctggcgacacccctgcccgggccttgctcaggcctgggcttgctgcaggagatgccccgtctactcaggtcactgggccacgcctggcttccactccaatgcagatccctgcactcagcccctggagggaggaggtgtgagcaagtgtggagtctgaccaccacaccaagcacagacacaggagtgggttccatgcagggcttgaggctggaccaggcatgttgcactgaggggaaagtggtggtatatgaacagggatgcctatgaccccaaagccccagagtgggtattacagcatgctaatagctcttttggtcccactgtctgcagcctgatggacagcggctgatgtgttaacagctctgtcagtcccattgccccattccagcctatggctccagtactggcttggccctgccactccttcccatcacatgaggcacctgacctcagccagtggaaggcagaggaccagtgttacagcctctttttacctacattcggtagtcctaagttcttgtcccgtgtccaagaagaatgaggttatgttgacgattgaagggtgagggggacaaagagctttactgagtgacaaaagagatctcagtggagaggaggatgtgagggcttcccccacctgaagttgggtggtctcttactcggtgtggctgtgtctgcggcttttataggctcagaatggcagagtacatgctgattggtttgtgagtatgcaaaaaaggctaaaacaaaggcatcactcaaaggtgggcacaacagtgtaagaaaccaattagggaagggtaggtatatgtaaaataggtgaggggtggggatcaatcagaggaaagtgcaccaaagtggaagagaggttctcactccagtccgtggatttacccaggacttgtagcttggctttcaggctttaaactgtctttggtttgaaggttggttttcaccggggacctgtccctgtctgcctaggatttgtctgcctcctgccactctcataacaataaaagttagctgcagccaggtgcggtggcttacacctgtaatcccagcactttgggaggctgaggccagtggactccttgggctcaggaatttgagaccagctgggctacatggcaaaaccccgtctctataaaaaatacaaaaattagccaagtgtggtggtgtgtgcctgcagtgccagctactgaggaggctaaggtgggaagatcacttgagctcaggagatggaggttgcagtgagatgtgaccttgccactgcactccattctgggagactgtctcaaaaaaaaatgctgctattatagcttgaaccctcagctgggcactggcagaaatgtgaagctgaattagacatatagtctagaagggaagagagagaggaaagtgtattgtcactagataatagagtgtgatcagttctactagagattgttaacctaaaaagaagaggctgagtcacaaaattaaagttacttgattcacagtgagacagctgtccataagactcatacccaagtaaccttggatatgagctctgttaggcctttgtttcaagttttttttttctgtttgtttgtttgtttttccgagatggagtcttgctctgtcgcccaggctggagtgcagtggtgcaatctcagctcactgaaacctctgcctcccgggttcaagcgattctcctgcctcagcttcctgagtagctgggactccaggcatgcaccaccacgcccagctaatttttttgtatttttagtagagacagggtttcaccatgttggccaggctagtctcacactcctgacctcgtaatcctcctgccttggcctcccaaagtgctgggattacaggcatgagccacagtgcccagccacaagtatgtttttaaaggtaaaatgcagggacaaggagtgggctgatacagtcttttgtcaggaattctcattggtttactgaattagcactgattagtgattggccatacattgttaagctgtagggtatgggttacagtgtccattgtggtattattaggttaatttatacctagttgtggcaatagcaagcagtttcaagagataaataaatagctcaaaaggaaggaagtagaatgtggttgctgtctcattttaatgttgttactgaattgaccttggatctgctttcctagtgtgcagaaaaagccaaacactggccaggcacagtggttcatgcctatactcccagcactttgggtggctgagacaggaggatcacttgaggccaggagttcaagaccagcctggccacatagtgagacccaatctcttaaaaaataagcaggcgtgatggcatgtgcctataatctcagctactcaagaggctgaggtgggaggatcacttgagtcttggaagtagaggctgcagtgagctgtaactgtgccactgcactccagcctgggcaacagagcaagactctgtctcaaagtaaaaacaaacaaacaaacaaaaaaaaaatgccaaacagcgacaccaggacttgcagcaaaagaaagtgagataatttattgcaggtgccaagcaaggagaatcaggcagctaatgcttaagacctgaactccacaatggcttacaagcaagggtttttaaaagaaggggcacatttcaggaaagcaaaattgtaaatcgatacatagaggttacacattggtttgccccaaaaaagtgggatatcttgaagcaggggctcatgtgaattcagagattctttgatttgtaattggctaaggaagcaaggctttgtctaaaaacttggtgtcagcagaaaggaatgctaaggtttggcccgtgggtgtgactctctccacatccctcaggaataatttggaaaaaaggatggtggtcagagttcagtcttcagttcccccttatctgaggtcaatgtgacagcagtgggcattttccatctggtaggagtctggaatcccagcactttgggagactgaggcaggagaacagcttgagcccaggagttcaagaccagcctaggcaacatagcaagaacctcccgtctttacaaaaaatttaaaaattagtcaggtgtggtggcatgtgcttatagtcctagctactcaggaggttgagatgaaaggatagcttgagcccaggagttcgaggctgcagtaggcctggatgacacagagagaacccatctctgaaaaaaaaaacaaaaccagaagacatgtcaaggtgttatttgtttttagagatgcagtctcactctgtcacccaggctggagtgcagtggtacaatcacagttcactgcagcctcgactttccaggctcaagcaatcctcccacctcagcctccagagtagctgggactaccggcatgtgctaccaccctcagctaatttttaaagtatgtttagagacagggtcttgctatgttgcccaggctggtcttgaattcctggacacaagttatcctccgccttggcctcccaacgtgttggaattacacgtgtgagccactgcacctggccaagatattattttcatttttttttaaatagtaatgagatcttgctatgttggccaggttggtcttgaactcctggcctcaagccatccttctacctctgcctcctaaactgctaggattacaggcctgagccactgcactctgtctttagttgttgtttgtttttttgtttttttttttattttgagacggagccttgctctgtcgcccaggctggggtgcagtggcacgatctccactcactgccattctcctgcctcagcctcccgagtagctgggactacaggcgcctgccaccacgcccggctaattttttgtatttttagtagagacggggtttcatcgtgttaaccaggatggtctcgatctcctgaactctatctcatgatctgcccgccttggcctcccaaagtgctgggattacaggcatgagccaccacgcccagcccctatctttagtttttatagagaactaaacatcttgtgactctggcttacttgggtggctgcttaagttactattaccttcttccttggtgggttattcatttacttccctaattgctgggtgcagggctagctagttcctgaaatctcccttgaagggactcaaaattttccctttatctccatacttgcgggccagaggggcacctaagaagggtctgtcctccatatcaatgtctctctgggcctgataatataaaaggatgcacattcctcagataaaatctcttttctcaagatagaccagcaagagggaagaagtagaaggttctaggttctccaaacaccctagtttctcttacagataagtttttctgtattgggggagggtggcatggggttggggggtggtctgtatctcccaacaatctaagttcttccttcactttgcagggatactatgagcaaataaccctgactctgttttctgtggtagtggtagtggggagtgctccaagaactccttgagcctcattagtccctcgttcttatctgagaaggttcctattgcttggtgtattagtccgttttcatgctgctataaagatactacctgaattgggtaatttataaagaaaggaggtttgggccaggcatggtggctcatgcctgtaacccagcactttgggaggctgaggtgggtggatcacctgcagtcaggattttgagaccagcctggccaacatggtgaaaccccgtctctactaaaaatacaaaaattagccgggcatggtggcacgtgcctgtagtcccagctatttgggaggctgagacaggagaatcgcttgaacccgggaggcggaggttgcagtgagccaagatcgtgccactgcactctactctgggtgacagagtgagactccatctcaaaaaaaaaaaaaaaaggaggtttggcctgacgcggtggctcatgcctgtaatctcagcactttgggaagtcaaggcaggtggatcacctgaggtcaggagttcgagaccagcctgggcaaaatggtgaaacctcgcctctactaaaaatacaaaaattagccgggcatggtggtgtgcacccagctacttgggtggctgaggcaggagaatcacttgaacctgggaaacagagcttgcagtgagctgagatcatgccactgcactccagcctgggcaacggagcaagactcaatactcaaaaagaaaaaataaaaaaaaagaaaggaggtttaattgactcacagttctacatggctggggaggcctcaggagcttataatcatgacagaaggcaaaggggaagcgaggcacatcttagatggcagtaggagagagagcgagaaagtgccacactttaaaaccatcagctcttgggagaactcactcactatcatgagaacagcatgggggaaaccacccccatgatccaatcacctcccaccaggtccctccctcaacatgtggggattacaattcaagatgagatttgggtggggacacagagccaaatcatatcacttgggtagtggagatgagggaaaggagtggtattccaaagcacgaggtattgagtacgttgtttcatgagtcttttttttttttatttattttttatttttttattgatcattcttgggtgtttctcgcagagggggatttggcagggtcacaggacaacagtggagggaaggtcagcagataaacaagtgaacaaaggtctctggtcttcctaggcagaggaccctgcggccttccgcagtgtttgtgtccctgggtacttgagattagggagtggtgatgactcttaacgagcatgctgccttcaagcgtctgtttaacaaagcacatcttgcaccgcccttaatccattaaccctgagtggacacagcacatgtttcagagagcacagggttgggggtaaggtcaccgatcaacaggatcccaaggcagaagaatttttcttagtacagaacaaaatgaaaagtctcccatgtctacctctttctacacagacacggcaaccatccgatttctcaatctttcccccacctttcccccctttctattccacagaactgccattgtcatcatggcccgttctcaatgagctgttgggtacacctcccagacggggtggtggccgggcagaggggctcctcacttcccagtaggggcggccgggcagaggcgcccctcacctcccggacggggtggctggccgggcggggggctgacccccctacctccctcccggacggggcagctggctgggcagaggggctcctcacttcccagtaggggcggccgggcagaggcgcccctcacctcccggacggggcggctggccgggctgggggctgacccccccacctccctcccggacggggcggctggccaggcggggggctgtcatgagtcttgtattatccattttattattccttagtgcatggtaaagcttcctttaaaatgcaagctgatttatttgagccagaggaccccaggggaggtgagatagatacccacacctgggcagaggattacagggaaaacggcacccgctctttcccctgggcacatatggtagaggctgtgggaatgagggtattgcaggggtgatgagggtagagtcaggactgtaactcctcattccaggttccccggagctttgactgttgtgctcctagcctcaagcaatccttctgcctctgcctcctaaggtgctaggattacaggcctgagccactgactgtcctcctcctaggaggctgttgactgagaaggtctggatgtcaaagcctttcaccacaggatatagccaagattactgcagagccaaggcccaaggccatccttccctatgcacagctcttcgtaattcccctgacttctgtgtgtgcaacttgtaagcagctcagcctggagtagaagttggggttctgactttctacagcacctgggacgggaaggatcagaggagcacagggagctgactgccttataggtgtctcacgtcatcccatctgaccctccaacaagcatgtcaggctggcattattcaccccattctacaaagctcagagcagtgaagggccttgcatgtgacatttaccatcatcatcactagtatgtccctactcacatcacagcaattctttgctcaaatctgtaattgctgagactcgaagtaaaacccaaagtcttcacaatagcaatagcctgcaaagctctgcccccctcctctcttctctgacctcctcactgcccctgtcttactcactctgctccagccacagtggcctccttgctagcagttccctccccaacacgcccggcacagtcccacattcccgccttgctctggcttccgctgtggctgtttcctccccgcagaacactcctgccttcctcaccgccaagtctggactcaaacctcacctcctcaagaggcttgcccagacagccttttatattctgcaaactgcctcccactgccacctgcccccttactttttgtggccttgacctttcaacatactacatgatttgcttacaatacttgtctgtcttgccttcaccagaatgtaagcgctctacaaaggcagagggaaggctatcttgctctctgatgtatcctccagcccttagaacagtccgtggtacttagcaggttttcagtacatctgtgcccggcgatggaaagaatgaatgaatagtgagaccgaagatcgcggccgtaagcctctgggcacgggtgccccggggcctggcggaacgctcagggaactacatttcccgtgaagctctgggcgcagagggccgcgggggctgccgggaaaggcatacgtgcttaatcctggtgcagggggcgagcatggccgctccgcgaggtgagccattggctggggtgtcggcgagtgtgttcgtggagcgcgtcctggggacgactcccggcattatcggccaggttgagtccgctcctggcattccgcggaaagatgggtgggtgccgggcagaggtgtggccacctgcgatggggattgacctccgaggggagggggcccttctagacgtcgtgccgtgggataggtaccttctgctccctccccgccaccctgcctcagatcagcacaaggtccttactgctgcccatctgacagttgggaacatcgaggcctgcagcggaggggggtctcatccaacagcctacaaaacccttatttgactctgtccccagtgagcacccccagctcttgcctggtttcccgggacactagggtggggcctgaggagtggagtggcagctgaccctgtctgtgcccctagtattcccactttcctgtgcggtgcagcagtatgcctgggggaagatgggttccaacagcgaagtggcgcggctgttggccagcagtgatccactggcccagatcgcagaggacaagccttatgcagaggtgagccccgggctgtatttcagcccactttacccgcaggtcaggagaaagggcctgaggcaagtcataagaatcagctgggaagggtgaggcagcaaggagggaggagacccacttggctcttcaggctaatggactagatagtgttatcaaaaagaagagaggttttgtcataataggctgggatttccagcactctccttcccccaaccactcttagcacttagtgaattttaattcagccctctttgacaattaagtttttttactttgactatttttttgcatttttattaacctaaaatatttctcctgcctatttagtggagaaaaagccaaagcataggaaggctttcgcctctgcttctgaaactggaagatgtatgttaacccctgaaagaatcatttaagagtcatagtttttctgctaccttgacagtgcagatgtcattctcctctttggacagacaaagaagatacatctaaagaagggaaataactagtccaagtcttcatagatggctagaggccgagtctggacaagggcctgggtctactgcctccctgtatgtccatgatggcatgaacatttgtatccagacctgggaggcctttcccaggactcagttgccctgtggggagcacagcataacggattgggacaggccaactcagggtggcaggtttcttcccccttcccctcccaagtttcctgtctttccagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggtaaaggacagagtgcggtgcagaggtcagggtacagaagggcttatgctaaggccctcccgtgacttttactgccacttttaccccacccatgccaggctcctgcccaaggccaaatccaggctgacaactcccaatttagctctgcaaagccagatggtagtgacacatgcagcaactaagtctaagcaaacagctcaccggcctgtgccaggggagtttctctaagctcattccaaggggcttgttcctggtcttccctcatccaacccatgtctattcatatctgccatttactcatctgctttcaggaagagttcaacttgcaaggcagggcaggtaccctcagccccacccccatggagtctccctacacaagccggagtcccatcctaagcaactgtggatcaaaactcctttttttttttttctgagacttgagtcttgctctgtcgcccaggctggagtgcagtggcgcgatctcggctcactgcaacctcctcctcccaattcaagcaattcttctgcttcagcctcgcaaatagctgggactacaggcacgcgccaccacacccagctaatttttgtatttttagtagagatggggtttcaccatgttggccaggctggtcttgaactcctgccctcgtaatccgctcgcctcagcctcccaaagtgctgggattacaggcgtgagccaccatgcccagccaaaactccttatttctagatacacaaagtaagacccagagaagggagggatttaccaaagccacacagcttgttagtgtcagagcttggtctggtatttgggtttcctgattcacaggccaagcctcttaaagtctgccccagcttttccctgatttgccccggggttgcccctgatttgcccctgccctgggttggctgagccccaagtttctgcaacatgctttgactgggctccttgccagaggtaggtagtcactgccatcctgcaactggggagggtggacagcaggggctaggtggcactggtgtacctgctaggtaatggctgtaccctcaccatcctcctcttcccctggccaccccacaggagctggcagagaagctgcacctccaggctccgcagcactaccccgatgccaaccacaagccagagatggccattgccctcacccccttccagggcttgtgtggcttccggccagttgaggagattgtaacctttctaaagagtaagttgggcagaatgctgaaggcatgcgtactgggccagggatacctggggaaccaagatgataggaacagtggctgagaacgggtcacatgtcacaggaactgaagggcctcatgaagcagtttttggagccagtgagccaggccagtgagaccaggctcaggtgtggtagtcaagggctggtggtgagtgattggtttccactgcaaagtttacttagcattgccggctctttggttagggctgggatggaaaggtgtcctccaactccccacttgtgtgggttccatcttaccattcctgatatgggccctgggccttgccttcctgtagaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaaggtggacacagttatattcctggttgggtgcaatgctctggcctgggcttcccagcagacaccagactctggggacagttctcaacccccttgcccaagtggaacactaaaaggggccccacttagatgacctgttggcaacttagcattgcttgcctagtctttgtggagcagggcccttcttagttgagtgctgcttcccaactggtcatcttctccagatggttggaggcagactggcatagaggactcttaggatgccttccacctaggcattctgagattttccctagccctgcagctgccctccatggatggacttgtatctcggggctaaagaggcaggaaggggacacgagcatcctccctctcctggaaaggactgatgcctccagcactcagtcatttgatctttcctttaccttctgtgtgcccaaccttgtgctaagaagagttcaggaaatgactgtgatgggtgtggtcactgtcaccctaaaggtggggagtcaacacaagcagtaagaaacccaaaacagaacagactcccagcaatgagcttatgtggtgcaggcgatgaggtctcagcttcttagcctggcagccacaaccccttctctaggtggcccagagctctctttttattttacctctacaggtttcccattacctttgagccttagggcattatttatttgacccaagcatatttttttctgttcagtgtgtgtgtgtgtgtgtgtgtgtgtgtgtgtgtgtgtgtgtgtgtgtgtgtgtgtgtgtgtgtgtgtggtctctttctgttgccccaggctggagtgcagtggtgcgatcttggctcactgcagcctctgcctcccgggttcaagcaattctcctgcttcagcctcctgagtagctgggattacaggcatgtgccaccacatctggttaagtttttatattttagtagagacggagtttcaccatgttgcctaggcgggtctcgaactcctgagctcaggcaattcacctgcctcagcctcccaaagtgctaggattacaggtgtgagccaccacgccaggccccttgcctcactttaaagaagcctggctgggcacggtggctcacacctgtaatcctaacactttgggaggttgaggcggccgtatcacttgaggtcaggaattcaagaccagcctggccaacatggtggaaccccatctctactaaagatacaaaaattagccaggcgaggcagaggttgtggtgagcctagatcatgccactgcacttcagccggggcaatagagtgagactctgtctcaaaaaaaaaaaaaaaatgctgggcatggtggtgtgtgcctgtaatcccagctactcaggaggctgaggcgcaagaatcacttgaacccaggaggtggaggttgcagtgagtctagattgcaccactgcacttcagcctgggagacagagcaagactccgattcggaaaaaaaaaaaagaaaaagaaaaagaaaaaaaatttaaaaattaaagaagtccacccttgccactctacccaggctgagctcattttcccttgtcgtttccaggacacattttggccctcagcgcattctgcctcatgctctctggagcagaccgagagagattctctgagacatagaactttcttttttttttttgagacggagtctcgctgtgtcacccaggctggagtgcagtggtgcaatctcgatcactgcaacctccgcctcccgggttcaagcgattctcctgtctcagcctcccgagtagctgggattacaggcacgtgccaccacacctggctttttttttttttttttttgtatttttagtagagatggggtttcaccatgttggtcaaactggtctcgaactcctgacctcgtgatccgcctgccttggcctcccaaagtcctgagatgacaggtgtgagccaccgcgcccagctgagacacagaactttcagtgctaaaaactagaaagtcgccgggtgcggtggctcacacctgtattcccagcactttgggaggcctaggtgggaggatcccttgagttcaggagttcgagaccagcctgggcaatatagcgaccccctctctctgcaaataataaaaaacttagccgggcatggtggcatgcacgtgtggttctcgctactcaggaggctgaggtaggaggattgcttggtcctggacagttgaggctgcagtgaggtatgatcgtgccactgcactccagcctgggtgacagcgagaccccgtctcaaaaaaaaaaaagggaaagctcgggcatgttggttacccttcatgaaactcttttgcgttatctccctagattttgagctccaagggcagtggttctcatacaggggacatttggctgttgtctggagccattttttgattgtcaaaacccagataggggttgctagtggcatcttgtgggtggaggccagggaagctgctacacatccatcagtacacaggacagcccccacaataaagaattacctagcccaaatgtcagtagcgccaaggctgagaaatcccatcctgaaaggaccatactctagctcttttagtggctagtatagtcctgggcatatgaatagtcaagatatgatgaaagatggtatttgtatggactggagtatcaagcaaggctcgacccccaaagggctggaggcgtggccagaaggacagggccactttggcttctggattcctgtggcagggaccttttcctaggactccctggccaatgtggggctatgaacagcactgagtatccccctaagtgaccttggggtgctctgtgaccctcagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtgagccacatttcagcagtgagccccactgccatccctgctgggccctgtttccctatctggacaaaggaaggagaagggtggtcaaggagacccccaaggaccttgcagctctgacctctgagggttcctgggctcagcaagcaacagctggtagggatgatgaatgcatttagcattgaacacgccttgaatcctgacaccaaccctgtgatgccatgctactctgattttaagtcctgccagtcagtgtgggaaccacaatttgaacgcaggctatattggatcaaagctgttgttctgtcacagcctttgtatgtctgtcctacctaccagggatttttacactaaaatatgcatgttgccatggaaggatgccacctttcgactgttggctgcttatccacacatgcctcatgcacaggattctggggtagaagtgggagactacagagttggggctccccaacccccaggggttaacatgactcccctctgacaataatgggtgacctgtcacctgtttttggtatttgatatcttaaccccattctcccagagaatacaattcatggaaatttttacctaacttggcatggggttcatggagctcaggttaggaggcccagaactggagagctaaggcatacttcatcagcttagcacatgacgactgtctctccagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtgagtgaggggctatgatgggtgtccttcgtgtgccatgaaaatctctggcaagggtcacgatgtggaggacacctggggctgggtttcctgtcaagcccacttggcggagggtggccccagggcctgcccattccttcctgtaccagggaccaggcctctatgctgactgagcctgggttgtgcgagaaggtggcagagctctccctcgtgccctggggactgtcctgggcccatgagctgatgagagcagagtctgagctgcactgccttatcatttcttcctgcccaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgaggctgtggggtaatgagcactcagcctttggggtacctgttcctaaagtgggccaaaagagccctccctacatgatgccccagtttttgctttattcctatttcatacagcttctcgggggagtgagcaggctacactccagaacaccggtatgggaaggagtgggagaggaagccagctttggcctcacaggcacagcttgcaagcaggccttgggtctgcccagaggcacagcttgcaagcagccctacagagaaggtgactcaaaggatacaccagtcaccagtgcaagactcttcgctcctgtttttctcttttttttttttttgagacggagtctcggtctgtagcccaggctggagtgcagtggcacgatctcggctcattgcaagctccgcctcccgggttcacgccactcttctgcctcagcctcccaagtagctgggaccacaggcgcccaccaccacgcccagccaatttttttggtatttttagtagagatggggtttcactgtgttagccaggatggtctcgatcttctgacctcgtgatccgcccacctcagcctcccaaagtgctgggattacaggcgtgagccaccacgcctggcccggctcctgtttttcaactggccctagaggaggggtccgcaaaccaggctggcaggccagttctggccatacctgttcatttccatactgtctggctgctttcaagccacagtggcaaagttgaagagttgcactagactgtacggcctgcaaaactgaaaccattgactgtcaaccacttctctacaacatactcaactgttgcagattacagggactcaggaaccgaattagacaattttcatggcgaggagaagcccagttagctttcctaaacgggcaggaagtgtgaaggagggaatctcctgatgccctgctccaggggtggcacacacctgcaagaggctgtcggctgtctgctgctgctgaggtttctgacctgcaatcgtagatcctgtcaccacagactaatcacttagtccactggctccttcctgtgggataaaggtttaaattcatgcaaaagaatctttctgggcttctgcccacactagagtccctatacaatggagttccaggaaaccaccttcaaaaatctcctgggttttcttgcctccaaattttcttcagctaaaaaacaataaagatgagctggaaagaaaaggtctgctaaagggaacccattctacagaagtgacttgcaagagcctatttcactcatgccgtccagtgaaacaggcccgaaagtgatgcccagtgggaacagcagaaaggggagggagtttccagaaggaattgctgtagtcagctgttaagctatttcttcatttcaggatatccaggatattcttaacttttatttttttgagacggagtctcgcactgtctcccgggctggagtgcagtggcgcgatagctcactgcaacctccgcccactgggttcaagcgattcttctgcctcagctcctgagtagctgggactacaggcgcctgccaccacacccagctaagtttttgtatttttagtagagacggggtttcagtagagacggggtgacaggatctacaattccaggtaaggtcaggttggtctcaaactcctgaccttgtgatttgcttgcctcagcctctgaaagtgctgggattacaagcatgagccattgtgcctggccaaggcctttaaaatccactgcaacacagacacagctcaactagtgtgattgcatttattcttataaatgtacagagctgtagaagtgcaagccaagagttctatagagtagtacataaacaccatatggtaccactcctgctgggaggtaagcctggatacacccctctcctcaggaaactgtcacctgcagaacacacagcactcagaattaaggcagtttggccctgggcacattggtggtattttggtatgtggccactggccctaaacaactgaccatttctaccctgcctcactgcactgtcccaccaggtccctccagctttttctacaaggtaacaccctcctacatggggtcagccagctcagaaacctcttcttcagggacagttgcagctgaatatgccagagctgattattacaacaacgatgcagagggccttggttttggggtcctgccaccctcacccctagaagctgctaaacacccaggccattctgccctgaccacctccccaacagagatgtaggtctatacttaccttccacagccacctcccagcacacactgggtccctctacctgtgttgctgtctttctttacactgtgctacatttgatccctttccacatgtgcacttcacctctgcagacacaagaaaggcctggacatggtctctgcagatggggaaggggttctggatggagatgttcttgagctctacaagcatttgcacaaagtgctcagaatgttggccactgcatagagctgcagagtcccattccagaacagagtaaccatctgcctctcttcccaagaccccaagctggcatgactctggtctctgtcctatctctctgctgtgatgctcctagctagtagagtaagtcagcccccagatactgtatattcctctcaaccttccatggtttgagaaaaacacaaagatagatgtccatcaggcactcacaggattaccatcgtaaggatggttgtcagacaaataacaaataaggccgtatctttttattagacttgctcatcttctagtcaccccttgtggtagagcgaaaagagtgtgttgtccctctcatgcctctggtggtcacaggacactgagtaaagcaagagactggatactttcccatgtagaacctataccccaatcccgactattgggctgggaaccctgtctatgcccattcaaagctcaccatgtgggaggactgcttgggcctgggaggttgaggctgcagtgagctgtgattacaccactgcactccagcctgggtgacagagaccctgtctccaacaaaacaaagcagaacgctcaccatggttctgagttaagccaaaaaacaaaacaaaacctgttggaaaaattctagaaagaggcttggtatagagtatagcaagatatactctccaatttgtgggtagggggtgtcacagcagaaattatgcctatttctgctgtttgggctgggggctgaaagaggctgtgtcacacccagaggtctgcttaaagcccaatcctgagtatccagtaaggcccatgctgtgaccagaagaatctggcaatagaatggtccatgctggagtgaagggaggccctctacactggtggactgatttcctcaggcaagggtctaggagctggcttaggtctctcttacccttcctgtctgtaagcctcagtctaggacaaagcccacacagctgtatacccactctcacgagtccattgctacttctcaaaagtttaaaaagtaaacaataggaaggcaccggactgctccctgtagctccctctgctggtaataataaaaactgcaggcttctggggccagccccagtaccttcgacctaatctttagctcaaagactgggtgaagaaactcacccagaccaaggaaatacaaataaataaatatgaacatgtcagagcagtttttctctaactagggaagggcaaaccagaatcactaaactcacccggacggttggaccagttggggatgccccaggtccagggattctggaagccaggatcctgctgtatcattaagcaacctgctatgatccctgtcatagttagacaggtgcaacctgaagagggacaaaaggactcactttatgctgtcttgaaggtcaagcctgcaaaccatcttagagctaggaagaatagagcaaacggaatttctcgaactggtctcaaacagtttcttttttggattgccagctataataaaccataaagtgctattttctgcctccattcaacactatctagcacagcctgggcacaagagctccctttttgcctccctgaagcactatgacaaataccaatcaagctgtctgcaagtgttttccttagccacctttgtcacccaccataagaaccagaattttctgtcttgcccttattaaagtgacttctccaaactctgctccaacagcagaggaaaactacagaattctacctatcagcccacagcccagatgggggcctctggcctgagaagcaacaggtaagggctacctgcaggtcactttctaggggtcagtgacttcagtgctcactgcactgtgtgagctatgagtggccaacagggctctgtaggcctcatggtgagcagggcccaccttggagggtaatgtctactggagggtacaggaagaagagtccccaagacagcaccagcagcaggagcatgttgaagaggccatgggcttaggggggatgaggtccaagtcctcgtcatctggaatctcatccaggtgatacccatcctgaagcagctgccggctcacatcctggttcacctgctaagagaaggagaggagggaactataggccaagatgcaaagcagaagtaactgctacccaaaagacagaaccacattccgttaccagggcttcctgtccatgtcccaccccaggccaaccccacacatccctggactacaggaggaagtaccaccttctcctacttgtgcctcagccagcagtaagccttagtactgtccagacttcactgtcactgacccccagggatctgttctcactaaatcctgaggcattcatgtaaatatcgagttcccaatatgtttgaaaatcagtgctctgacagttcccactgggagcccagactagtccctatcaaagctgaagaatatgggataataacagaacaatgggctagcgtagtagagcatgggttacagtggaagggggtggtgagcagctttgtctacacactgctggttagacttatcctttgatgccaacagaggtgggttcctgcaaagtggaatttgttggttggtttcatcagttcactgaacataagaaaaataaggctgggcgtggtggctcacgcctgtaatctcagcattttgggaggccgaggcaggtggatcacgaggtcaggagatcgagaccatcctggctaacatggtgaaaccccatctctactaaaaaatagaaaaaattagccaggcgtgacggcgggcgcctgtagtcccagctactcgggaggctgaggcaggagaatggcgtgaacctgggaggcggagcttccagtgagctgagatcatgccactgcactccagcctgggccacagagtgagactctgtctcaaaaaaaaaaaaaaaaaaaaaaaagaaaaagaaaaataaatgaggctggggaaagtgtaagacttcctcttacacacaatctttgacactcagacatttaaggaggacaaaatttgcaaactgctctattctctgtgacagaaactcagagattagccaagatttccaggagagtaagaaaagcaagtggtgtagagtcaggtccccagcacttcacctctgtcaaagggaatgggcttcacttgccaggattttacatccctgtttttctatctgggacagtcactctagaaaaatgtctacatggctatcccaggagtgttttagcctgagttttcatagatggaacaactgaagaaacagaagttgtttggtctggaagaaagcaagcttggtgaaagatgggcaggggagagacggaaatgctgatctcagagaaactagagttgctgtgtgacactggaaagcaggtcaaggaccaatggaaccattcagattaataaggaagatttctctaacagctactcaaagaaaaaattctgtgtgtgttgagggaagggtgggtagcaaggctccttggaggtggtcagtacccaattacaaaaagcattcaagtaagcacagactagcaaacacttagctgggatctatcaaaagggttccttttgtaagctgtggcctagaagacttttattttagagtcttattttagagacagggtcttgctatattgtccaggctggtcttggaactcctgggctcaagcaatcctcctgcctcagcctccctagtagctgggactacaggcatgtaccaccatgcccagcttacatgacttctgagatcatttctagccctgagtctaaatggtctcctcgattctcaacagccctccttggtcacctatacctccaccgggggaagagggcagagtggaagatcgtagaacagaccagaagtctggcacagtgctgtgctcacagcgggcaccaaacaagcatttggcagtggtggtaatgctgcctgcagcctggccctgcacagaaaggtgttctggacttgcctctgcagatgaatacccggaggagtatctggatcccagctccccatcactaggagaagaggaaaacagtcagttccgggaggtacctgtggtgcacagctgtaaatcatcaggcggagagcatgcaagggcatctggaagacttttgaagcaaaggccacacacaacagaactcaagtccgaacaggccttgaataatactggttccctcaattggttctggcagggacagggtcactctcactaacaatgcaaacataacagggcaggatgatcccccggacattggtgctccgaattctagagcagcacgattacctatgagtcttctaaccaagccatcctgggaagggatattgttcagaagagaacggccctggaatgtacatgaagggccttggaggagacagggaacaagcaaaggcatcaggcgatcttcagtcccagccaagttgcttcccaagggggtatttccaaggggagcactcacctgtcagagtcgagggacaccaggttttcatctggactctggctaagagcagtatagcccttgttaaacttcactgacctgaggggagacgggggagaagagaccaaacatagatgaaagcataggcatttcacagggataggcagagtcctcgccctgaaggagaaagaattgactgcactactgacttgccttctccctggtcacagccaccactgcctgcagctccatgtacctggctacagtgcctcagaatgtgtatgttctcattctttttttctttttttggagacagagtctggccctgtcacccaggctgcagtgcagtggcgcgatctcggctcactgcaatctccgcctaccatgctcaagtgattttcctgcctcagcctcttgagtagctgggactacaggcgtgcccagctaattttgtatttttaatagagacgggctttcaccatgttggccaggctggtctcgaactcctgacttcaagtgatccacccgcctcggcttcccaaagtgctggaattacagtcgtgagccaccacgcccggcctgtattctactcctcccataggtcttggaaaaaagcacacctccccttgcctgatctaggaaaagcaccctctccccacttatttaatcagaggacacaaaaactgcaagtctttgggtaaaaggttagggttaaccttcacttctccgagtttcaaccctcatctgtaaaaggaggcactgaataaggttctatgcagctccgagtttactattctgttaaaaacaaacaaacaaaaacaggtctagccattcccacactgctcttcgtcctcattgctggggactccagccaccattctcctccctaacagaggaggagaatgatagtgaatgagcctgtgcactcacagaactcccttattccgaagccctttatctgatcctatcacatccttaaaggaaaagagagattgttcctcttcccattttaaagatagtgaacctgacaggttgcatcaggggaatcgctagctcggccttaaaccagagcaccctgcctccgtcctggggattaaagccttctctaaagctgctggcacagaggaggtggcgcctgctgagaccttttccctgaagagtctgggcggttcggcgaggcccccagcatgccttttctccgcagaacggccttggccaggtcccggtgcttctctggaagttaaaggacccgggtcagccgggtcttccccactccgccgcgtctcccgaaggctgggaggccgctctttccgaacggattttgaggggcgagagcaggctgcagctaaccccttccctccggggccgaggcccagcggagctccggaacccgccctggggacgcggccgcccgcccagggagaaacctcccccgaccatcgggccacactcacgcagcttggcttgaatggagggtgcgcgcgtcaccatgtatggcccccgcttttccacggccgcgggggtgcgctcccccagacggagggctctattaccgatctgcccggagggtggccccgcagctcccggcgcgcggtcccgagccccgctgggccggggtcccggggtagacaaccgcaacgcgcgcccgctgggctccgcggtcgccatggccgggccccgccctgccggatggtgcaaccccgcccgtggcgaaagagtgaccggccgagggagaggcgggctcttttaacaagatggcggtgcgcaggcgcaggtagtcccctttcggagctctccggttcggtagtctgaggacttggccgaaatgttccgcccttcttttcggggggaccgggcagttccgttctcggttttggggtaggcggcttgagcctggtgatggttaggcttagttctgtctctagtggaaattaaatactgatactgtcgtggggctgcgcgtgtgcgtcggtcgggtgcccacggtttgagtcctggcgcgccgcactctgtgcttctcgcagtgtctccttgggggtctccccacatgtggggctgccagagagcagacttgggttgaagagtcatatgaggacaagcgttatcagcgaccttttctagcaaaagaaacaggccccagaagttaaagaaccttgtgaaggtgacacatctagaggcagtgcttgcgctgatccatctgacgccaaaccccaccttctttccaacaccaattggtgcctgtgacattggacaggacctgaccctctctaggcctcagtttccacatttaaaaatagagccaatgtcactactcattgtacagtgaggcaaataggcgttgaaaaggagggtgaaagtgcactctgagtctgtgtgtggtaggctatgtgtcagggctcttgacttctctagcccccaagggatgtgcttgtgactggctggaaagaaactccagatccttgtagaactcccaaatctcatgaggctgtcccttgactaacttactggcttcaatagggtaggtcaacagtgtgcaacctccgagctcccagggccacgcagaccgttgggtggcactatgccttgggcaagagaggtgaaaaggaagaatttagggctgaagttttcaaaaatcaaaagcacaaaggaatccttaccattttggtagattccccccactccccatgatgttagactgtttttgcctccagaaacagcaggttcatatagctcaacttagtatttaatggttataacctcccaatgaagccaatagttattcttgttaaacaaatgaagcttagacttggtcaagtttaccagttaagtgataaacctggaatttgtacccagttgcctgtggactccaaagaagtagttttctggccgggcacagtggctcacatctgtaatcccagcactttgggaggctgaggcaggcggatcacccgaggtagggagttcaagaccagcttggccaacatggtgaaaccccatctctactgaaaatacaaaattagccgggcgtggtggcgggtgcctataatcctagctattcaggggctgaggcaggagaatcgcttgaacccaggaggcggaggttgcagtgagccgagatcaggccactgcactccagcctaggcaacagagcaagacgctgtctcaaaaacaaccaaccaaccaccccccagccaaaaaaaaaaaaaaaaaaaaccaacaaaaaaacaacgaagtggttttctcctggttatgctgatgtggacatcaccaagggccaaagaaaatgtgatttaaaccagcagtctccagcctttttggcactaggggttggttttgtggaagacagtttttccacggggtggaaatgcgggggctggttttgggatgattcaagcacatttattgtgcactttattattacattacaatatataatgaaataattatacaactcaacttagaatcagtaggagccccaagcttgttttcctgcaactagacggtcccatctgggtgtgatgggagacaatgacagatcatcaggcattagattctcataaggagcccacaacctagatcccttgcatgtgtggttcacaatagggttcatgctgctatatgactctaatgccacggcttatctgacaggaggcggacggagctcaggtggtaatgtgagcaatggggagccactgtaaatacagatgaagctttgctcactcatggaccagtatccatccatggcctggggcttgggaaccccgacctaaacccacttaatgtcacaagatcactaggaacttgtagcaaaagtgtgacagccttcatgcacactcctcccaatcttccatcaataatgctgttaactgctgactgattgaacatagaccctgaagccaaattatttgctctgttacctactggcaaattattaaacctctttatgtctcagtttctttagctaagtggagataagaaaacccatctaatggaagtggaattgtgaagttcagttgtaaagtgtttagaatgacacctggcaaatagtaagtgttcaagaaatatatgctattatttacacaacccttatacagcattacaaggatttagtgtttattctctcatttgactttacactccccaagggcagaccttattcactttttagcataaggttatagtaataagtatttgttgaattaatatcctatttcccctcttttagttaactagtatcatagaactttggggctggaagagatctttttttttttttttttttttgagacagagtcttgctctgtcgcccaggctggagtgcagtggcgcgatcttggctcactgcatgccctacctcccaggttcacaccgttctcctgcttcagcctcctgagtagctgggactacatgcgcccgccaccacacctggctaatttttttttgtatttttagtagagacggggtctcaccatattagccaggatggtctcaatctcctgacctcgtgatccgccctcctcggcctcccaaagtgctgggattacaggtgtgagccaccgcacccggcctggaagagctcttagagattatataaagtcattattaatgaagaaattgtggtcttgtgatagttgtactcaatgatcctggcctggatgtgggaagttcccttttccacttaagaaattatgttcactagggctcacgcctgtcatcccagcactttgagaggccaagacaagtggatcgcttgaggccaggagttcaagagcagcctgggcaacatggcaaagccccgtctccacaaaaaaaatagaaaaagtagctgggcatggtggtgtgtgcctgtggtctcagctacttgggagtctgaggtggtaggatcacctgagcccaggcagttgaggctgactgacaggaggtggagctgcagtgagctgcgatcgcaccactgcactccagcttagatgacaatgagaccctgtctcaaaaaataaataacttacaattcaaaaaaaaaaaattatgttcactaggaacctaagacaaataaatacccaccccaccaccaaaaatacccccaaccaactctaggttgcaaggggatgagtctccagagcaagaattgccacagcagaaagggcacaaagcccctcttccttgctcctactactcagaccttaacccagtgcttgtgctgcctgccttgctgggcctggggcttctcaatttagcatagctttattcatctcctactgtgtcacaggtgctatgctgggtcctgcaaacctaatgatgacaaataaggtatctcccagttcccagtcttatttctttgttattggggggtagtgaatcctcggggagagattattggctgttaggagcaaggactactaccctggcttttggaaccctcattgggcagttactctttatccctggctctaaatctaagttattccctaaactttcttggtcctgggacagatacatctccatcatcagttgagaattctggttctgctgttgactggagctgaattccttcatacaggcaagtatctggggttaaacattaaaagggatggaggacagagattttttttttttatcctgctacttccctttcaagctctcttccatctcagaagccactgtctcaccaggttgtggcctctagcccaaggaacttctctcattattggtagagtacagataactagataggacctatgaatctgcaggtctttctgggttcccaggttaccagacccaccattgtcctcacagttatatgcaaaggtatggccacagctgtggcgggctgctgtggcttgtctccaccaaaccccatgtttaaatttgatccccagtgttggaggtggggcctaataggaggtatctgggtcatgggggtggatccctcacgaatacattaatgctctctctgaaggtggtaagttcttattctataagttcctgagagagctgggtttttaaaaaaatatcaattatatatatatagtgggccataaaaactatctctgcggccaggcgcagtggctcacgcctgtaatcccagcactttgggaggccaaggcaggcggatcacaaggtcaggagtttgagaccagcctgaccaacgtggtgaaaccccatctctactaaaaatacaaaattagccggacgtggtggggtgcgcctgtaattccagctactcaggaggctgaggcaggagaatggcttgaacccaggaggcggaggttgcagggagccgagatcgtgccactgcactccagcctgggcaacagagtgagactccgtctcaaaacaaacaaacaaacaaacaaacaaacaaaaactatctctgctttcttgaagtgtggatttagccaaggagccaaaaaacaaaaaaacatagcagtggaaatttactagttatagggatagtcttagatatatatttatgtgtgaatatatattatctgtatagataactaggtattaatgtcacataagatggtgtgaccacacacacacacaaacacacgtgcagagagagggaattcagccacgtggtgtaggttggttaattacttgagataaatgagaagcaggcaggtctgtgctgagctgtgtcatcagtgaagatcacacttggaggtgacattgaagctgattcctcaaagaaccacgaaggaggcacgtggagacccagacagggaacatcagaggctccagaaagagcaggtcccagaaaagtctcagcctgttcttcagaaaggaatgaccactttgtctgtggggtatagtgggaggcagaggaggagatggagctgagattcagggccttggtggattcagaataggtcaggataaactggccaggaaaaggtggccccaccatctcaagagagttagatattaaagagcctggtatctccccttcctcttgcttcctcgctcaccaagtgatttctgctcaagcctgctcccctctgccttccgccatgagtggaagcagcctgaggccctcaccagaagctaagtagatgccagttccatgcttcttgtacaaccaaaacaaccgtgagctaataaacgttttttttttttagaccaagtttcactattattgcccaggctggagtgcagtggcatgatctcggctcaccccaacctccacttccccagttcaggcgattctcctggctcagcctcctgagtagctgggattacaggcatgtgccaccacgcctgtaattttgtatttctagtagaaatggggtttctccatgttggtcaggctggtcttgaactcctgacctcaggtgatccgcccgcctcagcctcccaaagtgttgggattacaggcgtgagccactgtgcccggcctaataaacattttttgttaagagatggggtcttgccttgttgcccaagctggagtacagtgctgtgatcatagctcactgtatccttgaactcctgggcccaagcaatcagtccatctcacctttctgagtagctgggactataggtacataccactgtacctggctagtttttaaaatttttttggtagagatgggggtctcactatgtggcccaggctggtctcgaactcctggcctcaagtaatcctcctgccttggcctcccaaggcactgggattacaggcatgagcccctttactttaaaaattacccagccccaggccgggcgcagtggctcacgcctgtaatcccagcactttgggaggccgaggcgggtggatcacaaggtcaagagatcaagaccaacctggccaacatggtgaaaccccgtctctattaaaagtataaaaattagctgagcgtgggggcgggcacctgtagtcccagctactcgggaggctgaggcaggagaatcgcttgaactcgggaggcagaggttgcagtgagcagagatcacgccatcgcactccagcctgggcgacagagcgagatgccgtctcaaacaaaacaaacaaaaaaaagttacccagcctcaggtatccctttacagcaacacactaaacccgtttaagacaaaggccaagcccagcacagagtcatctcacttggcgttcaaccaaacttctccaatgcagcaaaatggcaaactaaacaatgttactgcaaaatgtgactatagactaataggctctgctgctaaggacaagctctctggcatccagttaaacaaacagccaggaaaaactgaagtgatagttagcaaaacttaggagagaatgactaggcttaagccattttcccaagcacaaccaaaaaaatgattataacaaatagaacataatctgctaacctttcattcttgttatatccttgtgaggtggctcccattttcagataaggaaacaaaaggacagaagtgtaggcaacatatacacagtcatatgactgttatacagtagactgggatttatacccaagtctgaatccaaaccccattttctcatcttactgctacattatgctgccttccatcagctggtaggtgtatgtaataaaaagacatgaggacaaactgacatcatgtccctcctgaggggatacaattggaatttcacatagtatttttgccaaaaatgtttagctggatttgaataattaggaaacagacacaggcagattacaggacattctacaactggcctggactcttcagaaatatgaactgtatgtatttgatgctaaacttattatttttttttttttattttgagacggagtttcactcttgttgcccaggctggagtgcaatggccaatcttggctcactgcaacctccatcttccaggttcaagcgattctcctgcctcagcctcctgaatagctgggattacaggcatgagccactacgcccagctaatttctgtagttttaatagagacagggtgtctcagtgttggtcagcctggtctcgaacttctgacctcaggtgatccacccgcctcggcctcccaaagtgccagggttataggcgtgacccactgcgcctagcctgatgctaaacttcttgaaatagaacagaattgtgtttatgtaggaggcaaaagtcctttttctcagatttttgctgaagtattcaggggtgaagtgacgtgtgtagatatataacatataaacaaatgtgacaaactattaattgctttgaaatttattttcttttttttttttttttttgagacggagtctggctctgtcgcccaggctggagtgcagtggtgccatcttggctcactgcaagctccgcctcccgggttcatgccattctcctgcctcagcctcccgagtagctgggactaccggtgcccgccacctcgcctggctaattttttgtatttttagtagagatggggtttcaccgtgttagccaggatggtcttgatctcctgacttcgtgatccacccacctcggcttcccaaagtgctgggattacaggcgtgagccaccgcacccggcctgctttgaaacttaattaaaacaaactgtaggaaagaaaaaggctagagaccccatcctgttagggtagaagccctgtccatccaagtcaagctgtggaaggatcctcatatttaccatctacttcttttgtttgtttgagacagagtcttgatctgtcgccaggctggaatgcagtggcacgatctcggctctctgcaacctacgcctcccaggttcaaacagttctcctgcctcagcctcctgagtggctgggactacagacgtgcaccaccatgcccagctaatttttgtagagacggggtttcaccatgttgggaaggctggtcttgaactcctaacctcatgatccgtccgcttcagcctcccaaagtgctgggattagaggcgtgagccactgcacccaacccatctacttctttaggtagagctaggatccatcaagctaaaagatgtacctacttttttttttttttgagatggagtttcattcttgttacccaggctggagtgcaatggcatgatctcggctcaccgcaacctccgcctcccaggttcaagcgattcttctgccttagcctcctgctgggattacaggcgctcgccaccatgcccagtaaattttttgtatttttagtagagatagcgtttcactgtgttggccagctggtctcaaacttctgacctcaggtgatccactcacctcagcctccccaagtgctgggattacaggcgtgagccaccgcgcctggccaagatgtacctactttttccagcacaacaaagaagttgattcaatttgcctaatgggtgtgtgtgtgaagaaagtttgatgagacaaattcaccagtagattgaatttatctagtcacttttgccttctagtaacatgccttgtgatttttgtaagtttgcttcttgtgaaaattatttctattattttagagtaaaggtgggcaaactttctgtaaacaggcaaatagtactctctggtccaactactcactatgtcattttaatgcaaaagcagctatagataatgcacagtgtgaatgtacctaatgccactgtactgtaaactcaaaaatggtcaagatgaggccaggtgcagtggctcatgcctgtaatcccagcacttcgggaggcccaggtgggcggatcacgaggtcaggagattgagaccatcctggctaacacggtgaaaccccgtctctactaatataaaaaattagccgggcgtggtggctgatgcctgtggtcccagctactcgggaggctgaggcaggagaatggcgtgaacctgggaggcagaggttgcagtaaaccgagatggcgccactgcactccagcctgggcgacagagcgagactccatctcaaaaaaaaaaaaaaaaaaaaaaaaggtcaagatggtaaattttatgtatgatcttaccataatttactaaaaggcaaaaaaataagccacagataatatgtaaatgaatgagggcgtgtgactgtgttccaataaaaccttatttatggacaccatatttgaatttattattttttgagacagagtcttgctctgtcgcccaggctggagtgcagtggcatgatctcggctcactgcaacctccgcctcccaggttcatgccattctcctgcctcagcctccggagtagtggggaccacaggtgcccgccaccacgcccggctaattttttgtatttttagtagagacggggtttcaccatgttagccaggatggtcttgatctcctaccttgtgatccacccaccttggcctcccaaagtgctgggattacaggtgtgagccaccatgcccggcccatattctgaatttcatacagtttttatatattatgaaaaatttttttttttttgagtcagagtctcgctctgtcgcccagcctggagtacagcagcatgatctcggctcactgcaacctccacatcttgggttcaaacgattcttctgcctcagcttcccgtgtagctgggactataggtgcgtgccaccatgcccagctaatttttatatttttagtagagacatggtttcaccatattggccaggctggtctcgaactcctgaccttgtaatccacccgcctcagcctcccaaagtgctgggattacaggtgtgagccaccgcgcctggccgaaatatttttcattgatttttcaaccatttaaaaacataccaggccgggcacggtggctcacgcctataatcccagcactttgggaggccgaggcaggtggatcgtttgagtccaggagtttgagaccatcctggctaacacggtgaaaccccgtctctactaaaaatacaaaaaataagccaggcgtggtggcgggcacctgtagtcccagctactcgggaggctgaggcaggagaatggcatgaacctgggaggcagagcttgcagtgagccgagatcatgccactgtactctagcctgggcgacagagcaaaactctgtctcaaaagaaaaacaaaacacaaaaaacccataccagcctgggcaacgtggtctacaaaaaaatacaaaaattagctgggtgtggtagcatgcatctgtagtaccagctcctcagaggctgagataggaggattgcttgagcccaggaggcagaggttgcagtgagctgataccacaccactgtactccagcctgggtgacagagcaagaccctgtctcgaaaaaaaaaaaaaaaagtaaaaattcctagagcaccccaggtgcagtagctcatgcttgtaatcccagcactttggagggtgaggtgggcggatcacttcaggctaggagttcaagaccagtccagccaacatggtgaaaccccatctctgctaaagctacaataaattagccaggcgtggtggcacatgcctgtgatcccagctactcaggaggctaaggaaggagaatcgcttgaacctgggaggcagaggttgcagtgagccgagattgtgccactggactccagcctgggcaacagagcaagactccgtcttagaaaaacaaacaaacaaacaaaaaacttaccagagtacccgtttccttctaagggtatacatgagtgaatcagataaaataaaatgttgaaatctcaaccttacctaagatacaaaggaggccagctgtggtggctcacgcctgtaatcctagcactctgggaagccaagacaggcagagagcttgaactcaggaatttgacaccagcctgggcaacatgagaccaaaaccacaaaaattagccatgtgtggaggtgcacgcctgtggtcccagctactctggaggctgagacggaaggattgttggagcccgggaagtcgaggctacagtgagccatgatcacatcactgcactccagcctgtgtcagagcaagacagtctcaaaacaaaacaaaaacacattaaaaaaaaaaaaaaaagcaaaggcaacaagaatcactttccatctactagttctatccagctacaaataaatcttctgcttgtaaaagaaaagccaatgcctcaaccctcaccatctttcaaatcactctcattgcctaagatcactccttcgcctcctgcagtttggcctcaaccgcccacaaaaacatggccaagaaattaaaatttcttgagcatctggctgggcgcggtggctcacgcctgtaatcccaacactttgggaggctgaggcaggcagatcacctgagaggtcaggagttcgagaccagcctggccaacatggtgaaaccccatctctactaaaattacaaaaattagcagggcatggtggtgcatgcctgtaatcccagctacttgggagactgaggcacaagaattgcttgaacccgggagggggaggttgtagtgagccgaaattgggccattgcactccaacctgggcaacagagtgagactctgtcttaaaaaaaaaaaaaattttgctgagcatctgtatatgcttacttgcttcacttagtgtcatttaatcctgacaaaaatggctcttaaaagtcctccattcagcatttcacaggtatacacatgtaaaagctcaagctacatactttaagatttgcacacttggctgcatgtaagttataccttactaaagttgctctcttctttccctctaaatgtacctgcttccagtttcggccttcaacgtagttcacatctgcctccaaacagcctccttggaagtcttactttttgctgtttcaaaccttaaattcttttctctagtctcagtctcttttcagagctcttgtcgtaactagcccacggatgcctgaaatttaacagatccagaatcaaatgtagcaatttctccactctgcaccaaggtcctccttttgctgactcctgtatgaatggcatcaccactcaaatctcaaaaatggccttcccagagttctcatttcccctcatcgaattacttattaactacacctcaataatgtgattctcaaaattcatccctttccattcctatggctactaccctaattcaaaatccccattaagttataaccacactgtgcctaacttttatccctacctccagtgtctccaggttccaatattcactgtctctcctgttcactgctttaccttcagtgcctggcatgtttgttagacagtaggtgttcgacaaatttttgtagcatgaagaccatcacagcatttatctcaccctcatagataactgtgaccctatgttccttcctctgctcctcccatgacatgaggaacgagaccatttttatggcagtgaggaggaaagcgctggcccacagtgggatcaaacctaagaaccatggcctaccaactatacattaaaaatatgtgccattttagtttcacatttctacttcctaaaaactgggcagggggttttctggtagcggatcagcctttataaaaggtctcactagtattagaacttcaccaaaactgattttaataacaatcccttacatggctctaggagagaagacatctaaatttcaagctaatattaattcaatttccctaatactgcagtctggactggctatactagaagtcacccagatctagaacctctttatccagcagctggttctagtattatggcgcttctaagacaagcaggatttgttttactcagctgtttaatcagaatgcctccaaatttacaaagcaaatgttttaatgtccaaggctaatacaccactgcaagggaagaacaggtaggaaaggaaaggggcactaagagaggaacacaccgtaagagggcttggctactgcatagcacatcctcaagactatctcagtgaccacttttaaacatcattaaaacctgttttggaaaggtacacaatttgatctatccccacagacaaccagtcccctaagcctagggtgtcaacaagaaaattctatataaatgacttctagccttcagctaatttacaagctagggcacccaaacatattaatgaagctgattttcatgtcagatggtttccagagaattaacacagttctctcagcatgtaagagggcagcaaaaccatgaaaccaatacagcacttaattttctgcttattaatgcaaacacatgaaacaaatacctaatttcagttcaaactcatttcccttttattaaagtccaagttaccattacatggcttggtactcaataaaggaaaacttgttcaaataaggtaatatgttatcatcagtatttccaggtaactgttcacactcaagtagcaatgtcaataaatccttggggaagcccatctgtaagagaaaacacaaagaattagccaggaaagaataaagaaaaagtagaaatcttttaaaaataacccttagtgctacaaccagggaaatcactgtctctctgtaccctttactgctcttacttaatcctgcctactgtcaacccacaagcgactagctttgtggcttttttgttgtttatacactggtacttccttcccaatcagaaaagtgtccagtagctgccatttaacaaaagaaattttttttgggccggacacggtgactcatgcctgtaacgctagccctttggaaagccgaggcgaatggattgcctgagcatagaagttcaagaccaccctgggcaacacggtgaaaccccgtctccactaaaatacaaaaaattagcctggtgtggtggcccatgcctgcagtcccagctactcgggaggctaaggcacgagaatctcttcaaccgggaggcggaggttggagtgggccgagatcgcttcattgcacttcagcatggatgacagagcaagactctgtctcccaacaaaaaaaagaaaaaaagaaaaaaagttagtatagctagaatatatcctacataaaaaagatcttctggaccccttggaataatacttgataaaatgaaaactaaaaccatcttttaggagttcattatagaatatgaaccacagggctgggcgcggtggctcacgcctgtaatcccagcactttgggaggccgaggcaggcagatcgcgaagtcaggagatttgagaccatcctggctaacacggtgaaaccccgtctctactaaaaatacaaaaaattagccgggcatggtggcgggtgcctgtagtcccagctactcgggaggctgaggcagaagaatggcgtgaacctggaaaacggagcttgcagtgagccgagatcatgccactgcactccagcctgggtgacagagccagactccgtctcaaaaaaaaaaaaaaaaaaagaaaaagaatatcaatcacagggccagacgcggtggctcacacctgtaagcccagcactttgggaggctgaggcgggtggatcacctgaggtcaggagttcaagaccagcctggccaacatggcgaaacccggtctctactaaaaatacaaaaatgaaccgggcatggtggtgggcacttgtaatcccagctactagggaggctgaggcatgagaattgtttgaacccaacaggcagaggttacagtgagcagaggtcgtgccactgtactccagcctgggcgacagagtgagactccgtctcaaaacaacaacaaaaaacaaacaagagcttcaaaagtataactaggaaaatttccattctgaacaactagttttctttaagtactcacagaagtcaaaaccattgcatatattataaagatgagctacttcagggaggttgtgctggtgagggggtggacaaagataaaatgaaaagaccattgcttttggctcacacctgaaacccaaataatttggaaggccaaggtggaaggatcacttgagcccaggagttcaagaacagcctgggcaacatagtgagactctgtctctataacaaaattaaaaataaataaattaaacaaaaacaaacaaaaagaccactccgttaaagcaagctttaaaacgagatcccacctgggcgtggtggctcatgcctgtaatcccagcactttgggaggctgaggcgggtggatcacctgaaatcaggagttcaagaccagcctggccaacatggtgaaaccgtctctactaaaaatacaaaaattagccgggcatggtggtgcatgcctgtaatctcagctacttaggaggctgaggtacaagaatcggcttgaacccgggaggcggaagttcagtgagccgagatcatgccattgcactccagcctaggtgacagagtgagactccgtctcaaaaaaaaaaaaaaaaatcttaaaagtagattacaaagttttcagcattttctgttcagtttctcaacaggaagactgaatataaaaattccttgaattctgaatatttttctttctatgtatgtatgtatttaattaactaaaggagacagggtctcactatgttgctcaagccagtctcaaactcctgatactcctgaactcaagcaatccttccaccttagcctcccaaagtgctgagcttacaggcatgagccattgctgccagccaagttgagtctttttttttttttttttttgagacagagtctcactctgtcacccaggctggagtacagtgacacagtctcggctcactgcaacctctgcctcctgggttcaagtgattctcccgcctcagcctcccgagtagctgggactacaggcacatgccaccacacccagctaatttttgtatttttagtagagacaaggtttcaccatgctggtctcgaactcctgaccttgtgatccacccgcctcggcctcccaaagtcctgggattacaggcgtgagccactgtgcccagcccaaatagaaatactttaaacacaccaaagcaaatgtggcaacaataaaagtatctgaaaatctggatatgtgtacacagactcactatattatcatctatgctactgtttatgcctagaatattgtatgaagatttttctttaattaaggtggcttttatttgtctttctaccagtaagaaaataatgatgccgggcgcggtggctcaagcctgtaatcccagcactttgggaggccaaggcaggtggatcatgaggtcaggggtttgagaccagcctggccgacaggatgaaatcccgtctttactaaaaatacaaaaattagccagttgtggtggcatgtggcctgtagtcccagctacttgggaggctgaggcttgaatccaggatgcggaggctgcagcgagcctagattgcaccactgcactccagcctgggcaacagaataagactccatctcaaaaaaaaaaagacgaaagaaagaaaagaaggaaagaaagaaaataatgacaacaactagaaatcatttcagttctttaaatttaccattactggtattctcaaaatctcttcatgctcacggccattacctctaacaagaacactgaaaggtcttactatagcacactgaaatgtcatccacccacacctctctggattgttttcctgccttcttcagtggtttgtcgcttacccatgcggtttacactttgtcaaggcccagttcctccggagtggagattcccagttcatttaaagttggtctaagttcctggatgacataggggtagatttccttatgaggtcctgctttgtcctgatggcaaagagaatattcacatttaactctctcaaaagccatgtctattaattcatgaaatgaacttaaaaatgcctttaattacttatgcagaggcaggtaggacagaataatacaggtgatcagctgggcatggtggctcacacctgtaatcccagcactttgggaggctgaggcgggcggatcacttgaggtcaggagttcgagaccagcctggacaacatggtgaaatcccgtctctactaaaaatacaaaaatcagccaggtgtagtggcacatgcctgtaatctcagctactcgggaggctgaggcaggagaatcggcttgaacccgggaagcggaggttgcagtgagccaagatcacgccactgcactccagcctgggtgacagaacaagattctatctcaaaaaacgaaacaaaacaaaacaaaacaggtcatctacttttaagttaacacatttgttcggtaagtagggcaacttgctgggtgccgtggctcatgcctgtaattccagcactttgggaggccaaggcgggtggatcacaaggtcaggagttcgagaccatcctgaccaacatggtgaaaccccgtctctactaaaaatacaaaaatttgctgggtgtggtggcacgcccctgtaatcccagctactcgggaatgcttgaactagggaggcggaggttgcagtgagctgagatcatgacactacactccagcctaggggacagagcgagactctgtctcaaaaaaataataataattaaataaaaataaagagggcaacttatatatgtactgttcaaggtaggcttttgaaataccttgagaataactgcaattggactaaatccagaacatcttaaagtctagaattactggaaaagaaggtagtgatgacagaattttgtgaaggcaattagacatgcccagcaggcaacacgaataattaagttaacgggaaaagttttttcatttgcctccaatttgagaccttaactgaattaactaccagtgctgaatggattgatagcctacagaacccttaattatcttacccattatagataaagtaatgtcacacttttgctgttaacggaccttaagtttctttcttacagaccacagtatcttttcatggagagctgtactttgagaatacatatgtccagggctggagacttttcactgtaatatatagttacacctgtgctgtcacaaggttccttaggaacgaataagaagtcaaaagaactaagaaagtgccggccgggcgtggtggctcacgcctgtaatcccagcactttgggaggctgaggcgggcggatcaactgaggtcaggagtttgagatcagcctgaccaacatggagaaaccccgtctcttaaaatacaaaattagcctgtaatcccagctactcgggaggctgaggcagaagaattgcttgaacccaggagacctcggaggttgcagtgagctgagatcacgcaatgattgcactccagcttgggcgacagagtgagactctgtctcgaaaaaataaataaactcagaaattatgaccaaataagaaggaggaaaattagtatatatcctcctatgttttcatataatgtatatatatattttttgagatggagtttctctctcttgttgcccaggctggagtgcaatggtgccatcttggctcactgtaacctctgcctcccgggttcaagcaattcccctgcctcagcctcccgactagctgggattacaggcatgcacccccacgcccggctaattttttattttcagtagagatggggtttctccatcttggtcaggctggtctcgaactcttgacctcaggtgatccacctgcctcagtctcccaaagtgctgggattacaggcgtgagccaccgtgcccagccgacacaaatatgtttaaagtcaaacacatttctacagtatcaacagttgtgtagtataaccagttctgggaagctccctcttaagaattcctaacatttcgtatgacaaatagcaagaagatgaatacactttgtagttaaatctttatatatcctttattatttccttgataaattcctttctttttttttttagagacggagtttctctcttgttgcccaggctggagtgcaatggtgcgatctcagctcactgctacctccgcctcccgggttcaagcaattctcctgcctgggcctcccaagtagctgggattacaggcatgtgccaccatgcccagctaatttttttttttttttttttttttttgagacagagtcttgctctgtcacccaggctggagtgcagtggcgctgtcttggctcactgcaagctttgcctcccgggttcacgccattctcccgcctcagcctcctgagtagctgggactacaggcgcctgccaccacacccggctaatttttttgtatttttagtagagacagggtttcaccgtgttagccaggatggtttcgatctcctgacctcgtgatccgcccgcctcggcctcccaaagagctgggattacaggcgtgagccaccgcgcctggcctaatttttatatttttagtagagacagggtttcaccatgttggccaggctggtctcaaactcctgacattgcatgatccacccgccttagcctcctaaagtgctgggattacaggcatgagccatcacacacggccaagataaattcttaaaaaagaaagaaaaaaaaaaaagagagaaaaaagaaaaaagataaattcttaaatggaattgctgaacaaaagtgtatcatgtacaatttgtaaggccttgaataaatgctgccaaagtagcctctagaaagattttaactgcaatgtacattccttctagttatataaggactcattttaggcattttaacaaattcaaaaatacagaatattctgatacctcagcaatagcccactcatttacagaacaattttagcattattatttcactgaccttaacaacctctaggatacgaactgtactagcaaaatcatttaaccgtctgcatgcccgcaaagcagcatcaatgattttgggctctggaaccatatcataggtaacaagtgtgtttatccctgcaaaattaaaaagaagggccatgtcaacctcgaagagcctcacttaaactatgagttatttatatttttactgaatcactgatgtatgatcttatctgtctgggtctccattctcttacctataaaatgagagaaacctacctttaacaaattctagataataagatcacagtggatctcccttagtgaatcagtggaaagaaagaactatgcaacagcacgcagattgaaggaaaaaatcctgagttttttttttcccctttgagaacaagagggtcattttcaactcctaactttttttttggagatggagtcttgctctgtcacccaggctggagtacagtggtgccacctcagcttactgcaaccgctgccacctgggttcaagtgattctcctgcctcagcctaccaagtagctgggattacaggcgggtgccaccaagcccagctaattttagtatttttagtagagacggggtttcagcatcttggcctggctggccttgaactcctgacctcgtgatccacctgcctcggcctcccaaagtgctgggattacaggcatgagccaccacatccggccctcctatctttaactcttagtacaatgaacacattttggatgctttaaaagagattcaaggctgggctcaggtggatcacctgaggtcaggggttcaagaccagcctggtcaacatggagaaaccctgtctctattaaagatacaaaattggccgggcgtggtggcacatgcctgtaattccagctactctcgaggctgaggcaggagaatcacttgaacccaggtggtggaggttgcagtgagctgagatcgcgccattgcactctagcctgggcaataagagagaaactccatctcaaacaaaacaaaacaaacaaacaaaaaaaccaaaataaaagagattcaactggaaaacagcctaaaaacagccagagaaatgcgtagagttaatgaagcctaaatgaggacattaaggagatattatagagaaacattagtacacagactcataaacattcaaccagaaaatgattgggcatgattactttcagatctgcacaaaatgacacataataaaatttaagattctcttaatgggaatacataattgttctttttattacttctactccagattgttcagtaagaattctattggttgtagcaaaagggaatcattacatttctgcagagaagtttaaagcacttaggtttcttgcttttattactttaaaatatttaaacaaaggataccagtgaatacgatagtcattgagattgaatttttggtatgagataaattaccctacacctaattctattttttcatgttaagtgtgcatctgcaaatttaggaaagacaagttctaacttacttagatacttattcatggcaaaacaatgcaaaaataacaaaaaacccaaaccatcacccaaaggggaagggaaccaaatgactgctttgtgtaaattcttttttttttttctgagacagagtctcactctgttgcccaggctggagtgcagtggcgcgatctcggctcactgcaagctctgcctcccgggttcacgccattctcctgcctcagcctcccgagtagctgtgactacaggcgcccgccaccacgtccggctaatttttttgtatttttagtagagacggggtttcaccatgttagccagaatggtcttgatctcctgacctcgtgatccgcccaccctggcctcctaaagtgctgggattacaggcgtgagccaccgcgcccgtgctatgtaaattgtttgaaatgtacaaaactgttaccttttgctcatctagccttattgctatagcagtggttttcaattaagggtgacttcatccctcaggagacactgggtaatgcctagaaacatttttggttgtcatgatacgaatgtgtgcatactggctcctagcaggtagaggccaaaggtgatgctaaacaccctacagtgtaaaggacagtcccctacaacaaagaattatctggcccaaaatgtcaatagtgcctgccttaaaatcctgctttataggtagccataaactttcctaactgcaagttgcatgaagtaaccagtttaaacaacgcatgttttcgaaacagttgctctcaataaaggagcagaagcagttcatatttacacaccaaaatagacaaatatgtttatgttccaattacctttacgcaattcccaggcatctatatctggcttgttgaagtatgttacccagcgagcatcaaactcctcatctgtctcctgtgacccatgggaatagcagcgaactgactggatagctataatgtgaaagaaccataacttcaatgtacacaaatagtacttgatatattttgttcaatgcattaaattttgagttgactatatatgttgtggcagcaaaaatattgaacaggtcaaatgaaatacatcgtatacattgatacagaaagatatattttaaattaagcaaataaaatcaagtagaacaaaaagtattacataggcatgtttatacttttctccctaatgtataatactcgcttgaaattattaacagtggttccctctgattttaaattaacagtgattatcatgggacgtaaaaactactttatatacttccatattgtttgaatttttacacataaccagagtattaattcctaagtaaaaatgtcccaggtgggcatagtggggcacacacctgtagtgccagctactcagaggctgaggcaggaagattacccgagcccaggagttcaaggtcgtagggtgctaacaatatgacagaacctgataagatagccattgcattccagcctgggcaacacagcgacaccccacttctaaaaactaagaataggccaggcgcagtggctcacgcctgtaatcccagcactttgggaggccgaggcaggcggatcacgaggtcaggagatcaagaccatcctggctaacacggtgaaaccccgtctctactaaaaatacaaaaaattagccaggtgtggtggcgggcggctgtagtcccagctactcgggaggctgaggcaggagaatggcgtgaacctggacggcggaggttgcagtgagctgagatcacaccactgcactccagcctgggcgacagagcaagactccaactcaaaaaacaaacaaacaaacaaaaacaaaaacaaaaacaaaaactaaaaaactaagactaggccgggcgcagtggctcacgcctgtaatcccagcactttgggaggctgaggcgggtggatcaagaggtcaagagatcaaggccatcctggccaacatggtgaaaccccatctctactaaaagtataaaaattagctgggtgtggtggcgcgtgcctgtagtcccagcaactcgggaggatgaagcaggggaattgcttgaacccaggaggcggaggttgcagtgagccaagattgtgccactgcactccagcctggcgacagagcgagactccgcctcaaaaaaaaaaaaaaagacaataaacaacaacaacaaaaaaaaccaaaaaagcaacaaaaaaaaaaaactaagagcaatactaatgtccattcaagttcttttttttgagacaggctctcgctctgttgttgcctaggctggagtgtagtggcgcaatcacagctcactgcagcctcaaattctttgggctcaagcattccttcctcccttggctcccaaagtgctgggattacaggtgtgagccaccagccctggcaccattcaagttcttaaataaacttatatacttcattcacacattaaaaaaaaaaaaatctcgggccgggcttggtggctcacgcctgtaatcccagcactttgggaggccgagatgggcagatcaccaggtcaggatatcgaaaccatcctggctaacacggtgaaaccccgtctctactaaaaatacaaaaaattagccaggtgtggtggcgggcgcctgtggtcccacctagttgggaggctgaggcaggagaatggcgtgaacccaggaggcggagcttgcagtgagcagagatcacgccactgcactccagcctgggcaacagagcgagactctgtctcaaaaaaaaaaaaaaaaaaaaaaaaaaaaaattctcatgttattatattccaaaataaattacacatcctgacaaattacacatacaaattgctttatcaaactacagccccttcccaaaatattctgataaatcccctaagggaacgtacactctaatctacacctaatgcaaaataatactgttttactaggaatattttgggctgggcgcagtggctcacacctgtaatgccagcactttgggaggctgagactggtggatcacctgagttcaggagtttgtgaccagcctgatcaacattgtgaaactccgtctctactaaaaatacaaaaattagctgggcgtgatgacgggcgcctgtaatctcagctacgcgagagactgaggcaggagaatcactcgaacccaggaggcggaggttgaggtgaggtgagatgatgccattgtactccagcctgggcgacacagcaagactctgtctcaaagaaaaaaagaaatgatgtttacatagagtactgtatgaaaagcatttccattttttttttttttttttgagatcgagtctcactctgtcacccaggctgaaatgcagtggaacaatctcagctcactgcaacctctgcctcctggattcaagtgattctcctgcctcagccttctgagtagctgagactacaggcgagcgccactaagcttggctaagttttgtattttgagtagagacgggatttcaccacattgcccaggctggtctcgaactcctgacctccagtgatctgcccacctcagcctcccaaagtgctgggattacagacgcgagccactgcacccagccccattttttctttcttcttgtcaaatggacactgaattgagtttggaaatctgaattccttctgaacagcctctggaacaggtagggggataggcggaggcagaaaattttatctttgggtattgaatgcagcacaacctagcactcagatacctctaggctcttcgctctctctgtttgaccctggaaaattaacttaagtttattttccttatctgtaaaatggggacgctaccccccttagcagattatgaagattaaatgtgaaaacaggtaggttaacactatgcactggtaagtattaaacaaatggtagctataaactaacccttatctaaaaacgtcttagttgtctatttatagaaatcataacttaaagaaatgaaacctatctcaaatcacatttcctactacctgtattagataagtgtggtgtaacttccagttgtttaaggcttaacatatttttatttatttacttttagagatgggggtcttgatatgttgcccagggtggtcttaaactcctagcctcaagcaatcctaccactcccaaaatactagaattacaggtgtgagccaccatgcccagccttaacatacatatatatatatttttaaaaacttcacccagaaacctctcaacattgttgttctaagaacactgaaatttaaacattagtaatatcctatatatctttaatgcagtaactggcaggaggaagagtagcaaaaaaacgaagcagaaaagatcttcccagagacctaaattacctacataatccaagcccagaatgaagtggaacatgtacataaatggactagaagtgaacacgttttaatttctttttttttttttttgagacagagtctcaccctgtcgcccaggctggagtgcaatggcacgatttcggctcactgcaacctccacctcccgggttcaagtgattctcctgccttagcctcccaagtagctgggattacaggcatgcgccaccatgtcaggctaattttttgtatctttagtagacacaaagtttcaccatgttagtcaggctggtctcgaactcttgacctcatgatctgcctgcctcggcctcccaaagtgctgggataacaggcatgagccacggtgcccagccttaatttctacaacaagaaaaaaatggatctctacacctaaatatgtctggtaagtatgaacatttaatcaaaactacgtggatatttaataagtcttacaagactaatattcaaatttaatatatcagaaaacaaggccaggtgcggtggctcacacctgtaatcccagcactttgggaggctgaggcaggcagatcacttgaggccaggagttcaagaccagcctggccaacatggtgaaaccctgtctctactaaaatacaaaaaattagccaggcgtggtggcacacccctgtagtcccagctacttggaatgctgaaggaggagaatagcttgaacccagggaggttgcagtgagccaagatcgtgccactgcattccagcctgggcgacagagcaagactccgtctcaaaaaaaaaaatatctatctatctatctatctatctatctatctatctatctatctatgtaaaaacatagattagaacaaccatctaatgcactattatcaagaacttagggccagatgcagtggcactagcctcggagacagagtgagaccctgtctcaaaaaagaaaaaattataagccacctcttcaaaaactaaagctagccttaactgaatactgaaagtgcaagtataaaatgatacaatcactttggaagacggtttaagcagtttcttatcaagttaaacacaaacctaccatataacacagtaattccactcctaagtatttacccaatgaaaggtctatgtactccttccccagaggtaattacctgtcccatccacaacagtgcttcatgataagcaattcgttttgttcactgctgggcatggatttgactacatgagtgctaggctttgtttcctaactgtgaataagatgaccaccaacagcaaatccaagtcaaggagatcaccaccttcaaggatttgatcatatgtcttctggaagccaaattacaaactggttgtattccaaaaagtcttttataaaacagaactagaactttgagaggccaaggcaggatcgcttgatgccaggactgagagaccagcttgggcaacaaagacagacctccattctccacaaaaaacttaaaaaattagcggggtttggtggtcccagctactcaggaggctgaggcgggaggatcccttgagcccagggcaacaaggctgcagtgagctatgactgcgccactgcactctagcctaggtgatagagcaacactctatatcaaacaaattaaaataaataaaaatttaaaaacccatacatccctttctgaagggctaaaacagactctccccacgtgatttaaattttttttttttttttgagatggagtctcactctgtcgcccaggcgggagtgcagtggcgcaatctcagctcactgcaagctccgcctcccaggttcacgccattctcctatctcagccttcccagcagctgggactacaggcactcgccaccacgcccggctaatttttttgtatttttagtagagacggggtttcaccgcgttagccaggatggtctcgatctcctgacattgtgatccgcccgcctcagcctaccaaagtgctgggattacaggcgtgagccaccatgcccggccatgatttaaattatattgttaaatccaataatgggtaaagcaggatctattctattagctatggacacatcccccacatgcttaactttttttaggtaaactctactagcattctctgccccacacaccccaccccacttaagaacaggatctccacctagtattgaagcttgaaaggcaaattattttggaaaacaattactcagagcttttacgtaacctgaaagtcccaaagtaagaaaaaagaagcagctgtgaaaaatgaggacatttttagggcttcatcctaaaaagctatttctaacactgctttttggcattcagttaagcactccatttaaaaacaaaaaaggctaacatatatagaaaaataaaagggctcattgatcctttgggtttaaatttagttaaatcggatagttttccatttaataaataatcaaccctgacaggcccaaagaatgaacactttggtggtggtaactgtaggaatgagggcacattaacgagttactgaggctgggtgcagtggctctcgcttgtaatcccagcactttgggaggctgaggtggaaggatggcttgagcccaggaggttaaggctgcagtgagctgtgccaactgcactgcagcctgcatgacagagcgagaccctgtctcaaaaacaaaaacaaaaacaaaacaaaaccacaacaacagaagaagaaaaagaaaaatttggctgggcatggtggctcacacctgtaatcccagcactttggaaggtgggaggagggaggcactcctgagcccaggagtccccagaccagcctgtttctacggaaaataaaactggtggcgcacccttgtggtcccagctacttggaaggtggaggcaggaggatcagttgagtcccaggaggtcaaggctgcagtgagctgtgatggtgccactgcactccagcctaggcaacacagtgagactatcaccaaaaaaaaaaaataaataaataaataaataaaaaattttttttttgagatggcatgatttcggctcactgcaaacctctgcctcccgggttcaagcaattctaatgcctcagcctcccaagaagctgggaccacgtgtgcgtgccaccacacccggctaatttttgtatttttagtagatactgggtttcgccatgttcaggctggtctggaacttctgatctcaggtaatctacccgccacaacctcccaaagtgctgggattacaggcgtgagccaccgtgtccggctgaaaaatgtaaattgtactgttactttagcaaaacacaaaatctaaacaaacatcaggatggcccaaacataactataagaaacaaaaatggttccaccattaaaaaggagtcagtttcggccaggtgtggtgtctcacgcctgtaatcccagcactttgggaggctgaggcagacggatcacctgacctcacgagctcgaaaccagcatggccaacatggtgaaaccccatctctactaaaaacacaaaaagtagccgggcatggtggcaggtgcctgtaaccccagctactccggaggctgaggcaggagaatcgcttgagccaagaccgtgctattgcactccagcctgggcaacaagaacgaaactctgtctcaagaaaaaacaaaacaaaacaaaacaaaacaaaaacaaacaaacaaacaaaaaaaaacaaggagtcagtttcccaagatggactttggtttccttttctataaaataaaatggcttccacgatctctaaagtacactctaggttggctgcagtggctcatgcctataatcccaaactttgggaggctgaggtgggaggatcacctgagcccaggagttcaagcccagcctgggcaacatagggacactccgtctctaatttaaaaataaataaataaacaaaaataaagtaccctccagccttatggttctacgacaaatgataaaagtctaaaatgaatgaagcaaaacatattcttttttttttttttttttttttgagacggagtctcgctctgtcggccaggctggagtgcaatggcgcgatttcggctcactgcaacctccgcctctcaggttcaagcgattcttgtgcttcagcctcccgagtagctgggattacaggcgcccaccaccacacccagctaaattttttgtatttttagtacagacagggtttcaccatgttggccaggctggtcttgaactcctgacctcaggtgatccgcccgcctcggcctaccaaagtgctgggattacaggcatgagccaccgcgcccggctgagttctttttttaatttttaacttcagcataccctgaaacgagtttctgagttcttatgtttaaatacgcatgcatagttgccagtgatgcaggttcaaaaataaaatataatatgcatgcatagaagctaaatttcacggaccaagatcgaagtgcaattactgtaattattctatggtggtggactcaaaacctcccagcacacatataaagggaaggaaaatagacaaaaatcagaagcacgtctcatactccagcaatcaggcttctattacaaaggggaaaaaacacgaagcgttcctatgcttgtaaaacccagtattcctgtgtctgtgacattcagttttcaaaagagtgatatttttatcataagccctatcaaaactctggctatcttccggagatcaggaaacaaccacacacttccatctattttaaacgtggaagaattagaacgtggcacagcagaccctaaaaatgatggaaaaggctgtgaaggtgacacactaatcgctaaccgagaaatgcctgattgaaaagtataatcgtgtgtcccatacggaagtatattgtgtcctcggaccccaagcggcgtgcccggaggctcaatgtcaccttcgccgaggcgctgcaggccggcggcggccactctcggtcaggtggccgcagggtcggcgctggggcagggtcatggcccgggaaccgaaggggagcgctgcgtcccctcctcggcgcccacagcaggtccacatctgacctgtccgcggtggcacagccaggaagttgcgcggggggaggccccgggggcgcgctttcaggtcctccactactcgaggcggcgggcagggcggcccgcggtcaccgggttcagtaaccagggtagggcaagggctaggccggggagagcccgccccggagtggcagcggggacccaggtcaccgcaaggacacgagggcgcgggcagtggcaagcaggggccttacccacggcggggccgggggtccgggcggagtgcaggaggcctcgagggtcggcccgggtggttgcggccacagcgcagcggcggagagcggcgcccagcatgacggcgatggcggcgcgcgggctgaggacagagagaagccggtgtaagctcgcgggttgctccggagcgggcgggggccggacaggctcacagcgggcggagcacgtaggcccgcccactgcgactctggcgcgtgggcgggaggagccaccgcgcggccggcggcggcgggggctacggcggcgcgctgaggacaaactgttagcctcgcgtcccgccttgtctctggtcaggtgacgtgcagctgccatcctgtaagtaggaatggaggcgagggaggagcaaccgaccgtgatcttgttcgagtcaggcccaggagggcacttaatcacctcaaaataggaatgacagcaataacaacaaactataataaaaaatacgtactttgcgcccgggcgctgtggctcatgcctgtaatcccagcacttttgggaggccgaggcgggcggatcacctgcggtcgggagttcaagaccagcctgggcaacatggaggaacccccgtctctactaaaaatacaaaattagccaggcgtggtggcgcaacgcatgcccgcaatcccagctactcgggaggctgaggcaggagaatcgcttgaacccaggaggaggaggttgcggtgagccgagatggtgccattgcactccagcctgggcaacaagagcgaaactccgtctcaaaaaaaccaaacaaaacaaaaacctactttgcttagccccgccttctcattgtggcataaaataaaacagcgaatgggggaaagaatgccgctggacgcggttgctcacgcctgtaatcctagcactttgggagcccaaggcgggcggatcacctgaggtcgggagttcgagaccagcctgaccaacatggagaaacccctgtctctactaaaaatgcaaaattagccaggtgtggtggcgcatgcctgtaatcccagctatttgggaggctgaggcaggagaattgctggaacccaggaggcagaggttgcagtgagttgagatcgcaccattgcactccagcctgggcaacaagatcaaaactccatctcaaaaaaaaaaaaggcctatgcgtaagggattttattagtacatattcttatatcacaaaccagcttgcataaaaaatgagttaaactacttcatttcacagattaggaaagaggctcagaaattaggttgctgctggcagtcaaggatcttttcgccacatccccagttctgaggactctcacctgaatgtttcccatctcctacaggagggctcctgaatccacgatggctctgaaatagggttgatcaagttccacagttgttgcatcttatctcactagctacatcctaactttgagcccctgggcagtcaaggacacctctcccaggcctgaagtatctggatgctgcccagagttaatgagacattgtattctgtcttgctgtctcccattctctatccctgggcacactgaggaaagaaaaggtggccattcatgtgccacttcctcacttcaggccgactctccagggcctcagcatctgcccttctctttttcctccctagcagtgtggcttcagtgggtaggaacctggcggggaaaaggatttttaaaatgttttcaaagcacctgccctcaccgtttcccaccaacctagtgctggggcttagaaaacaataccacaaagtgaaggcctatgaagcagtttctctctgaccttctgccctcttgtctcttgccccttactctccctccaggcatgccacagaaactagaatccctcctccccaagagggggtctagaaagtagaacccctttgtcccaaagccagccataaagcctaaaaatattgctctaacctttctctttgcctttctatgtaacagctggccataaagaaattaaggccgagcacggtggttcacgcctgtaatcctagcactttgagccgccaaggccaggagatcacttgaggtcaggagtttgagaccagcctggccaacatggtgaaaccccatctctattaaaattactaacattagccagaaatcacttgaacccaggaggtggaggttgcggtgaggcgagatcacaccactgcactccagcctgggtgacagagctagactccgtctcaaaaataaaattttttaaaaaaaaggagaaaaggaaacatggccaggtatggtggctcatgcctgtaatcccagcactttgggaggctgaggtgggaagatcacctgaggtcgggagttcgagaccatcctggccaacatggtgaaaccccgtctctacgaaaaatacaaaaattagctgggtgtggtggcgcacgctactctggagcctgaggcaggagaatcacttgggcccgcgaggtggaggttgcagtgagccgagatcgcacaactgtactccagcctgggtgacagagtgcgactccgtctcaaaaaaagaaaaaaagaagttaaggctgggcgcgatggctcatgcctataatcccagcaatttgggaggctgaggtggggggatcacctgaggtctggagtttgagaccagcttgaccaacgtgaagaaaccccgtctctactgaaaatacaaaattagccgggcatggtggtgcatgcctgcaatcccagctactcaggaagctgaaacagtagaattgcttgaacctgggaggtggaggttgcagtggaccgagatcttgccactgcactccaacttgggcaacaagagtgaaactctatctccaaaaaaaagaaagaaaagacactcgttccagtagtagggaggacagggaggaagaaatgctacaaaagagaggccagaaggatttgaacagacaggctttgctgggttttcccactcaatccatttccgttagcttggaccctttttgtccaatcacaattctacatatgctttattgaacctaagcataaaggacgattttccttgtatctatgggtcttcagtctgaagcctcccatgtcacataaaactatgatcaagtaaacttgttatggttttttctttttaacctgtcttttgttatgggagtgtcagccatgacccttatgatggtgaggaaaaggatcacccctttctgcccctacactggccaaagggcaacggggaaacctttgacctctctgcagttcaattagtgttcatcaaatctccaaggctggaagcttaagatgaggtcagggtaagaaagtaagaaaagtaagaaaagcaagtaagaaagcactgggctatattgcttgaatcccagctggtctccctgctgtcagaatccctccactttgcctacagtcacttagattggctgctgaagtgtttttttttctttttaaaatacaattatgactataatttacaatgtgccactacatgccacaaactattatcccatttatgcctcataacaaccttgtgagataagtttttatccctattttcaaaatttattttattttattattattcttttttgaggtggagtctcgctccgtcgctcaggctggagtgcagtggtgtgatcctggcttactgcaacctccgcctgccaggttcaagtgattctcctgcgtcagcctcccgagtagctgggactacaggtgctcgccaccatgcccgtctaatttttgtatttttggtagagacgctgtttcaccatgttggccaggctggtcttgaactcctgacctcaggtgatcctctcaccttggcctcccaaaatgttgggattacaggcatgaaccactatgcccggcctagccctgatttattgataaaggaatagacttaaaggatacttgccaaaaatcatacagctaacaaatagtggtagttaggttttagtccccacttgtctgactccagaaattgttctttccctaccactgctgaaggtaggttttgcttgtctttcagtcagttctgaattctctgctaccttgagagcagtccacagccctaattgcctgcattcattttttgttgctgcctaacaatttatcaggtatagcataactgaattctctactggttatcacaagactgaaatcaagatcacggctaggttagacatctcatctggagctcagaggcctcttctaaggtcattcaggttgttggcagaattgatttcattgcagtggtgggacaaggtcctcatttcttctcggtagctgtcagccaaggacactctcaactcctagagagtgccctgatgtcctctccacttggctctctccataggcccttcttacaatcctggagcttatttattccaagcagcaggaaagtgtctctctgacactttacctgcttttaaagacttcatctcaaggtgggcggatcacttgaggtcaggagttcgagaccaacctggccaacatggtgaaaccccatctctactaaaaatacaaaaattagcagggcgtggtggtgggcacctgtaatctcagctacttgggaggctgaggcaggagaatcgcttgaacccgggaggcagaggttgcagtgagccaagatctcaccattgcactccagccaggggtacagaagactcagtcaaaagaaaaaaaaagacctcacctgattaggtcaagcccaccagggtaactttttgattcactcaaagtagactgactagtaaactagtcttgggaatgatatctaaagaaattcacagattctgccccctactcaagaggaggagattgtacaagggcatgtaaacagggggcatgaatcctggggctatctttgaattcagcctaccatatcactaaggcacgggggcccttgcttgtttcctagttggcccccagatgtgtccacaggttgaagcccatcccattgcttctggagggtaccccttccctgatgggctcagagcagacatcctggttcttactcaaggtcttcagggtcttttatctcttcctgccatttcctaccttgaaatccttcgctgtccctctggagaagccacacctggacttttgcttcttcttctttttttaaaacacaacagctggacttctgatggctcagaaatgtcatcgtcaccagtggatcagcctatcagctttctgctacagctcagggccttcattctggaaaagttgtgatgaggcagtccctctgatgtgtgtgggggatggaatgacattactgaggagtttgtgaggataaagacactgttccaccatgtgaatttctagtaacggttaagttcacgtgcaagaaaagctcttttttttgttttttcttctcttttctttttcttttcttttttatgtttttgagatagggtcatgctctgtcacccaggctacagtgcagtgacagaattatggctcactgcagctttgacctcctaggctaaagcaatcttcccccctcagcctcccaagtagctgggactacaggtacgcactaccattcccggctaatttttttaacatttttgttgagatagggtcttgttatgttgcccaggctggtctcaaactcctagcttcaagcaatcctcctgccttggtccctcaaattgccgggattataggcatgagccaccgcaccaggctagaaaagctcttattttctctggtgggaattaagcatgtgctcaggaaaaagagggggaaaaaaatgaaagaatcctaccattttaagactgaaagtgggggccgggtgcagtggctcaagcctgtaatcccggcactttgggaggccgagccgggcggatcacgaggtcaggagatcgagaccatcctggctaacacagtgaaaccccatctctactaaaaatacaaaaaattagccgggtgtggtggcaggcgcctgtagtcccagctacttgggaggctgaggcatgagaatggcgtgaacccggcaggcggagcttgcagtgagccgagatagcgccactgcactccagcctgggcgacagagtgagactctgtctcaaaaaaaaaaaagactgaaagtggcccccgaggccattagtctactgagtctacatggtttccatttcctcaggcccctacttgaggagcatctccagtgaacaggatctcaatactagactgcttcgaaaacagagcctaatgaaaaaagtcacccaagagaatgacaccctcaccgctattaaactacagttctgccttatgcccttgggcaaattattccaattccctgaaccactgtttccttgtctaaaaaatgggaatagccgggtgtggcagctcacgcctgtaatcccagcactttgggaggccgaggcaggaggatcacctgaggttgggagttcaagaccagcctaaccaacatggagaaccctgtctctactaagaatacaaaatccgcctcgcggcttcaagcgattctcctacctcagtctcccaagtatgccagcatgcctgtaattccagctactggggaggctgaggcaggcgaatcgcttgaatctgagaggtggaggttgtggtgagccaagattgcatcattgcactccagcctgggcaacaacaacaacaaaaaattagccaggcatggtggcacgcgcctttagtcccagctacttgggaggctgagacaggagaatcgcttgaacctgggaggcagaggttgcagtgagccgagatcacgccactgcacttcagcgtaggcgacagagcaagactccatctccaaaaaaacaaaaaacaaaacaaataaaaaatgggataataatggaacctacctaataggttaatagattgttgggacgattacctcagaaaatgcacataaaacactatgtcctggctggtatacagtaacagctcaataaatgcttactgttgctctctaaaagagcattttcttgttgtaaaattgtagcggggcagggcaagttgtgagatggggatgttttagtctgttttgtgttgctataacagaatacctgagactcggtaatttatttatttatttatttattgagacaggctcacccaggctggagtgcagtggtgagatcttggctcactgcagccttgacctcctgcgctcaagcaatcctcccatctcagcctcctgagtagctaggaccacaggcatgtgccacctcacccagctaatttttgtacaggtaatttataatgaccagaaatgtattggcttatatttctggaggctgagaagtccaatatcaaagtgctggcatcttgtgagggccttcttgctgcatcatcccatggcagaaggcatcacatggtggaagggcagagaatgcaagagggggtgaacccactcccttgatgaacaaatcattctttttttccccccacaggctggagtgcaatgactcgacctcggttcaccacaacccccacctcctgggttcaagtaattctcctgcctcagcctcccaagtagctgggattacaggcatctgccaccatgaccagctaattttgtatttgtagcagacacggtgtttctctatgttggccaggctcgtctcaaactcctgacctcaggtgatccgcccaccttggcctcccaaagtgctgggattacaggcatgagccaccgcgtctggccaagaactcattcttgcaataatggcactggtccattcatgagggtagagccctcatgacctaaaaacctcttaagggttccacctcccaacaccaacacaatgacaattaaatttcgagattagtttgattttttgtttctttgtcttgttttttttagagacagggtctcactctgttgcccaggctggagagtagtgacatgaccataggtcactgcagcttcgaactcctgggcttaagtgatcctcctgcctcagcctcctaagtagctgggactacaggtgaacactactacacctggacaattttttggacagggtcttgctatgttgccaggccgaccttggacttctgggctcaagcaatcctcccacctcagtctcccaaagtgctgggattatggaccacatccagcccagttgtttcttgtgagtggcttataaatagacatcttttttccctgttttcacatggtctttcgtctgtgtgaacacgtctgtatcctatatcctaatgcctttttttttcttgagatggagtctcactctgtcgcccaagctggagtgcagtggcatgatctcagctcactgcaagctccgcctcctgggttcacgccattctcctgcctcagcctcccaagtagctgggactacaggcgcctgccaccatgcctggctaatttttttgtatttttagtagagacagggtttcaccgtgttagccaggatggtctcgatctcctgacctcgtgatccgcctgcctcggcctcccaaagtgctgggattacaggcgtgagccaccgcgccctgcctgctttttattttttaagagactgggtctggctattttgcccaggctggtgttgaactcctggactcaagtgatcctcctgcctcagcctccccagtagctgggactacaggttgcgacaccaacccaggctgtggcagttatttaacagtgtttctctccagaaacatgttcaaaccattactgaaggtgaaaagcaaaagaaggggatttaattttgtgtctctcttaccactgtaaatgtggctacataacatctcagagaataaacaatcttgatgaaccatcaaaatcagctgaagatcttattacaatgtgtattcccaggtccctcctgggagaatctgatcctgttggtttagagtttagcccaggtaatctgttttttgtttgtttgtttcgttttcttttttggttttttgtttttgttttgcttttgagatggagtttccctctgttgcccaggctggactggggtggcatgatctctgctcactgcaacctccgcctccctggttcaaacgattctcctgcctcaacctcccaagtagctgggactacaggcggctgccagcacacccggctaatttttgtatttttagtagagtcagaatttcgccgtgttggccaggctggtctctcactcctgacctcaagtgattcgcccaccttggcctccccaaagttctgagattttaggcgtgagctaccacacctggcttgtttttgtttttttgagagggagtctagttttgtgcccaggctggagtgcagtgggcgatcttggctcactgcaacctctgcctcccgggttcaagtgattctcctgtctcagcctcccaagtagttgggactacagacactggccaccatgcccagctaatttttttttttgtatttttagtagagatagggtttcatcatgttagccaggctgctctcaaactcctagcttcaggtgatctgcctacctcggcctcccaaagtattgggattacaggcgtgagccattgtgctggctttttttttttttttgacacggtcttgttctgtcacctagactggagtgcagtagtgtgaacatggctcactgcagcctttaacccctgggctcaaggagtcctcctgtctcagccttcccagtagctgagactacaggtgcataccactatgcccagttaatttttgaaatccgtaatctgttttgttttgtttttttttttttaacatggagtctcactctgttgcccaggctggagtgcagtggtgcgatctcagcctactgcaccctccacctcctgggttcaagcaatcctcccacctcagcctcctgagtagctgggattacaggcccacgccaccaagtcccagctaatttttgtatttttagtaatgatgggttttcaccatgttggccaggttgaactcctgacctcaagtgatccgcccaccttggccttccaaagtgctgggattacaggcatgagccaccaagctcggccagtaatccgtatttttacacttgattttagccaaaaggtggagaagtgatagtaatctgtatttttaataactgtccaaagcgatcctgacaatgagccaaggttgagagttccggtagtattatctcccttttctccacagcaatctggtttattttgcaaacaagaaaactgaggctcagagaagaattaacttgcccaaagcctcaatcatactgacttcctccaaagcctatgatctcttccatacaacatcagacataacgtttgttggcacaaggctgcaaagtagagaccttcccaccacgcagggctggaaattctggtaacaggggccttggcaaacaacccacattcctcttccctattcccactgaaggctgtgagaacacttgttggattagagtcctagctgccataatgaagtactacaggctgggtggcttaaaacccagaggaggccgggcgcggtggctcacacctgtaatcccagaactttgggaggccgaggtgggcagatcacctgaggtcaggagttcgagaccagcctggccaacatggtgaaaccccatctctactacaaatacaaaaattagctgggcgtggtggcaggtgcctgtaatcccagctactcaggaggctgaggcaggagaatcacctgaacctgggagtggaggttgcagtgaaccaagatcgcgccattttactccagcctgggcaacaaaagcgaaactccatcgcagaaaaagaaaagaaaaaagcatagagaaaaaaaattattgtctaacagttctggagattagaagtctgagatcaagtggggcagggccatgctctctgaagactctagggaagtatctgttccatgcctttctcttagcttctgtcatttgcaaccttccttggcttgcaggtgtataaatccaacctctgcctccatattcacatggtattcttccctctgtgtaatcaatctctgtctcttctctattttataaggattcctcattgaattaaattgtattggattaagggcccattttacttaatatgacctcatcctaatttcttaatttagatctttattaaatctgctgaatctcttttctttttctttttttgagacagaatttcgctcttgttccccaggctggagtgcaatggcttgaccttggctcactgcaacctccacctcccaggttcaagggattctcctgcctcagcttcccgagtagctggaattacaggcatgcaccaccatgcccggctaattttgtatttttagtagagacagggtttctccatgttggttaggcgggtctcgaactcccagcctcaggtgatccacccgcctcggcctcccaaagtgctaggattacaggcgtgagccaccgtgcccagccttttttcctttttttttttcgagacagagtctcactgtcacccaggctggagtgcagtagcacaatctggtggctcactgcaacttccacctcctgggttcaagtcattctcctgccttagcctcttgaatagctgggattacaggcataagttaccacgcctggccaatttttgtatttttgaagagatggggtttcacaatgttggccaggctggtctcaaactcctgacctcaggtgatccacctgcctcggccttccaaagtgctgggattgattacaggcatgagccaccatgccaagccagagtttccaaataaggtatcagggattaggacttcaacatgtcttggtgggggggcacgaaattcaattcatagcacctataatattcaggtgtcagaaacaacactggaatcctcaagctgaatatacaaacccaattgccatggtgaccctagcttctccaaaggcaggggtacccaagggctcagatgggatgagaagctgtggaagagataggggcagctttggccattggttggatggttaagaattgtaatgtgacatcagaacagttcagaaacctggctcagaaagtcttttgttggtttgaaagagtggagtgatcatggctcactgcagactggacctcccagactcaagcaatcctcccacctcagtctcctgagtaactgaactgcaggcacacaccaccacatccaactatttaattttttttttttttttttttttttttttttgtagagatggtatctcactatgttgccagggctagactcggaactcctgggctcaagtgatcagcgctcctaccttggcctcccaaaatgctgagattacaggcatgacccactgtgcctggccagcggcaagtccattcaatcaacaactctctaagagcttctcatgtgccaggagctgggcaaggagcaaggcaggcaggatccagtcaatcacgggctcatgggttagtagggtgaccaatagccaaaagataagactaatgaggacacacttataaaccagtatctgtgctctgaaaggaagaaacttgatgcctttgaggagaccctcctgtggctgcattttcctcctctttcattctccttcccttccttcctttcctttgcctttctaactaccattctcttggagacctgcgagtgtttcaacatctcagtgaaatagagggacgagagcatcacctagtggtcagtgtgggcatagcaatgaccaaaactgaactaatcagcttgggagatgaagggcaaggggtggtgggggtaggcagtgtgtgtgtctggcccaggtatgcacctaacagtgaagtgaatacactctggcagattcatggcaatggacaacagctcttaaagatttaccaatttgaagctgggtactcccacctcccacaaaaaataatcactccattgtttggtcctgacatagcacgtcccctggggtgccagaaaggcagaccaagtcctggccaggcagggttaatgctcaaggagaaccctcccatttcctggctgtaatagcagtgaaatcctacctagcctgggtagctctcacatctgctcccatctccctccgcattgccgatgtctcatctcttatccctgcattgtctctagggtctaatcagacccccttccaatccactcccacttacacaggtgtcagagggatccttctcaaacaccagtcagatctgggctcagagcactccctggctcccagtggctccctcacttccctgtgacctggctcccaccggctccctcacttccctgtgacctggctcccacctagcactctagttcacctgcatctctacacgttaccctctgccatctcctctatccatcagacacctgtggcagcctcagcatcatacacacccgctctctatgctctgcctggagctccctgtccagtcttggtcagctggctaactcctgatccttggagaaccagctccatcagcacctctgggcaaggtaagttccccttctcagagctcccatcttctatcatcacactgtgctagatgggcccaggctggagtgcgatggcacatctcagctcactgcaacctccacctcctgggttcaagcgattctcctgcctcagcctcccaagtaggtgggatcacaggcgcccgccaccatgcccggctaattttgtattcatcatattggtcaggctggtctcaagctcctgacctcaggtgacccccccccccccgtctctgcctcccaaagtgctgggattacaggcgtgagtcaccacacctggccaagactcggccctctttgaggtacagtgtctgattatgctgtgattctatacccagccccagcccatttctagactgggtcccggtacaacagtgaacacttgttgaatgaatgaaggctcaggtggaagtccatcactcattcgaccatgagctctgggccttgcattatatacttttatgtttccaaatggattttgtttttgtgacctaagttttctaggtgtgagacttcactgccgctcctagtctggaagtatcccaaggcggggccaaggcaagcaccaggctgggtccaggaagctcctgggtagagaccactattggaaaaatggggtttcacaaaagggactctcccactctgccactagtcggctcctgaaatgggccttgtctctgaggtgctcccctagccacccctccctttatcccaggacttctgaggttcccacttcagccttggtggtggggagcgggtagaggaacatctgtcaccttcttttggagcctgctcctaggtcagtggggccagaaatcagtagggcagagatggagtgctcatgcgtgctgggttccattggtgagtcagcacacctactgaaagcctgggaaccaaacttgccggggtggggcgggagtgcagaaaagaaagtgtttcatgacctgcttgggggaaggttaatgctctgatgctggataaacatgttcctctcttctctaccccccaggataggtttctgggctggaagggaacttttctgacccatcaagagaaatccactgcaggccgggggcagtggctcacccctataatcccagcactttgggaggccgaggcgggtggatcagttgaggtcaggagttcaagaccagcctggctaacacggtgaaaccccgtttctaataaaaatacaaaaattagctgctcatggttgcccacgactgtaatcccagctactcaggaggctaaggctggaggattgcttgaacctgggaggcggaggcggcagtgagccaagactgtgccactgcactccagcctgggcaacagagtgagactccgtctcaaaataaaaaataaaataaaaaaataaaaagagtccgggagcagtgactcatgcctgtaatcccagcactccaggaggctgaggcgggtggatcacctgaggtcaggagtttgagaccagcctggccaacatggtgaaaccccatctctactaataataaaaaaattagccgggcgtggtagtgcacacctataatcccagctactccggaggctgaggcaggagaatcacttgaacctgggaggcagaggttgcggtgagctgagattgtgccattgcactacagccgggcgaaaaaatatatatatatataaaatcgtggtggctcacacctctaatcccagcactttgggaagccaaggcaggtggatcacaaggtcaagagattgagaccatcctggccaacatggtgaaatgccgtctctactaaaaatacaaaaattagctgggcgtggtggcacatgcctgtaatcccagctacttgggaggctgaggcagaagaatcgcttaaacccaggaggtggaggttgcagtgagctgagattgcaccactgcactccagcctagtgacagagcaagactccttctcaaaataataataataataattaaaataaaaaaaataaaaaagagaggccgggtgtggtggctcatgcctgtaatcccagcactgtgggaggccgaggcgggtggatcacctgagatcaggtgtttgagaccagcctggccaacatggtgagaccccttctctactaaaaatacaaaaactagccgagtgtggggatacacgcctgtaatcccagctactcaggaggctgaggcaggagaatcgcttgaacccaggaggcagaggttgcagtgagccgagatcgcaccacagcactccagcccgggcgacagagagatactccgtttcaaaaaaaataataaaaaaaaatccattgcagccttatctccgtgacaagactagcagaccctgctttctttttttttttttcgagacggagtctcacactgtcgcccaggctggagtgcagtgatgcaatctcggctcactgcaacctccgcctcccaggttcaagcgattctcctgcctcagcctcctgagtagctgggattacaggcgcccgccaccatgcctgactaatttttgtatttttagtggagacggggtttcaccatgttggccaggctggtctcaagctcctgacctcgtgatttgcccgccttggccccccaaagtgctgggattacaggattacaggcatgaaccaccatgcccggcctcaggccctgctttcatagtcctggtaacccggctatcagtcacttgttgtcttggaaagttggacccttttcagaaccaagaccagtctcccttaagcttctaccatgcaggaccttgtccaagttttatcactgcctttagatgctgaagtccaggagaagctaggccatcttgtcaggacagtttacattctttccatgcttcttgggccacccctgagagggtcagacaagcaaacccaaaccccttggccctctccagggactcatcaagagcaggaatttggggagagcaacgagggacaaagtctggatgacaaagctcactccaaagctcaagcagagatactgcaggggagggaaacctccctaagagcccctccagtcagccacagaacgtatctcttgtcaccagcaggatttatttcagggttctgccagcaaaatgacttataaatacattcttccgcatctccccctttccaggggtgctgctgagttgcatgggatgagatctgcttctgagatcctggggctgtatgccacccccaactcaccagagctcttccagcacacagcagcacccccaccccccagctggcttggagttgggcagagaagcttatgaggctgttatctctcaacagacagctgtgcagggctggaggcagcagcttatcaggaggcctgcagtgattcacagcccaagacccagcttctctgctgaatagtaatttccagcagtggatttgtgctcagtctctctcctccccctttcccaagggtgtgctgtcctttctcagagagagggcagtgaaggggagatcctacccacagagctgggggctttgtgccagccttctgggtaaggttcagtttattgtctggaggctgcagattcagggacctcagcagggtctgccaccctttgcagtgacctccaggagagttcatcgatgctgtccttccactccttccttcccctcccagaaaaacaatgtgccgctccctttcccttagtggcgatgtacaggggtacacgggcccccatttgcaacagcctctgaggccagggccagcccgggagggcggagtgggggaggagagaggaagaagccagggactgggcagtgccttgcaccattttgaagctgttcagtctctgtgcctgaccctgaagactccaaagactcaggacgcaaggctggaggggaggggagacacaaggggccaggcgagagctgtctctgcacaggcgggtggttagaaaaaaaatgggggacacagccatttttgtgcttgttttattggaagcaagactccagccagctgcagggctcaggggaggaggcctggagagttcagtcctgggtctccctctgggccagcagggggaaaaggggtgttaaaagagctagaaccctcagagatgctcctctgaagcaggggaaagaaaactagaaaggaaaactgtcccagggcggggagcggaatagggcccccacatctcagactctcctaccctcaagcagttaattctcaccccctgccttcctctgtcaacggtgggggtgattccaataactcttctcagcttccatacttcaggtgctcttcgtgaatgctgggtggctttaacccttgggggtcccaaacaagtttccagaatcccactgtccaccattctcccccaaagaaggtcccagaaaaggtgaagttccgtgtcttcacgcaacacgggcataagcagcaattatcgcacgaagtttccctagggtggtcggggatcctctcctgccactcctggggcccctctcttgtcgccttaaggtccatgctacctgtcttgaggagctgtgtccaggttgtgggctccggaggaccgaggagtgaaaggctggaggtacatctgaaggtggaggcgctggcggaagatcctgccggactaggtggcccacagtccggagtttcaggccgtctgatcctcgtccgcaacccctggctcgggttgcgatcgcttcgcggagccttctccagctgcgggttcccctaggctcctcttggacgctggcgcggctggcggggacgagggaccaggatggggattcgggggctggtagccgggctgtcgcggatccagcgcgtccttggaaagtaggatggcgaggccgggcacgttcttaagtacgctgagactagcggccggctcgccaggcgtctgaccctgcgtgggcccaggcgggaggctctgccacacctcgcgtacgctccggtagcgcagccgcgtgacctggtgcaggcccgccaggcggcgcttgaggatctcggcgcacgtgacggttttggtggtggcccggccgcagccgctgaagacgatggcgcgcgtggctggctgcgccatgctggcggtggcgaaggccatcaggttccggatcttgctgccttccttgacccgcatgtgcaccgcgcccggcgccaggtctgcgaaggggccggagcccgggccgcctccctcggccccgcaccccgctggcgcctcttcggagcgcaccttacggaagttctccatgcgccgtcgtcgccgggaccgccggctttgccatggggcggcctcagccccggggctgcatggccgccggtcgcgccttgcaagggccagcaggggtaagggcgccggagcagcgcagacgccggcgggcgggctgggacggcgcgatctcggccccacttctctcgagcgggcgccgctctactcagcgctctcggcgccgggtgctccgcgcctttagctgaggccccgcccctgccgccaggcccctcccctgacccggcccggccgggcccgcccgggccccagcctcactagcctttcctggcgagtctgggtcctcagctacgcgggcgtgggagcgggcgcgctgcggggcgcatgagcaggtgaaggtgaagttccactataatcgccatcagcgctctgagagccaaccctcacaaaccggcagtctaaataaaagctgcgcttgccgtgcaaacactgcttcaaatccggtatccgagcccttcccatttgcaactgaaggccgcccctcgtcccctcccagggagagatttccaagaggcttgctggggccttgcccctcctcccccgccccggggaacacccccaccttttttccgctcccaagtattcttgcctcaaggacagctagtgcgcggtcagcagagtgcgggaggagctggctgcggctccactccgcgcctccccgcgggcgattacgtcgcggcgtggtcctcgcggggcgcggaagacccagacttcagcctcgccacgcctgcccggagctcgaggctcccggacccccgtccacccctgggacgtgaggagtgaggctttgggccaggctgttccccgaggcgcgtggggaagcgggcgtgacctcttctgaaaaggcggtaggctcgctccacccaggccctagagcccacccttagagctgcgcgctttagggtgagccaggcacgatgccttgccaacgtggccgcccccttcctcccaggcggaattcgctcaggcaacattggccccttgagatccagtggggtccttttcgaaaggaggctaggtgaacgcaggttttaaaaaagagaagggaggggccgggcgcggtgtctcacgcttttaatcccagcactttgggaggcagaggtgggcggattacttgacgtcaggagttcgagaccagcctggtcaacatggtgaaaccccgtctccattaaacgtacaaaaatcagctcggcgttgtggcacgctcctgtaatcctagctgctcgggaggctgaggcaggacaagcgcttgaacccgggagctgaaggctgcagtgagccgagatcatgccactgcactccagccggggcgacagagcaaagctctgtctcgaaaaatgaataaattaattaattaaataaaatacaaaagagaagggagggataccccattctccaggatgtgattattatgcattgcatgcctgtatcaaaacgtctcatgtaccctctaaatatagacacctattgtatacccacaaaaattaaaaagacttaaaaaaaaataaaagagagaaagaagggaggaagatggggagttgaagccctgggggcattatggaactactggatgcctctccggcggaaactccacgggaccgaaagagaggcccggggtctcctgccgggtgagagaagcattagagaaagatgagattgggggctgtcaggactactgatggaagggagggggtctgagaaggggcccgaccctccctaaaactgctctcgggattcccccgtcctccttccacccgccctacgcagtcaggactgagagagggcggcagatctggtcctagccaggggactgtgacggggcgtggcggggagggacacagagagctggggcgggcgggccaccgggaaagtgctgggggcatgacagtgccttggattgctgggcctcagttggagatggggctgccagatgctgttctccctcctcccgctgttctcgccctctgggcatctgcagcagctctcagtccctgctgttcaaaaccagggtttacttccttgtcacttcttgggagcggccctcggtccctgctgttcagaaccgggatttaccctcttaccacttcctgggagtggctgcggcgactggaccttggcaccgcaatgtgtgaatggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtggaaggagcgagctctccgtccccgggagtatgcaagtttgggctgcacgatcacttggaagggattgggcggagttctgtcatttggagaaagggtcctgggagcttcaggtttgtgtagggcgaggacggggcggttctgcgtccggccaggttggccctcgaggacccagccgtccccaacctcctaaactgctgtcggatgtagaagactcgcattcactgctctccacagtcggtgaagggagaacgccgaaaagggccgcattccctcctgccggtcccctccccttcccgcgctccctctgcagcacttaaaatgtaaatgtacatcgtgattagccgcggggtcgctaattacagctgaagccattcattacactgtcagcgcgcgtcgcagcccgccggctgtgcgctccctcctagccgtgaaggggtgtagggggtgggggcgggagatgcggggagtgagggaggaaggatggggtgctgtgaattagggtaatgtggcaggcctggaggaagctggagtgggagagagcgggcagcgagcggggaaaacagggtgggcggtgaaggacggggcggggtggcgaggagagaggagaaacgcgagaggcaggaaggaattggggcatgaagtagtgaggacacagggaaaggggctgtatgaggggggaaacagcgtaggggacagggcgaagggagaaaaagctgagaagagggtgggaaccccagggtggggccagagtcagaggaggggagcacagggctcaacttcagaaaggctggtaaattttaaagtagagcatcagtggtgcacaccacacaatggttagaaaagtggagtcagtgaagacgttgtgttaaaggagctgggtgccagccatacacagagtaggggggcatttatttccgtgtgtgtttatagatgtaaatgtatttttaaaatatctgcaagaaaacagcacactgacctcttgttaccgcatgaagttttcattaccttctttaagaaaaggacaattaaatatgaatacagagtcttggagcagcttgcataaatgagctactgaccctgaagcttcagcttctattagcttctttctgcctctgtgtgaccttggacaatttacttaacccatttgctttggctttgtcatctgtaaaatggggctaattatagtaatctacctcacagagtgattatgagacacagccgtcttggaaccttggctgctaagttctcaggaaatgttggctgttattatttttcatatattatttgtgaatttaaaaaaattgtaaagggattgggggaaagaaaactggtgaaaaggaaaagaaattgggaaagactcagaaataatagcagttttcactcacagtgaactggtgagtggcaagctagactcctttcaccctgggaggaggtgttggggtagctgggctagaggccaagcctagccaatacatatctgttaaggttccctgggacctttccagcagcacaccctacttcctgtggacaaatctctcatgttcacactggagggggatcgctggtacagcccctctcctctgtctcttgttgcaggaggaggatgaggagctcttaaaacccctgatcctagtcccagcctctttgggcagggtcttgggagcatgcaagtagagtcaggaattagaaagttagcagggccaggccgggcgcagtcgctcactcctgtaatcccagcactttgggaggcagaggcgggcggatcacgaggtcaggagatcgagaccatcctggctaacacagtgaaaccctgtctctactaaaaatacaaaaaattagctgggcgtggtggtgggcgcctgtagtccctgctactcgggaggctgaggcaggagaatggcctgaacccgggaggcggagcttacagtgagccgagattgtgccactgcaccccagcctgggcgacagagcgagactccgtctcaaaaacaaaacaaaacaaaaacaacaacaacaaaaaagaaaattagcagggccagagggaactcagatttagcaggcacccaccgagtgcccagcattgggtcagatgtgtttaatctccacactcttctttccaggaaggtatcatcattgtttgacagatgtgaaactgagacccagagaggttaaataacttgccttatgtaccacagctagaaagaagcaaccacagatgtttgaactcagagttctgactccctttactatctcagccgaatgtatgagaaaaataaacttttaagtgactcaaactgcccaaaggggttagctttgggagatgagggtgttccatagtggaaaagatgtgttggtgatctgttgctgcataaaaattaccccacagctcagcagcttaaaacagcaaacatttggccaggtgcagtggctccaggaagtttagactgcagtaagctgtgattgtaccactgcattccagcctgggcaacagagcgagacactgtctcaaaacaaacaaacaaaaaaaaacccaacaacaatcatttattattgtgagatcacacaatttctgagggtcagaaatccaagaacagcttgaagaggtctcatctagctcagggtctgtcatgaggctgcagtcaagatgtcagctgggcatggaggatctactcccaaacttacttcacatatctgttggtcagaggcctctgtttctccactggtctgatcatgacctggcagctggcttcccctagagcaagtgatcagaaagagacaaagaaagagagggacagagaaaataagcaggaagctgcagtgcctgttatgggccagcctcctctgaagttgcacgccatcatttccagtttattatattagttggaaggtagcccagcctacattcaaaaggaggggtttcagacttcatttcctgaagggaagggtatcaaagaactgtaggcatttcaaaaatcacaacagagccgggcgcggtggctcacgcctgtaatcccagaactttgggaggctaaggcgggtggatcacaaggtcaggagatcgagaccatcctggctaacacagtgaaacccggtctgtactaaaaatataaaaaattagccgggcatggtggtgagtgcctgtagtcccagctatttgggaggctgaggcaggagaatcgcaggaacccggaaggcagaggttgcagtgagccgagattgcgccactgcactttagcctgggtgacagaatgagactccgtctcaaaaaaaaaaaatcgcaacagaaggcgagtgtttgggaggcaaatttaggaggagacggaagaaggaatcaacatattgaagcaaacacgtggaaagaacactgaccttgaatcaggagagctaggtttatttcccggcatacagcaagcacttaatagatgtttaagtgaatgcatgattgacaatttttctgagattgttttcacagacgtaacagcagttaccaccccacatgctctcctgaggattgagtgggattatgggtatcagagctctctgtaaatgtaatagtgctggttgatgatgcctggaagtgaatgtggtctgggagacagggagagggctctgccatacaagagcctctgcccaggccaggcatctcttctgtcagactgagtcccaggccctggggtagtgctctgattccagctctccttctcagctctctatctcaccctcggtccaacctcctcaccatggctcagctctaggtattgcttttctccttcagccagtcaggacaggacccaggagacttaccattggccaagcctcttgcctgcaggccactctacctcttgtgctggctctggccccacagatggggaatgggggtttgcattgcagacccagtgagtgatgccatttgaggacaagaaccattaatcttgcatgaaattcaattgctctcctagcagataggccaagtcaccggagtcctgagaggaagaggggtgtgtggggcctagaatgaatgaggagtggtgtctgtggaaggggaaaggagaggagaggcaaaagcatccatgggacctccttctcgttctccttaagacgggatgctgccagtagttcccctatcttccttccagactctagaggcaagtgcagcgaaaagccactcacctgggcaacattagtgttcccaggagagctcctattcctgaaagacttcccaagagcctgctgtgatgcccagaatcctccattattgcttccccccttaggatcagttttgtcctctgaagataaggtccctccaaaatgggaattggtcaaaacaaaataatccggatgcttgagaacgttgggatgggaggaagatatagagctgataaagtgaggaatcattatcaattacagctgacatttagttagcacgtactatgtgccagacactatcctaagcactttacatgtacaaactcatcacatacaacaagcactatgaggtagctgctacccacttcatacgtaaattagagccagatccagagacagatggtctggctccagtgtctgctcttaaccatggcactagaccattgcaggaggaagggaaggcagggcagaaagccaccagctatcaagacctccctggctatccataatgaagggcacagcactccagggcgtgttctgctttgcatttgcctggtgtggaaggcatcagggctggtccttctccagcactgacctggggcagagatagggagcttggttgggtctgcttccctagaaatatatcatatgcccttcagggtgcactgaagtttgtctgtttttgagacggagtttcgctctgtcaccaggctggagtgcagtggtgtgatctctgctcactgcaacctccacctcctgggttcaagtgattcttctgcctcagcctcctcagtagctgggacaacaggcgcatgccaccacgcccagctaatttttgtattttcagtagagatggggtttcaccatgttggccaggatggtctccatctcttgatctcgtgatccacctgcctcggcctcccaaagtgctgggattacaggtgtgagccacttcgcccgaccgaggtttttgtttacaactcagaaaatgcttgcccatctgacacccagaagcagctaatggggtggttacgagtttggactctagagctccactgcctgtgttggaatcccaggtctgccacttaccagctgtgcccttggtcaagctatggaacgtctctgtgcctcgatttctttccctgtgaaatagaaacaatgacaatagtacttatctcttagaattggctcaggttaggccgggcgtggtggtttatgcctgtaatcccagcaattcgggaggccgaggcggacagatcacttgaggtcagaagtttgagacgggtctggccaacatggtgaaaccccatctctactaaaaatataaaaattagctgggcatgatggcgcacacctgtaatcccagctactccggaggctgaggcagcagaatcgcttaaacctgggaggcagagtttgcagtgagccgagattgggccactacactccagagcgagtgtagtgtcacctgggtgacagagcgagacagagcacaaacaaaacaaaacaaaaaaccgaaaaacaaaaaacaaaaaaatgattgtcttaggttataccccagtacttccatggagttgtcaccccagatttcagagataggctaaatcccttgtctatagattcagctactgagcattaaagcttgtagggaaacccgtggtggtggggggatggggtaaaaaaacacagggaggcagaagggggatgttgacttccatgtggcagccagcactgctgggcctcagctgttcattgacaggcaggactgcaggcccagtggttttattttgattgtgtgtgattgaacattttctgcttcatttcaatgagagttgtctgtgtcagcttttctgaatgttacatagatagaacccttcttccttcacatccggttgagtcaggctcatgacaaacaatgtaatttccttgctgtagagtcccctagggtctggagtactgggaagaagccaggaaattgttccctttttcctgggtcgcctctcttcctgacagttgttcctttcccaccttcccatggtggtgagagtggaaacagcatttttcacatgctacccttgatacctccatcccccagcctgccagcctggaacagagcccccaaatcaagctggatgaattggggttcctctcaattccaggagacacttagtcaaattccctttatggccacgaggataattacaaccagataattgtcttccttctcttgaacgaacgatgaagtaaatcaagtgtgcctgccttctactctgaagtaaatcacaaagcaccctgtatgtattctcccagaagataaattttatacatttcaacaaggaaagagaacatattttgtttgcaaaattcctgggagaactctctatctctctctgcccagaaattatgtgtacctgctgatgaatgacctgcctgatgaacctgccttgggaaagataatagagttatgattggatgtcaccagctctcatcatttctgctgtgggagaagtcacaggagcaggcagaactcttccctctgatgaagcagttgtcttcttgtaaccacagatcttcttcgttcactggggttgtgggcacacctttaagattctgccctgcgccgggcgcggtggctcacgcctgtaatcccagcactttgggaggccgaggcgggtggatcacgaggtcaggagatcaagaccatcctggctaacatggtgaaaccccgtctctactaaaagcacaaaaaattagccgggcctggtggcgggcgcctgtagtcccagttgctcaggaggctgaggcagaagaatggcgtgaacccgggaggcggagcttgcagtgagccgagatcacgccactgtactccagcctgggcgacagagccagattccgtctcaaaaaaaaaaaaaaaagaaaagaaaaagattctgccctgaagtccaagtgagctacacaggtccagtgttttcaaaaaagaagtccccaaactcatgtttttatgtgacagtttcaggtttttattttttatttttttatgtttaattgtttttagacagagtctcactctgttgcccaggctggagggcagtggcacgaccttggctcactgcaacctctccgcctcctgggttcaggcgattctcctgcctcagcctcccgagtagctgggactacaggcttatgccaccacgccctgctgatttttgtgtttttagtaaagatgcggtttcaccaggatggtctccatctcttgaccttgtgatccgcccacctcggcctcccaaagtgctgggattacaggagtgagccactgcgcccagcctattttttatttttaaatttcttttagagacaaggtctcattttgttgaccagagctggagtgcactggtgcagtcatagctcactgcagacctgaacccctgggctcaagggattcgcaggcacatgccatgtgggccagtttcaggtttttaaatgttgtcgactgtttcagttatctattgctgagtaacaaatcaccttaaaatcacaaatcaccaggccaggcgcggtggctcacgcctgcaatcccagcactttgggaggctgaggcgggcggatcacgaggtcaggagattgagaccatcctggctaacacggtgaaaccccgtctctactaaaaatacaaaaaattagccgggcgtggtggtggccggtgcctgtagtcccagctactcaggaggctgaggcaggagaatggtgtgaacccaggaggcggagcttgcagtgagtggagattgcgccattgccctccagcctgggcaacacagcgagactcccatcacacacacacacacacaaaaatcacacatccccttaattagtggctaaaatagcaatgatgtattatttatgtttttttactattatatattttttaaaaatagagatgggctgggtgcagtggctcacgcctataatcccagcactttgggaggccgaggagggtagatctcctaaggtcaggagttctagaccagcctggtcaacatagtggaccctgtctctactaaaaacacaaaattagccaggcatggtggtgggcacctgtaatcccagctactcgggaggctgaggcaggagaattgcttgaacccaggaggcggaagttccagtgagctgagatcagtgtagcctgggcagcagagcaagactccatctcacacaaaaaaaagagatggggtctcactatgttgcccaggctggtcttgaactcctgggctcaagtgatctgctcacctatgcctcccaaagggctgagattataggcatgacgcaccatgtccagccaatgatgtattatttctaatgacttcgttttggctgggttcagctgggcagttagttcttctgctccacttaatactggctgtggtcactcacatggcttcattcagctgggagcttgacagaggtcagaacactcaagatggcttcattcataagtctagtgcctctgctggggtggctggaaggctgggggtgttggctgggcctctcttttcatggactctagcctaagcttctttcttgagtggcttgatcccaaaacagtgaaaatgggagctgtcaggctttgtaaggcctagacctagatgtcacacattatcatgtcctctacattccattggtcaaaccaagatacatgtctagaccagattcaagggataaggaaataaactgtacctcttggtgaaaggcctgacatgtatatacaggaatgggaggaactgttgacagccatctctgcagacaatctaccacatgaactaactcatgtgtttttgttttttgtttttgagatggagtctcgccctgtcgcctaggttggagtgcaatggcacgatctcggctcactgcaacctccgcctcccaggttcaagcgattcttcttcctcagcctcccaaggagctgagattgcaggtgcccgccaccacgcctggctaattttttttttttttttttttttttttttttttgagacggagtctcgctctgtcgcccaggctggagtgcagtggtggagtcttggctcactgcaagctccgcctcctgggttcacgccattctcctgcctcagcctccagagtagctggaactacaggtgcctgccaccacgcctggctaatttttttttgtatttttagtagagatggggtttcatcatgttggccaggctggtctcaaacgcctgaccttgtgatctgctggcctcagcctcccaaagtgctgggattacaggcgtgagacactgcgcctggcctagctcatgcttttaaataacgtatctgtagctcagtttagcccaaggttgcaacttcctttttttttttttttgagacagagtatctctctgtcgccagcctggagtgcagtgacctgatctcagctcactgcaacttccatctcctgggttcaagcaattccctgcctcagcctcccaagtagctaggattacaggcgcccaccaccatgcctggctaatttttgtatatatatattttttagtagagacggggtttcaccatcttggccaggctagtcttgaactcctgaccttgtgatccacctgcctcagcctcccaaagtgctgggattacaggcgtgagccaccacacccagcctccttttatttttttaatttaaattttatttttttgagacagaatcttgctgtgacgcccaggctggagtgtagtggagcaatcagggctcactgcaaactctgcctcctgagttcaagcaattctcctgtctcagcctcccgagtaactgggattgcaagtgcccaccaccacaccagctaattttttgtattttttgtattttttttttttttagtagagtaggggttttaccatgttggccaggctggtctcgaactcctgacctcaggagatttgcccgcctcggcctcccaaagtgctgggattacaggtgtgagccaccgtgcccggccatgcccaactaatttttgtgttttgtttgtagagacggggttttgccatgttgaccagtctggtcacaaactcctggcctcaagtgatccacccgcctcagcctcccaaagtgttgggattacaggcatgagtaaccatgcccagcacaactttttttttttttttttaagacaaggtctcactgctgtcacccaggcaggtgtgcagtggcactatcacagctcattgcagactcaacctctcaggctcaggtgatcctcccacctcatttttagattttttttttttttttttgtagggatggggtcttactatgttgcccaggctggtctggaactcctgggctcaagcaatactcctgcctcggtctcttaaagtgttgggattacaggcgtgagccactgctctgggccaaggttgcaacttctacttgaaactttcagggaattcacctggaaatgcaggggctttttttttttttttttttttttttttttttttgagacagagtctcactttgctgcccaggctggagtgcggtggtgcgatcttggctcactgaaacctctgcctcccaggttcaagcgattctcctgcctcagcctcccaagtagctgggactataggtgtgcaccaccatgcctggctaattttgtatttttagtagagacgaggtttcaccatgttggccaggctggtctcgacctcttgacctcaggtgatcctactttgggattgtttccacccatcagcctgaatcccaaagctgcctagttcctaacctgaagggaagaaggccaggtgattggctgggtgcagtgactcacacttgtaatcccagcactttgggaggccaaggcaggcggatcacctgaggtcaggagttcgagaccagcctggccaacatggcgaaaccccccatctctactaataataataaaaaaaattagccagaaaagaagaccaggtgattaatgagatctctttattttatttttagagggagtctcactttgtcacccaggctggagtgcagtggtgcaatctcggctcactgcaacctctgcctcctgggttcaactgattcttctgccacagcctccctagtagctgggattacaggcacatgccaccacagccttttagtagagacagggtttccccatgttggccaggctggtctcaaacttctgacctcaagtgatctgccctcctcggcctcccaaagtgctgggaatacaggcgtgagcaccgcgcctggcctattttattttattttatttttttgagacagagtcttgctcagttgcccaggctggagtacagtggcatgatctcagctcactgcaacctccctggttcaagcaattcccctgcctcagcttcccaagtagctgggattacgggcacatgccgccacgcgtggctaccttttttgtatttttagtagagacagggtttcaccatgttggccagactggtcttgaactcctgacctcaagtgatctgccctcctctgcctcccaaagtgctgggattacaggcgtgacccactacgccccgcccattttattttttggagacagagtctcactctgttgcccacgctgatgtgcagtggcacaatcatagctcactgcagccttgattgcctgggctcaagggatcctcctgactcagcctcctgagtaactgggactacaaatatgagccaccatgctggctaatttttgaatttttttgtagagacaggggcttgctatgttgcccaggctggtatcgaacttttggcctcaagtgattctcccaccttggcctcctaaagctctggaattatagctgtgaggcactgtgcttggtctgaaatctcttttatttatttatttatttattatttttttgagacagagtcttgctctgttgcccaggctggagtgcagtggtacaatctcagctcaccgcaacctccgcttcctgggttcaagtgattctgctgcctcagccccctgagtagctgggattacaggcgtgtgccaccacgtccagctggcttatttttgtatttttggtagagacggggtttcaccatgttggccaggctagtctcgaactcctgacctcaggtgatctgcccaccttggcctcccaaagtgatgggattactggcgtgacccaccacacctggccctgagatctctttttttttttttttttttgagacggagtctcgctctgttgcccaggctgaagtgcagtggcaccatctcggctcactgcaagctcaacctcccgggttcacgccattctcctgcctcagcctccctagtagctgggactacaggcacccgccaccacacccagctaaatttttttgtattttcttagtagagacggtttcaccgtgttagccaggatggtctcgatctcctgaccttgtgatccgcctgcctcggcctcccaaagttctaggattacaggtgtgagccacagcgcccggcccctaagatctcttttaatatcctgtagtgctcaccagctttgactttagcctgaggagtcattgcaggattttaatcaggcctatcttgattagattagtactttagaatgttcacataggatgctaagaggcctttgttccagttagcaaccgctgcgtaacaaattatcagaaatctagttgtgtaaaacatttatttatttatttatttatttatttatttattgagacagaggttcactcttgttgcgcaggctggagtgcaatgacacgatctcggctcactgcaacctccacctcccgggttcaagcaattctcctgcctcggcttcccatgtagctgggattacaggtctgtgccagaacgcctggttaatttttttgtatttttggtagaaatggggtttcactatgttggccaggctggtctcaagctcctgacctcaggtgatccacccacctcggcctcccaagtgctgggattacaggtgtgagccaccacacctggccaaaacaattatttattatgctcacagattctgtgggtcaggaatttaggcagggcacattggagatggctttgtttcttctccataatgtctgaggtttcagcttgaatgctgaggctgaattaatggcaaaaccttatctctaaaaaaaataaaagttaaaaaaattttaaaaaatgaccacagcaatggtcccaagtgctaggattacagctgtgagccaccacactcagcctattattattattatttttttttattattattattttttaatgatttaatgctgggcatagtagctcatgcttgcaatcccagcatttgggaggccaaagtgggcagattacttgagctcagtttaagactagcctgagcaacatggtgaagccccatctctataaaaaatacaaaaaccagccaggtatggtggtgcacgcctgtaatcccagctactcaggaggctaaggtaggagaatcacttgaatccaagagacagaggttgcagttagccaagatcgtgccactgcactctagcctgggtgacagagcaagactctgtctcaaaaaaaaaaaagtaataataaagcgaagcattaattcaatgaaatcatcaatagcctttcaaagtatacccagaacttgagcactcctccctcctccggcctcattccccacacctttcccgtcatccattctgcctgagccgcaccagcttccttgcgttccctcaaatgtgatgaacacgcttctgcagggcctttgcgctggctgctccttccactaggaatgtgggtccccctggtatttccctgactgtctcccttgtagccttcagtctctgctcagatgtctcctgctcagagagcccacccgaccatcctaatataacagtcccctccttccatctcttttcctttctttggttttctttttcttcatggcatttaccatcatctggcataactgtaattgcttattgtttattatctgtctcctcccactagaatgtcagctgtccaggaggatagggaccttgttttgttcctagcttcatttccagcacccagaacgtgtctggtactcagtaagtgctcaaatcaatgtttgtggagtgaatgaaggataggcttctttgggtgagaaaagtcagtaacccatgcctaggacatgatctagaacagtggttataaagtgtggtccttcaagtgtgatccaggatctttgagggtccccaagacccttttgtgtgagaggatctgcaaggtcaaaactatttttttttttttttgagatggggtcttgctcttcttgcccaggctggagtgcaatggcacaatcttggctcaccgcaacctccacctcctgggttcaagcaattctcttgtctcagcctcccgagtagctgggactacaggcatgtaccaccatgcctggctaattttgtatttttagtagagacggggtttctccatgttggtcaggctggtcttgaactcccgacctcaggtgatccacctgcctcagcctcccaaagtgggtcaagactatttttataaatatacggaaatatcatttgcctttttcattcttattttttcatgagtgtactgtggagtttttcaaaggctgtagagcatgtgatgtttcaacagatcgaatgcagaagcagatatggtccaggcacagtggttcatgcctataatcccagcactttgggaggctgagatgggaggattgcttgagtccaggagttcaattcagtctgggcaacatagcagaacttcatctcttttatttttattttttgagatgaagtctcactccatcacccaggctggagtgcagtgtcgtgatctcggctcactgcaaactccgcctcccgggtttaagcaattcttcagtttcagcctcctgagtagctgggactacaggtgcctgccaccacccccagctaatttttatacttttagtagagacagggtttcaccttgttggtcagactggtctcgaagtcctgacctcagatgatccacccagcttggcctcccaaagtgctgggattacaggcatgagccactgcgccccagctcatctcttttattaaacaaagaaaggaaaagaaaaggaagggaggaaggggaggagaagaagggagggagaagaggagagaggcagaaaggaaaggagggaaaggaaaggagcagatatgggaatccagctgtcttctattaagccagacattaaagagatctgcaaaattataaaatgatgccactcttctcactgttttttttttaatgtaactaatttaaataaaatgttttttatgttaacgtgtaatgagtttattaatttttttgtttgtttgtttggtttttttttggagacagagtcttactctgttgcctacgctagattgcagtggcatgatctcagctcactgcaacctccacctccttggttcaagcgattctcctgccttagcctcccgagtaactgggcttagaggggtgcaccaccacacccagctgatttttgtatttttagtagagatagggtttcaccatgttgcccaggctggtctcaagctcctgacctcaagtgatccgcctgcctcggcctcccaaaatgctgagattatgggccacctcacctggctgagtttattaattttaaaaaatgaattaataataaatgttttccgtgggtgtggtggctcacgcttgtaatcctagcactttgggaggctgaggcaggcagatgcttgaggccaggagttaaagagcagcctgggcgacaaagtaagacctcgtctctacaaaaaaatacaaaaattaaccgagtgtgatggttcacgcctgtggtccaagctactaggaaggctgaagtgggaggattgcttgaacccagaagatcaaggctgcagtgagccgtgatcatgtcactgtactccagccagcctgggcaacagagcaagaccctgtctcaaaaaaaaaaaaaaaaaaaaaaaaaaaaaagaaagaaaagaaaaagaaaaaaaaacctccacaaaaacaaaacaaaaatgaatgaattaataataaatatttctgcggggtggtggctcacacctgtagtcctagcactttgggaggctgaggcaggaggtctgattgaagccaggagttcaagatcagccaggcagcatagtgaaaccccctctctataaaaaataaaaaaattggccaggcacagtggttcatgcctgtaatcccagaactttgggagactgaggtaggtggattgcttgagcccaggggttcaagaccagcctgggcaacatggtgaaaccctgtctctataaaaaatgcaaaaattagctgggtgtggtggaacatgcctatagttcccagctacttggaaggctgaagcctgagaatcactttaactctggaggcagaggttgcagtgagccgagatcacgccactgcactccaacctgggtgacagagcaagaccctgtctcaaaaaaaaaaaaaaaaaattgccaggcacggtgatctgggtctgtagtactgggtactcgggaggctgaggtgggaggattgtttgagcccaggagttcaagaccagcctgggcaacatgataagatcccatctctgcaaaaaatcagaaattagctggatatggtggcatgcgcctgtgttcccagctacttggaaggctgaagtgggagaatcgcttgaacctgggaggcagaggttgcagtgagctcagatcatgctattccagcctgggcaatagagtgagactctgtctaaaaaatatatataaaagaggtgaggattgaaaggaggctgagagactcggacccagggaagagttgatgtatgcaaaggagtccaacaacacgatgcctgtgcactcattgaggaataatctcagtgcagcaatctctcggttcagagatgaccaaaaatgctccaggaacagtcatgcttaatattgactgtttgttgttttatttttattttttgactgtcctagattgtttattaggtatgaattttataaactttagttataccagtggtaacggtggagctggagagtattgtgccttctccaagcttcaggggaagaaccaccaatagtgtggtggaacttatggccctttccaaggccatggctctttcagcctgcaggtgtcagcccatgcatttccctgtgcttgtggactggtttggtgatccactgggtgtcaagatttcttctgatagctttatggaatggatcaatgaggataacatcaaaaaatgtttatgtggaatcttcatcaacccagtaagaattcaggactcttagagccccacagtggcatccagcttgctgctctgcaaaggactgaaggctttgagcaaactttacaaatatatatatataatattatatataacatagataacatataatattatatataacatagataacatataatattatatataacatagataacatataatattatatataacatagataacatataatattatatataacatagataacatatattatatataacatagataacatataatattatatataacatagataacatataatattatatataacatagataacatataatattatatataacatagataacatataatattatatataacatagataacatataatattatatataacatagataacatataatattatatataacatagataacatataatatatataacatagataacatataatatatataacatatataacatataatatatataacatataacataatattatatatcatataacatatataacatatataatattatatataacatataatattatatataacatatataatatatataacatatataatatatataacatataatgtatataacatatataacatatataaatatataacatatataacatatataacatatataatatatataacatatataatattatataacatatataatattatatataacatatataatatatataacatatataatattatatataacatataatattatatataacatatataatatatataacatatataatatatataacatatataatatatataacatatataatattatatataacatatataatatatataacatatataatatataacacattatatatgttatataatattatataacatatataatatataacacattatatatgttatatatattatatataacatatataatatgtatattttatatatatctttctcccccacaagaacacatattcaaagagtaagttgcatgtaataataatagaatacagcatccagatccttgaaataaaaaaatgaaaaatataacactggtgaatattagcttcagtttctaaaattgaaagccaagcagggaaagtaaattttttttcttattaaagtatgaaggtcacaaaattaacaactcacaaaagagaggctgatgtatagccaattagcgcacaagagacagatggataaaccagacacaaactgttaaagggcctggcaatcacatcctctgagtgattacagacctaggcaagggccatgggaggccacgtaacgaccagagttatgactaatggatcttgagtcagaatgggagagctagttttatattttctaaataccatttctgctcacgttagctagaggtggcttcttcacatttaataaccaagaactctgatttatcaaacaatctttagcacatggtgggtacttactgccttgggaatggctgaaatattccaggcgtaggagttaaagaatgacttgggtgaacagagggataacagttttttgtgtttctattgggagatgcttgaaggatgaataaaagaaacaaggagaagttgatagcactgaggaaaaagggtaattgatagatcaaaacccctgaggagataagaagtgatgagaatcagagcacagttgtggggctggcctgagcctgtgaggagggagtggagacatctcttcctctgagacaggtaggaaggaggaagggatacaggagtacattagtaaatgcatctccctgaagaggctgaggttgcctgcagagagtgaacagaatgggcaatactggggaagaattatccctagcgggctttttgcaggttccacattgaaggacagtaggtgataggagtttattaagaggatgcatagggtacaatgtggaatacaataatgaatcattattcatttattttgtttgttttaaagccctgagcttaattttctatattaattcattcaaaatattaattgtctgtatcacatgacaggcattgttgtgggtgctggggatatggcagtgaacagcacaaaagttgtttctgcttgtggaggtcacatttcagtgagacgaaaacaacaaagtgtgtgtgtgcatccctgccccccctcccccaccgtggcactgagtcacccggggagctgaactctcctttgcctctacagccagcacatgaaatgcagctcaaagccacttgaaagcactcacttggtaacaggctgctccctagtgtggcagacaccactggtgccctactcagcatccattctccttttcttccttactaatacaaccctgattttattggcagaggcaatgtgcccagctaaaaggtattttccagccttccatgccaaataggagtgactgtatgacagtttaggccaatgggagataaacagaaatggttggatagggctttttggagctaattaaatggggatgcagactcggctggcatgcccattgtccctttgcccttccttcttccagcttcttgcaatgcagccatgatggctggagttgagaagccctctcaaaactcttgagggcagctgggcacagtggctcacacctgtaatcccagtgctttgggaggccgtggcgagctgattgcttgagctcaggagtctgagaccatcctgggcaaaatggtgaaacccggtctctacaaaaaatacaaaaattagccgagcttgatggcatgagcatgtagtcccagctacttggggtgttgaggtggaagaatcgcttgatgcctgggaggtggaggttgcagtgagccgagatcacgccactgcactccagcctggatgacagagtgagactctgtctccccgcgcccccaccgcccccccaaaaaaaacttctcaggaaaaggccaagagaatttcagagacctctaccctgtatcttaaagtcactgagccaagtcacttatttggatttctcattatgtgagaacaagcagaggtatcttgtttaaggcattgctatttaatatttgcattttctgttatatgcagccaagcttaagccatacttgagatgcaaagaatcagccgtgtttgttacctgtggcagccatgagaatggcttctcaaatctctgactgcaggaagtataattaaccaaggactccagctgctgcctctgaaatgcatcactgcatttatgccaaggccagattttccatggactgctcccggctaatgactgagcatggatgggatactaaggcagtctcattcttgggagaagggtgaaagatgggtgactttaagtgaggatgccgcagtggacttgctgaaaactttccttagagctgcactgcagtttaagaggtgtccattaacttctttccttccctctcttctgcactcaagagtcagacttctatcatgctctgatgtctctcccaacctttcttagctccctcctcattctctctctctttttaaaatagagatgggcactttgggaagccgagttgggtggatcacttgaagcctggagttcaagaccagcctggccaacatggcaaaaccccatctctactaaaaatacaaaaattagctgggcatggtggggctcgcctgtaatcccagcaactcgggaggctggggaacgagaatcgcttgaacccaaaaggcggaggttgcagtgagctgagatcacgccagtgcactctagcctggatgagagagtgagactttgtctcaaaataaataaaataaaataaaataaataaaatagagattggatcttgctatggctaaatagagattggatcttgcccaggctaatatggaactcctgcctcaagcaatcctgcctcagcctgtcagtgttgggaatacaagtatgagccaccatgcccagcccctcctcattttctctaacagttggtttcctaataaatttcttgcatatttaattttattctgggatcccaccttctctgaggacctggactaacacatccccaaatctgtttatgcctgttgcaggtgctactgtaattacataatttaactaagccataactaaaccatagaaatatggacacagaaggaaagtgagttgttatttctatgaaaaccaagtagactgctttagaaagttttgaaaagggtatttgcttaaaagaaaaaaaaaagctgttcacaaaaagacaaacgaggtctttttacaaaaagacaaataagggtgtggtggctcattcctgtaatcctaagactttgggaggctgaagcgggcagatcatttaagctaaggagttcaagaccagcctgggcaacatggcgaaaccccatctccacaaaaatacaaaaatttgctgggtgtggtggagtgagcatgtagtcccagctactcaggaggctggggtgtgaggatcgcttgagcccaggagatttcagctgcagtgagccgtgattgtgctactgcactccagcctgggcaacagtgcaagggactggagggagggagaaatgggagttgtttaatggatatggagtttcagttttgcaggatgaaaaagttgtggagatctgttgtaaaacaatgtgaatatacttaatactactgaatcatacacttaaaaatggttaagatggtacgtttggcacacctgtactctcagcactttggaaggataaggcaggagctcaggagtttgagaccagcctgggcaacctgcagtgagccatgataatgcctctacactccagcctgggcaacaagagcaagaccctgtctttaaaataaaataaaataaaataaaataaaaataggctgggcgcggtggctcatgcctgtaatcccagcactttgggaggccgaggcaggcagatcacctgaggtcaggagtttgagaccagcctgcccaacatggtgaaaccccatctctactgaaaatacaaaaatttgccaggtgtggtggtgggtgcctgtaatcccagctacttgggaggctgaggctggagaatcgcttgaacccgggaggtggaggttgcagtgagccaagatggcgccactgcactccagcctaggcgacagagcaagactgcatctcaaaaaacaaaaacaggccgggtgcggtggctcacgcctgtaatcccggcactttgggaggcctaggcaggcagatcacgaggtcaggagatcgacactatcttggctaacatggtgaaaccccatctccactaaaaatacaaaaatttagccaggcgtggtggtgtgcgcctgcagtcccaactactcgggaggctgtggcaggagaatggcgtgaacccgggaggcggagcttgcagttagccgagattgcgccactgtactccagcctgggcgacagagtgagactccatctcaaacaaacaaacaaaaaacaaaaattagctgggtgtggtggcacgtgcctgtaatcccatctactcaggaggctgaggtaggagaatcgcttgaactcaggaggtagaggttgcactgagccgagattacaccactgcactccagcagcctgggcgacagagcgagactccatctcaaaaaaaaaaaaaaaaaaaaaaaagtaaaacataaaaacttacaaagtagctgtttggtttggaaagactaccggaaaaggttggggaaacgctatagtaacccgagtctgcactcacactggatcttgagtgtagatccagtagaaggaaaaggaaggcagggcaaagggatgttccagggatcaggaggaagctgataaagagaccatttgaggattgagaaatggtgttcttcaaggccattctcagtcttgctttgcaagcatcctaaagcacttaggcactttataggatgtggaaatctagacaatttgtcatgggtattgttatgcaagaaaagaaatacgccaggaggctgaggcagggggattacttgaacctaggagtttgacacggcagtgagctatgattgcaccactgcactccagcctggatgacagaacaagaccccatctcaagaaaaaaaaaaaaaaaaagggccagatgtggtggctcatgcttgtaatcccagcactttgggaggccgaggcgggtggatcacctgaggttgggagtttgagaccagcctgaccaacatggagaaaccctgtctctactaaaaacacaaaattagccgggcatagtgccgcatgcctgtaatcccagtcactcaggaggctgaggcaggagaatcgcttgaacctgggaggcggagactccagcctgggcgacaagagcgaaactccgtctcaaaaaaaaaaaaaaagacaagtgcagtggctcatgtctgtaatttcagcactttgggaggccaaggccgtagaattgcttgagcccagtagttcaagacgctggagtgagaccccctctctataaaaaataaaaacttggtcaggcatggtggcggcacccctaggctcagctactcaggatgctgaggtgggaggattgcttgagcctgggagttcgaggctccagtgagccatggtcctgccactccagcctgggcaacagagggagaccctctcaaaaaaaaaaaaaaagaaagaaatacggaattccaatcagcaaacccgtactcaaagaaaaagccttggcgttacatcaaaagattggcgagttagtatatatttctatgttttaccttaaagcaaaatgtacaaatacatataacttttttttaggccagtcaagtgaggcagtgggagtggagaaggaaacaaagaaatctgtaactagttataatcaaatacttgtaaacaccactgcactcggaccagcccacatatcttttttgttgttgttgttgaaacagagtctcgctctgtcacccaggctggagttcagtggcttgttctttgctcactgcaagctccacctcccgggttctcctgcctcagcctcccaagtagctgggactacaggcgcctgccaccacgcccggctaattttttgtatttttagtaagagacgggggtttcactgtgtgagccaggatggtctcaatctcctgacctcgtgatccgcctgcctcggactcacatatcatttttaatgatccttttaaacttactgtttttttttttgtttaattgaccaacttctggtctcaattgcatcaaataagaaagcttctactgaaataatagtaagtgtgaattgctttattgtgtaattactatacatctgggtgaaaagtctcgagtgtcaagtgtcagtccagtagaagaaaggcagggaggagggacgttccaggaatcaggaggaagtcaataataaacagagactaagtgaggggttggagaccggtgttcttcaaggtggaaggacatgcatgggggtattgagagggctggaacaagaggaggctgtagtcaagaagcaagagaggaaactgtgattcagtgggtgaaacagtttttggtgatgacaaacctctgttgaggccaggggagcaggtgggtgactgaaggagagacaaaggtcaccagagttgaggaggaatcacaaaccccgggtattgggtgagtcatcctatgaactcagaagtctactagactggcagcaagattgggcttggagaggaaattgggggcaggtgtccaagcagtagtgtggtagaagcagcttgtatagggtcaggaaaaccaactgttaaattttcaattttgtgggcttgttgttacacattgtcattattaaaatgtaattataaaggccaggtgcagttgttcatgcctgtaatcctggcactttgagaggccaaggcaagcagatctcttgagcccacaagtttgagaccagcctgggcaacatagtgaagcccaacctctacaacaacaacaacaaccaaaacaaaacaaaaaaaaaaaaacaaaattagccgaatgtggtggtgggcactgtaatcccagctactcaggaggttgaggtgggaggatcgctttagcctgggaggcggaggttgcagtgaactgagatcacgtcactgccctccaacttgggtaacaaagtgagaccctgtctcaaaaaaaaaaaaagtaattatataaacttacaattaagtaaagtatattaaaacaaaggtaatgaaaattcaaaactcattactttctaataactttcctacatcttactactattcatgctcttggagttaatttctgcttcttgcatctgtatggtggaaatactgtataatggtgtgctatggtgcatctctgcccagctctgcattcagtggcatcgtgttattaactcaaaatcagctccggtggaaatatttacgccatggaaattagccaacactacagatacagagcttgagttactgagttttttttttttttgagacagagtttcgctctgtcgtccaagttggagtgcagtggcgcaatctcagctcactgaaacctccacctcctgggttcaagtgattctcctgcctcagcttcctgagtagctgggactataggcgtgcatcaccatgcccggctaatttttttgtatttttagtagagacggggtttcaccgtgttagccaggatggtctgtatctcctgacctcatgatccacctgcctcggcctcccatagtgctgggattacaggcatgagcccctgtgcccggcccactgagttattgttttgtgaaatacctatactcattcatcaactgcaatcatagatatgagttcagcaaaaaacgacagcattctgtgagaatcaattggttatatggaatttacaataaagggagttgtatattatgtgtaagttctgtgttaagcatcctttctatcagtaaaatttatagtaaatatatttgcacattatatatatatacacatatatatgtaaatacacacacacacacacacatacacacacacatttttccctaaagagctggttgttaaacatttacaaacacatcactcagctaaggactcctttcccggagactggcattggggtgatggtaagcaataccatcatggtggggctgattctccttcctgcccctgagctcacatctcacggggagtcaggaaccgaggtaacaatacagcactgggtggcagggagggaaggaactgagaccaagtagaggtagggaggtgttcaaagcaagtgagatttatgtagacactcaaaggatgagtaggaatcagccagccaaaggaaaaacatgagcaaaggcccagctgtcgtcagaaacaatgggaggcaggctgggtgcggtggctcatgcctgtaatcgcagcactttgggaactgaggcagatggatcaccaaaggtcaggagttcaagacaagcctggtcaacatggcaaaatgctgtctctactattaacacaaaaattagccaggcatggtagtgcacgcctgtaattccatctacttgggaggctgaggcacgagattcacttgaacccaggaggcagaggctgcagtgagccaagatcatatcactgcactccagtctgggcaacagagcgagcctccatctcaaaaacaaaaacaaaaacaaaaacaaaccaaaaacaaaacaaaacaaaaaacccacaacaggttatgatgtgcctgagggcagtggccatgggttgctcctcctggagcacctggagagtggagaaagagcagcctgtactggaaagggttttctgaaccctcgatctaagaagagtaaacatttctggacaaagggacaaagatgggagtcaggtgatgggaagagagggtattctaggcagaaggaaccgcatgagcaaaagcaaggaggtgaaagagaatctgaatacatagatctgcaggcagttctgggtggctggagtgcctgtcggggagagtgtgcaaaagacaaggctggagaagtggccgtggctgaggccaggagggctgagagccaagcccaggagagggtgtgagttcttaggagctgtggggagccttaggaggggcctgagtagggagtgacatgattaagatccccgcggctgcttgaaggagaatggcttcagtgggtgtcaggtagggaaagactggagaatgtgatacttttgggaagatactgcagtcacgtaggtgagagatgatgaaataaggtagtggatgtggagaaggaaaaaaggaaaattgattccaaagatatgggggagcggaattgaaaggacttaacttcaaggagtctggcatgggtgattgagggctgatgcagtcgttttcgaagagcactgatccgttattttgtagaatgtccctccactggagtttgtctgatgttttctcatgattagactgagtttggccgggcatggtggctcacgcctttaatcccaacactgtgggaggccgaggtgggcagatcacttgaggtcagaagttcgagaccagcctggccaacgtggtgaaaccccatctctactaaaaatacaaaaattatctgggcatggtggtgggctcctataatcccaggtacttgggaggctgaggcaggagaatcacttgaacccaggaggtggaggttgcagtgagccaagattataccactgcactccagtctgatgacaaagtgagactctgtcaaaaaaaaaaaaaaaaagattgaggttacacattttatgcacaaatatcacacagatcagtgaatcctactaggaggtacatgatatacccatgtcttattactgatgatagagtcatctttgggggcagggtcacagaaggaggtacacttatagggaaaagacctagcgttctggtttgggatggggctggagtgcagaagagaatccagatcagagacacggctttgggaacactcagcaccacggaggtagctgaggacttgggagggggggcaaggttgccagggcagagggtgtcagaaggaagagaaacagtggaagtggaagcaagactggctttgcattgtatccaagtggtcaggtgggcgaggatgggaatgcgtcctgtggatttggtatccagaggcttggccagtgctggggttagtgctcaccagggccaggcccaggctgggacttgtggagggcattttttctttctgggcagttaattggagcagatttggatgggcactcctggccgtgtgtgtttttttgtttttgtttttgttgttgttgtttgtttttttaagacagggtcttactctgttgcccaggcttgagtgcagtgcacgatcatggctcactgcacccttgacctccctggctcaagtgatcctcccccttcagcctcccgagtagctgggactacaggtgtgcaccaccacacccagctaatttttgtatttttagtagagatggggtttgccatgttgcccaggctggtctcgaactcctgggctcaagtgatccaccaacctaggcctcccaaagtcctgggattacaggtgtgagccactgagcccagctcactacttctgatttaactcaacccatgagaagtgggcagtgttctggattctgtgttaagaactcctggctaagctgcaagaggtgacaatgaaattggcttgtgtgcaggccagcaggctgcctagcccccagcacttccagctgtggacagagccacctagctggtggagaactaactctgtgggcgtgggtgcccccaggtgttcaattggaggccctgctgttggaagggaagcagtgaagggtggccatttgtaaatctttggagaaatttctattcagatcctttgtgcatttttaagtggattatttgtctttttattattgagttgtaagaattcttcgtatattctaaatgcaagtctttttttagatatattgcaagaggtagaaggtggggtccttattccctagactcaggctgccccagggatccacatatatatattttgagacagggtctcactctatcacccaggctggagtgcggtggtgtcatcacagctcactgcagtcttgactgctggggctcaagcgatcctcccacctcagcttcccagtagctgggagtactggcatgtggcaccatgccagaatgatttttttttttttttgtagagatggggtttcaccatgttgcccaggctcatcctgaattcttgggctcaagtgatctgcttgcctcaacctcccaaagtgctgggctttcaggcatgagccacatcacctggcctccccccaatttttaaaaatgacattactttactgagttctagttcacatacaataaattgcacctatcttaagttttcagtttgatgagttctgttttttttttttttttttgagccaagtcttgctctgtcacctaggctagagtgcagtggtacgaccttggctcaccacaacctctgcctcctggggtcaaacaattctcttgcctcagccttccaaatagctgggattacaggtgtctgccaccacagccagctaatttttgtatttgtagtagacatagggtttcaccatgttggtcaagctgctctcgaactcctgacctcaggtgatccacctgcctcagcctcccaaagtgctgggattacaggcatgagccaccatgcccagctgagttctgataatttcatacagttgtaactatcaccctaaacaagatctagaatttttttttttttgagacggagtctcgctctgtcacccaggctggagtgcagtggcacgatctcagctcactgcgacctctgcctcccaggttcaagtggtccctctcagtctcccaagtagctgggagtacaggtgcacgtcaccacacctggctaatttttgtattttcagtagagatggggtttcaccatgttagccaggctggtctcaaactcctagcctcaagcaatcagcctgcctcggcctcccacaatgttgggattacaggcatgagccaccgcacccagccaagatcaagaatatttctatcaccccccactctccccacaacttttatttttgcccctttccattcaatccacacacctccccaaccagcaaccactattctgacttccatcacattaattttcctgttcttgaactttatataagtggaatcatatagtttgcatttttttggtctggcttattttgctcaacataatgttttgagatttatccatgtgctgtatcagcagtttattcattttaattgttaagtcatattccattgtatgaatatgcaatgatttctctattcattctgttgttgatggttgtttccagtttttagctactaggaataaaatcataataaatattcttggccattttgtgaatatgttttcatttctcttgggtatatacctaggagtagaattgcagggtcaaatgataacttgtttaaaaatgtttaaattttggccgggcgtggtggctcactcctgtaatcccagccctttgggaggctgaggcgggcggatcacgagatcaggagatcgagaccatcttggctaacacggagaaaccccgtctctactaaaaatacaaaaaattagccgggcgtggtggtgggcgcctgtagtcccagctactcaggaggctgaggcaggagaatggcgtgaacccgggaggcagaggttgcagtgagctgagatagcgccactgtactccagcctgggcgacagagcgagactccatctcaaaaaaaaaaaagtttaaattttttagcaactgccaaactgttttcccaagtggctgcactatcttactttctaccagcagtgtatgaaagttctgatttccctacatccctgaaaatatttattattatctatcttttaaattatagtaatcctagtacatatagagtggtatctcattgtggttttgatttgcatttccctgatgactaataatgttgaacatgttttcacatgattattggccatttgtaaatcttctttggagaaatttcttttcagatcttttgtacatttttaagtgggttatttgtctttttattattgagttgtaagaattcttcatatattctgggcgcaagtctcttttcatatatatgatttgcaagtatcttcttgcaatctgtggattgtcttggggagcttccagtctgtttgggcgagaagggacaaacacagggacagggcagtgtggagcagtgtaaggaggagaagcactgttcagggaggtctagggtgagctctctgagcctcagggttgctcactgctggatgagctgatctgacatttctgtggctctgtagcaagtatgtgtgtccctgtatgctcggtgctgtgcaatcaagcacacatgctaagtgtcagggaggtggcatctcacaagaccaggagcatgggggagactgggggaagcaggaagttctttctcttctttctttctcttctttctttctttttttctctttctctctctttctttctttctttctttctttctttctttctttctttctttctttctttctttctttctttctttctttctttctttctttctttctttctttctttctttctttctttctttctttctttctttctttctttctttctttctttctttctttctttctttctttctttctttcttttttggcagggtctcactttgttgcccaggctggagtgcagtggttgaagaacatggtttactgtagcctcaatatctcaggcttaatgtggtccttccacctcagcctcccaactaaccaagactacaggagcatgctaccatgtcaagctaatttaaaaaactttttttttttctttgagatgaagtctcactcttgtcccccaggctggagtgcaatggcacaatctcggctcactgcaacctctgctttccgggttcaagcgatttccctgcttcagcctcccaagtagctgggattacaggcgcccgccaccacacccggctaatttttgtatctttagtagagacggggttttaccatgttggccaggctagtctcgaactcctgacctcaggtgatccacccaccttggcttcccaaagtgttgggattacaggcatgagccaccgcgccagtcaggggaggctctttgttaagaaagaagactccatattgtaaacttccacaggactaacagcatggatgataacgtgattaacaggattatcatggaggtgacataagatggctcaggagccaggctgatgggtttaggtcctggctgtggtagatgtcacaacacagtgcccttcccatacccctttagccactcctgatgtttttttactataagcccctgggattttctgcctgagggtgctctctgctcagaaggcactccggcaggctggaggtgccaggaacagctctcaactaatgaagaaatcatcagtgtcatcactccttcagtgggatgagtaccttgtcttcttcactctcccagagatgcccaatacagtcaagccccatttgtccacagtggtaatctgctgattattgcaccctatattgcttttcttcatttgtttgtttcactccccctctctcctactagtgctccacggaatcatctctcaaatggaccatttatatgaacatccttatctcagtgtctgcctctggggatacccagcctaaagatagtggttcttttatttcttagatctatccatccaatttccttgggcagatcactttacctctctgaatttcacttggctcatctatagaatatggatagtatcacttctttctttctttctttttttttttttttgagaccgagtctcgctctgtcgcccaggctggagtgcagtggcgggatctcggctcactgcaagctccgcctcctgggttcatgccattctcctgcctcagcctcccagcagctgggactacaggcacacgctctcatgctcggctaattttttgtattttcagtagagaccgggtttcaccgtattagccaggatggtctcgatctcttgaccttgtgattcacccgccttggcctcccaaagtgctgggattagaggtgtgagccactgcgcccggcccaatagcacttatttcttaggatggtcatgcagtttagcatttcactcagacattaaaagttcagtaaatacttctatttttattcgtttactggcctgtaacataaatattctcccagagactcttggatggacatgcctcattcaggcatagctaggcagggaaagataagcagcctggagctggccctgtgggacattgattgattgggttcctgttcccagttacttgctccctctgcaatgggattaaatgtccccaccatttgtcatgtgacttatctggcatcctgtatgggtagcatacctccctgacccccatgaattaattttgggcttacccatgtgacttgctttgagtaatggcatatgagcagatgtgacattctccacatctgcaaagaagcttgaaatgtgttactgcatggtttggcacaggctctctcacccctgccctccactacaacaaagacatgtctccagtgcctgccacgcagtttgagctagcacctttaaatactttatttatttatttttttgagaggaagtcttggtctgtcgcctaggctggagtgcagtggcgtcatctaggctcactgcaacctccacctcctgggttcaagggattcttgtgcctcagcctcctgagtagctgggattacaggtgcacaccaccatggctggctatttctgtatttttagcagagatgaagtttcaccatgttggccaggctggtctcgaactcctgacctcaagtgattcgcctgccttggcctcccaaagtgctgggattataggcgtgacccaccgtgcctggcttaaatactttatttttaatttttaaaaattgttttatccatctatttacagatcattaaatacttactgtgtaccaggcagtcccatatgttacatgtgtctgcatgtattaattcatttcatccttgcaggaaccctaagacacgggtcccattatcaccatccttattttacatatgtggaaaactaaggttcagtgaggattagtaccttctcaaattcacactgcagggaaggggcaaggtctgccttctaggttgatattcttaaccactgctgtatgcttcttctcatggtaggtaaccagcaaatgcctattaagtaaacgtttgtttaagtgatcattgttcccttccatttacctgaataggaaaggtacaatctactgggacaaaggtgggcttctgactttggacctgctcactcttcctacgttagttgtttatcaaataggagacccttctgattcttctgagtggagaaaaattgtccgtggtcatcagacgggaaccccaatatttcccttgtaggacctacatgaaccacaagatatctcctataaattccatgtggtttccagacatcttccttgtggatcccagtgtggacctcagatctctctcctaaaggcctatgtgaacccctatatctttcctgaggcccacatggactcccaacattttccctgtagcagccacacttgataacttcgacaggttcccagttgtcatctcattggctgctctccacagctctgtaaatcagccttggcttgcattatagcagggagagacagcatgtgggtcaaccagggacaggactgacacagaacccagttgtcctgccccgaagcccaggacccttccttcctggttggcctggtggcaggatgatgcttcctgctcagcccttcccaggcaccgaggctctctccctccttttcccctctgccacactagttcttgtctgccttttttcactgccacccccttttcatgccagctgtgggagtgaggccccactcctggcaggatggagccagacaatgggcccttattctaggcaaagaatccctgcagtgtctcccacccactgaggcccccttccaggcctaggatggtgtgggtggggggtggagggtgggtgtatggtgtaggggaaggagcaattggctggcaggacagacagtggccctggccctgcctgtagagatcccacggaggtttactatgtaaacaccaatcacaataaaatcctgtcttcactcccagcccatctctccaagtgggtctctctcaaccctccaaagctctgggtttttaaacatttacccttgcctctactctctcttggtattcatctctgcatatcactgtctctttcattcctttttctgagtctctttctttttctaagcctctcctctctctctctctctctctctgctcctttgcgtaatttgtctctatttcttgcctctttcttgcttcattatgctcccttacctatcttatctttccatgtcttttttctctccaggccttgagctctcatctcagtctctctctccgtgtgtctctgtctctgtttgcagctcttctttctcgtcctcctatgtcgtctttccgtggatctgtgtccttgcctctctgaatatcatctccgatcttccgtcctctgttctctctttccccctgcgcctgcagatctgaaggaccttccgcagtcaccacactctcctgctttcagctctttctcactcctttctggcacgtcccagaggctcctggcataggtataggaggttattctccccagtttacagatatggaagctgaggctctggctgctggtgccaggctcccatctctgggtctcttccttccacctacacgccaggctcttgtccctgaggtgcccgtcaaccacctgatccggccggggcccgggaactagcacctcggacagctcctggaagatgccggggcggccgggtcgtccttctcgcgagctcaggaggagcagccttaggagcagagcggaagtctcgcgagagtgactgctgcaggcagtggcggcgcgggcgcgcgcagagacggcctcgggcgcgcgcgcgcgcgcgcgcgctccccgcccccagccccggagcggctcgcggccggctccgcgccgcatcgctcgggtgcagcgcagctcagcgcagcgctgcggcctttcggcagccgaacggccgcggcaggtgagtctgggcatgaaggctgggaggagagctttgaagggaagctgggcgcggggcgagaggtgtgggggtcgctggctgcagctttgttcctcctacacttcacctttggatgcaggaagaaggccgaactgctggagaggtgggagtggaggtgacctttactgtttggggctgggggagagcgctcagggcgcacccaggccccccgagccccccaagcccccccattcccatctgtggctcccgcagagggaactgggcctttgggtgacgtcagaccctggatctggagcctgagctttgggccctccatcccccccgccagccccacctggcgttccctggaaaccggccttctggagatggcgtgcgcagccggggatgggggcgactggaagggggtgcccgtggcttcctttgggcctttccttccaactagcgcctgcaggtggacccgggttgacttccctcacctccctcgggcggccgacctttggatggcggacctcagccgccccagggttgcgaggcgacgggcgcgctggcccaggccaccaggcgggctccatcagggctttgggtggtgagttgggggcgccggatttggctcatttcaacgctggccggaggtcacgaggatggaggtgaggtgtttgtgaaccgatccttgtcctccgcctcggggagctcctggtctgtgggttgggggaaccaagtagagactcggactgagcattcactgtcacaggcggcttaaacaagtaatgtcccagcttcccgatggggagatcagtgagggcctggcagactttcccagggacacagagagaaagggaggcgacagctagcgaataggagacttccagaggtgatgggatttgggtgggaggagaggcaagagagggcattccaggagaatgtatgggcaaaggcacagggatgaaaacgagcacagctgttgggggctgagcctgggagctcagccatgtgactgcccatggggtggtggagtctggagaaatttgcaacctgtcccctacatgttctgcctcacggagcagggctctgaaagagggagatggttcttgcaggggcatgattggcagagagattttgtttggggctacacaggtcttgctaacttaggtttgttctgggcttggtgagccttagggcaaagtctctagagctgagagggggctgtctctggtgaatgggcccctgaaagagggtcttaggtttagcaaaccccttggagagttagtggggtcccaggaggggagttctagagagagaccttgggctctgtggctgtttctttaaccgtttcctgagtggccacctccaagcaagttccccaagtcacctcccctctctgggcatctctttctagcacctttctctagagatgaaataataggactaagtagtgacctcccttgaggatgctccttgttctagtttagagcatcccccctttcttctccctcttccttttcctttcctcccctatccctctgcctccctgtccctatccccaccccttgccccccacagcatttcctttacaggctgcacttccttccctgctgccagccaggagtttcggaaggtttcctggaggaagtgtgatacagcaggtttgacagcagctttgggcttaatctgattgggggagggcgttaattgcctccctcccacccattgggaaagtgtccaagtcttaagcaagtatatggattgactgtgctctgtgctgggtccctcctggaaactccatccaggagggagtgaggagattatgggagaagacgtgaacacttagtgcccaatgactgactcaaaatgtatgcagcgggatgcagagcagcgatttttggaaaggcttcccagaaggggtgggatgtgagaaggtagcaggacttagaggagctgatagtgctgccaatttaggggcactggaagcagagggggcggctagagatgatctcctgcatgaggctgggagtgtaggaggcaggtcaacctgtgagcagccaaaggtggtgggagggaggtttgtagctgactggcacaaagccttgaatgccaggcaaagatctgtaggaggctactgaatagtcatcagtaggacagggacagcatggccaggagactgctgttttctgaggattattcatagttctgggatttcagggcagaagatggggctaggagtgggatgaggggattggaggtagagcaggagggggaaacttccatcttagcaggttggctctgggcagcaaaaaggaatcaccatttctgtgccagggatgaggggcccatactggtgagcagggagccctggagttagccccaggactctggcctgatctgaagccaggcttgaccctcgtctgctgccagaggcctcagtctccccactgtgggggcttctgtcctagcttcacaataaggaatggaatacattatagttagggtttcatgaacaaaattcaggtagtaactgctatcttattgataattaaggtgtttccctaggcctacatctttggagggatatgtagcccttatccccattataaaagattatcagttgagcagattgctaattcttctgttttgtagtctaagaactttggtttggccggcgcggtggctcatgcctgtaatcccagcacttggggaggccgaggcgggtggatcacctgaggtcaggagttcgagaccagcctggccaacatggtgaaaccgtgtctctagtaaaaatacaaaaattagccaggcatggtggtgcacgcctgtaatcccagttactagggaagctgaggcaggagaatagttcgaacttgggtggaggaggttgtagttagctgagatcgtgccactgcactccagcctgggcaacagagtgaaactccatctcaaaaaaaaaaaaaaaaagaactttggtttgcagaggccagtgattgctgtcttcccctccaaccccccaccccccatttcaaaggcttcccagaaacaagggcagagaagcctggagccttccatttctgtgaccctagtcttttaccaccctctcaagccccagattctctctgccctaacctttatatacaaacaaggcagctttgccctctgctctggtttctgctctgaattattcatactttgctgcactgacttctctggaactgtaagcagacttttgggagattgtctgggaccagggacaggggttaggctggagcccggttagggagaagactcctcctttgaggcccctatgttctagttgttttctcctctccctctgcttccttgttttcctggaggtctttagtgctggaccacagtctcccactccatgtcccattgtctcaggggaggtagtgcctctttcagtcaccattttaaccaactacatctgaatgtggtcctcattggcatgtggccacctctgaaatcttaaactctagtatttctctctgaccacagtctaactaatgctttatgtgctctgacctcaaggagacctctagttctcagacacctccattttctccatctcatgaattgcctcttccgtgttctttctgaactccatgccctcaaccactttgccactttgcctgtgtgtcacccgagctgccaggaagggtctccagtctcagccatcccttcatcacttatagaaacccctctcctcattcccatcagttcccctttctattccatgggaggagtattccaaactggactactctccccaggccctttgctcatgtagagggtggttggggtgtgtgtgggggaggtggaaccacccccatgttttcccgaggcggagcttgcagtgagccgagatcgcaccactgccctccagcctgggcgacagagcgagactccatctcaaaacaaaaacaaaaacaaaaacaaaccaaacaaaaacaaaaataaaaaaacacaaaagttagccaggcatggtggtgcgcacctgtagtcccagctactcgggaggctgaggcaggggaattgcttgaacccaggagacggaggttgcagtgggccgagatcgcgccactgcactccagcctgctgacagagagagacgctgtctcaaaaataaataaataaaataaaacacttcctgattgccatatcaacttgtcacctgactgcttcatggccatggatattgttgacccagtcgaccagtcattaaaaagattgagatagatctgtattcattaacatgaaaaactttcacgagatattgttgagtggaaaaaaacaggttataaaacaggatgtgtggaatgatctcatttttgtcatatatgattctatatacgttaaaaatgaaagccaacaaaatccaccaaacctaaagatcagactgttaaaggggtggcatctgagaaagtggattttgggaagacttttctactttatgcacttagattttttttttaattgcatatatttttacagatagctaaaaagcaacatattaattaactaattagtttagagatgaggtctcactatgttgtccaggctgtagtgcagtgactattcacaggtgcaatcatagctcattgtagcatccaactcctgggctcacaatcctcccacctcagcctcctgagtagctgggactacaggcacatgccaccgggctaggcatatttaaaaaacctttaaggccatttttttttttgagagggagtcttgttctgtcccccaggctggagtgcagtggcacaatctcggctcactgcaagctctgcctcctgggttcatgccattctcctgcctcagcatcccgagtagctgggactacgggcccgccaccaagcctggctaattttttgtattttttaagtagagacgaggtttcaccgtgttagccaggatggtctcaatttcctgacctcgtgatccgcccacctcggcctcccagagtgctaggattacaggcgtgagccatcgcacccagcctttttttttttttttttttgaagagaagaagaataaaatccttcagtggctcccgtgacactgaggacaaagtccaaatactgcccatggtcttcaaggccaggatgacctagccccatttacctttcaactccattttgcctttcctttgctcccttcactttgagattcatccttcctctgcctctttcgttccttaagtatgccgtgctattgctcttctgactttcacacctgctttcctgattctctttccctggccaactccctattccttgttaaaaattcagctccaggccgggcgcggtggctcacgcctgtaatcccagcactttgggaggctgaggcgggcggatcacgaggtcaggagatcgatactagccgagaccatcctggctaacacggtgaaaccccgtctctactaaaagtacaaaaacaaaattagccgggggtggtggcgggtgtctgtagtcccagctactcgggaggctgaggcgggagaatggcgtgaacccgggaggcggagcttgcaagtgagccgagatcgcgtcactgcactccagcctgggcgacacagcgagactccaaaaaaaaaaaaaaaaaaaaaagattcagatccaatatctatgaagccatccttgactcctgtaagacagaccagggaggtgttctgtgttaccacagctttctgagtctgctctcccagagtgctcaggctgtgtcagaattgctccttgatttagctgggtcctgtacgcttatctcctccctctcaccttcatcttgtctcctctatcacagagaaaattgggctaggtgcagtggctcatatctgtaatcccagcactttgggaggctgaggcgggtggatctcttgagtccaggagttcaagacaaacctaggcggccaggcaccctggctcatggctgtaatcccagcactttgggaggttgaggtgggtggatcacgaggtcaggagttggacaccagcctggccaacgtggtgaaaccccgtctctattaaagatacaaaaaatttgccaggtgcgatggcacgtgcctgtaattccagctactcgggatgctgaggcaggagaatcgcttgaacccaggaggcggaggttgcagtgagctgagatcatgccattgcactccagcctgggcaacagggcaagactcggtctcaaaaaaaaaaaaaaaaaaaaaaaaaaaaagagactaacctgggcaacatggtgaaaccccatctctaccaataaacaaaacaaaaaattagctaggcatggtggcacgcatctgtagtcccagctacttgggtggctgaggtggaaggatggattgagtgtaggaggttgaggctgcagtgagctgtgattgcaccaccgcactccaggctgggcaatagagtgagaccctgtctcaaataaaaaataaaacaaaattgaatgcctgtgaaaataaaataataaaacagaaaattgaagcagacatccaagatgctctcactgcccatctaagacctcaaacctgcctgcatctgcttggatcctgttcggcttcccacctgttaggatcaaggcttgtccacctccttgcactggtgcccctgtgtctccctcttcacgggctttgtctatcaggtaacatctgtctctactgtaattgcaacctttctatgtatcctacacatctctggcttatttccacctaaaatgacccccagctgcagccctccctgggccctctccctacccccatatcctacccaggtggtaccctatctctattctctctgtatattgtcagccaggcttctttatcactgctgtcaccaccaaaacgattcttgctggattcacagctgactcgatgctgttagtgtcatgaacgcgttagtcccggtagtgccatcctttcacatgggagccctcagtggcattatcacatttgtccaatctctgcccctggctatggagactccacgctctctgggctttcctcgtgtctcatcagctgctccttctcattcttccccaactatcctattctgcttgccttttttttttctgcttaactttcttgactttttatttttttgaataggtagtgcatttatatatgatttacagttcacaaagatgttccaaattttgtcagttctaagatgaacattttgatatttctgaaaacattttcatgtctgtgttttaaaatttctggcatcttacagttacaaattggcatttttatttttattttttggagattgagtctggctctgtcactcaggctagagtgcagtgtggcacgatctcagctcactgcaacctctgcctcctgggctcaagcgattctcctgcctcagcctcctgtgtagctgggattacaggcgcacgccgtcacacccggcttatttttagtagagacagagtttcactgtgttggccaggctggtctcgaactcctgacctcaagtgatccgtccatctcggcctctcaaagtgctgggattacaggcgtgagccatggtgcccagcctgcaaattggcaatgttttttcttacttttggtcaataaaataatggtctgtcttaaaactgatgatgtcatcaattatatggaaatggtataaagttatatagtaaatattctgcttcccacctactctatatccattcagttcctttgttccccagagagccacaattaccatatttttttcttgatatccttccagagattctttgtgcatatattgtcaaatacagatatgtatatttccccccactttttattttgaaaaatttcaaagctacaaaaaagtttaaagaatagggcaatgggctgggcacagtgacctcatgcctgtaatctcagcacgttgggaagccagggcgggtagatcgcttgagcccaggggtttgagaacagcttgggcaatgtagcgagacctcgtctctacaaaaaataaaaaaattagctgggcatggtggcgcacacctgtattcccagctacttgggaagctgaggtgggaggattgcttgagcccaggagttcgaggctgcagtgagctatgattgcaccgctgcactccagcctgggtgacaaagtgagaccctatctaaaataaataaataaataaaataatgcagtgaacaactgtatacccttctcccatcaattattaacattttgcaacatttgctttatcttttatttttactttttttttttttgagatggagtttcgctcttgttgcccaggctgcagagcaatggcgtgatctccgctcaccgcaacctccgcttccggggttcaagcgattctcctgcgtcagcctcctgagtagctgggattacaggcatgcaccaccatgcccggctaattttgtatttttaatagagacagggtttctccatgttggtcaggctggtcttgaactcccgacctcaggtgatccgcccgcctcggtctcccaaagtgctggtattacaggcgtgagccaccacgtctggcctatttttactttttagagacaggatcttgcgttattgctcactgaaggctcgaacacctgggcacaagtgatcatcttgccttagctcctcatgtagctgagactacaggcacacaccaccatgcttgtttctgctttatgtatatgtataaaattttttcgcagaaccgtttgaaaggacgttacagaccagacactgcttctaaagaccagcgtgtgtcttctaagaacaaaggtgttctacaggccggcatggtggctcacgcctgtaatcccagcactttgggaggccaaggcgggtggatctcttaagcccagaacttcaagatcagcctaggcaacatggcgaaaccttctctctgcaaaaaatacaaaaattagctgggcatgatggcacacacctgtagtcccagctactcaggagactgagactggaggatctcttgagcctgggaggttgagactgcagtgagctgtgattgtgctgctgcactcctccagcctgggtgacagagtgagaccctgtctcaaaaaaaaaaaaagaaagagagaaagaaacaaaaacatgcacacatacaatacccaagaaatttaatagtgaatagtagtatctactatgcagcctatattcaagtttctctagttgtcctaaaaatgtcctttatagctgtgattttaaaatccaggacctggttgggcgcggtggctcacgcctgtaatcccagtactttggaaggcggagttgggcggatcacgaagtcaagagatggagaccatcctgcccaacatggtgaaacccagtctctactaaaaatacaaaaattagctgggtgtggtggcgtgcgcctgtagtcccagctacttgggaggctgaggcaggagaatcgcttaaatctgggaggcagagcttgcagtgagccgagatcgtgccactgcactccagcctgggtgacagagtgaggctcttgtctcaaaaaaaaaaaaatccaagatccgggcctgtaatcccagcactttgggaggccaatgcaggcagatcacctgaggtcgggagtttgagaccagcctgaccaacatggagaaacgccatctctactaaaactacaaaattagctgggcgtggtggtgcatgcctgtaatcccagctactccaggctgaggcaggagaatcgcttgaacttgggaggcggaggttgcggcgagccacgattgcaccattgcactccatcctaggcaataagagcgaaactccgtttcaaaaaaaaaaaaaaaaattctgccaggcttccccattgcatttggttgcatgcctcttttgtctccattaatttagataaattccccctgccaatttctgtctttcatgacattaacatttgtctcgtagaatttcccacaatctgaatttgtcggattgttttttcataattattttcagattaaacctttttttggcaacagtattcatacatgaccttgagtccttctgtgcacagcatagcaggaggcacatgatgttctttctttctttctttttttgagacggagtctcactctgtcgcccaggctggagtgcagtggcgcgatctcgtcttactgcaacctccgcctcccgggttcaagcaattctcctgcctcagcctcccgagtagttgggactacaagcacgtgctaccatgcctggttattttttgtattttttggtggagacaaggtttcaccatgttggccaggctggtctggaactcctgacctcaagtgatccgcctcggcctccctttttttttttttttttttttgctttgtttttttgagatggagtctagctctgtcacccgggctggagtagagtggcgtgctctcggctcactgaaacctccgcctcccgggttcaagctattctcctgccccagcctctggagtagctgggattacaggcgcccgccaccacacccagttaattttttgtatttttagtatagacagggtttcactgtgttggccaggctggtctcgaactcctgaccttgtgatcctcctgcctcggcctcccaaagtgctaggattacagatgtgagccactgagccaggccctccctctcttttaaaaaataaaataataatgtcactttggactcatggattaataataaaaaaaatctatgtgggccgggcactgtggctcatacctgtaatcccagcactttgggaggctgaggtgggtggatggcttgaggccaggagttcaagactagcctggccaacatggtgaaaccctgtctctactaaaaatacaacaattggccgggcactgtggctcatgcctgtaatcccagcactttgggaggccaaggcaggtggatcacgaggtcaagagatcgagactatcctggctaacacggtgaaaccccgtttctactaaaaaaatacaaaaaaattcgccaggtgtggtggcgggcacctgtagtcccagctactggggaggctgaggcaggagagaggcagagcttgcagtgagccgagatcacgccgctgcactctggcctgggtgacagagcgagactccatctcaaaaaaaaaaaaaaacaattagctgggtgtggtggcgggtgcctgtaatcccagctactcgggaggctgaagcaaaagaatcacttgaacccaggaggcggaggttgcagtgagctgagatcatgctgctgcactccagcctgggcaacagagcgcgactctgtctcaagaaaaaaaagagagaaaaaaatccacgtggttattacttttgatagtctaattgtcccaaatttggttggtggtagccctttcagactggttcttgtgtccttttgacttgcctccattagttattgagtactttcttctttatgataccacaagatgttccaggctaaccttgtatttccttttcctggcttgggaccagccatatatatttttaaaattctgtgttcatactgatacctccgctttgaatccaacaccacaaggctctttcttacctttccgcggtctgaattgtatctcctacagtgagaaaccaccttccccaaataatcagcacactgattcatttgccctctcctgtagtatacgggcaaagctttagagtcgtcacagcagtaccagcagtaagagtaaacttgctaaaattcatgacttgtttgcagtttctttttctttttttgagacagggtcttgctctgccgcccgggctggagtgcagtggcgcaatcacacttcattgcagcctcgacttcctgagctcaagtgatcctcccacctcagcctcatgagaagctgggactacaggcgcacatcaccatgtcccgctaatgtttttttttgttttgtttttgtttttttgagacggagtcttgctctgtcgccgggctggagggcagtggcacgatctcggctcactgcaacctctgcctcccaggttcaatcaattctcctgcttcaacctcccgagtagctggaactacaggcacatgccaccacgcccaggtaatttttgtatttttagtagagaacagggtttcaccatattggccaggatggtcttgatctcttgacctggtgatctacccgcctcggcttcccaaagtgctgggattacaggcgtgagctaccatgcctggccatgtttgtattttttgtagagacgggggtcttgctgtgttacccaggctggtctcgaactcctgggcccaagcgatccatctgccttggtgtctcaaagtgctggaattccagtcatgaaccactgcacccggcctgtttgcagttatttttgcccttgaggtttatctttctaggagaacataggagaacccagaattactgtgatcaaaagttacttgggctcttttttttttcttgtctgtgagattgttatcaatttaaagtatagttagcttgatttgtttttgtttcagttttagagtttgcttttctttttggtttaagtttttgaaatatggaagtcattttatgtgtacaagtatattaaaaaaacttattaataagtatataaagaatggaagtctctctactcatcgtagcccttccgttatgtaggtgactatttcattactttctggttgattcttcctgtgtttcttttgcaaaaataagcaaattcatatgtgcattcttacttcccctttcttacataaggggtagcatatgatttacactttttgtgctctgcttttttttttttacttaatatatcctggaaagcattccacagcagtttactgagctcatctttattcttttttttttttttttgagacatggtttcactctgtcacccaggctggagtgcagcagcgaaatcttggctcactgcaacctccgcctcctgggttcaagcgattctcccacctcagcctcctgagtagttgggattacaggcttatgccatcatgcctggctaatttttgtatttttttggtagagatggggtttcaccatgttggccaggctggtctcaaactcctgacctcaagtgatcctcctgccttcgcctctgaaagtgctgggattacaggtgtgagtcaccatggctggcatcttttttacatctgtgtaatactctattgtatgatgcacctcgtatattcaaatagtcacatttaggttgctttaagcattttgctaatgcaaatagtgtcatgtcgaataacgtgtgtgtttgtcatttcttatatctgggtaaatgactaacaggagcaggattattaggttaaaaggaaaatatattcttattatcttctcttccttttttttaatatgaaaagtataacatacagactgttgtacatcttgctttttttaactactcatctttttggagacttttgcatatcagtacccagagaactgcttcctctttttaaaatttttaacagctgcaaagcatttttaaaaatagctgcggaacagtccattgtatgactaccattggtttaatcagtcccctattgatggtttctaatcctttgttattcaaaacagtgccgcaattaatgcacctgtgtatgggtatcatttcctgattgtctctatcatacccttctcttctctttttgtggtagatgttactgggtttttgtatctgtatttgatcccatatcacaaaagagtccgaagattgtaattgcccgatcttttaatcaggtccagaagaatttgactggaatgctagaagtttgtgtgtgtgtgtgtgtgtgtgtgtgtgtgtgtgtgtgtgtgctttttttcctttgagacagtcttgctctgttgcccaggctggagtgcagtggtgcaatcatggctcactgcagcctctacctcctggactcaagcaatcctcccacttcagcctcctgaggaactgggactacaggcacgcaccatcgtgcctgcctaattttttattttttgtagagatggagtctcactgtgttggccagactggtcttgaactactgggctcaagtgatcctcctgcctcggactcccaaaatgctgggattacaggtgtgagccactatgcccagcctgaagtttttattttaaagcaaacttctcatggaagtctaacacacaggagattgcacaagttgtaactgtatgcttggagaatgttcacaaaatccatacctttgtgtatccagaaccccgaccaagaacagatgccgggcccccagtcgctgccccatcaagggtaatactatcttgacttctaacaccatagatttagtttttcctgttccaaaactttaagcaaatttctgcccagcttttaaatgttgcattgccttagcacttggttgtggaccattttctgctgttgactatataaatgtccaccaaagtcactgttctaacaaggtgattgctgcttggtttccttggccttaacttgccagtgattacttagcatgggtcagccaggcctcctgctgaactcccaggagcagagcatgtttgtaccctccagattcctataagacgccctgtccaggtgtcccccagcgtctctaccctgtatgtccctagcacagctgctcgtcctcccctggaacctccgcctcatctcacacaggcttgtcatgatgggtctccaccatccactcggggttaagtgggcagggagtcttccaattgctccctttcccctactccttaaaaccaagaccccttcaaacttgtctcctaagggtctcaggaagcacatcctgcccaccttgcctttccagcctcatctgctgccccctcatttgcactctgctttggccatagtggctttctttcccttatgatgggtggctcatgcctataatcccagtgctttgggagtccaaagcgggaagattgcttgaggccaggaatttgagaccagctgtgcaacacagcaagacctcctctctacaaaatattaaaaaattagcatggtagtctgtccctgtagtctagctactcaagaggctgaggcaggaggatggcttgagcccaggagtgccactttactccagcctgggtgacagagtgagaccctgtctaagaaaaaaaaaaatgtgaagctccttcctagtaaggaactgtccctgtacgatgctttcccatctgcctagaaggctgttttgcccggggaactcctcttcatgcttcaggtttttactaccacttgtatttaatttccctgaggctgggtgcagtggctcatgcctgtaatcctaccactttgggaggctgaagcaggtggattgcttgagcctaggaattcaaattagcctgggcgatatggcgaaacttaatctctacaaaaaaatataaaaattagctgggcctggtggtgcatgcctgtagttccagctactcaggaggctgcgcttggaggatcacctgagcctggggaggctgaggctgccgtgagctgggattataccactgcactccagcctgggcaacagagagagaccctgtctcaaaaaaagttttttaattaaaaaaatttaatttccctgcctctccagaccagattagatcaccaggacatgatgtgtatgttttcacggtggctgtgcttgccttttgtatgatttactgcagaggtgattgactgtttcatggggagagcagggaccacatctgtctcactcattcttccagcaccatataagtgtcctaataaatgaacaaaggcaaaaggagcaaagggaggctagcctgtgaccaaggccgaggctcagtctgtaattcaaggtcaaggaatagaatgtcacttggctttccctgtatgggatcccctcccaggttcctttcctacccttggatggggttttcagagagtagattttgtgccttgaagcagagggcgggagcagctggtaagatgcagctggtggaagggtggctctgggaggaggggagctgcctccattgcattcacggcactgtgggagtatgtgctgggtcctgtcctggggagcttgcagcccagatgaggagtagagagggactgggttgggtgtggccctgatctcatccttctctggcttttctttccttgcagttcaggacaaagaggtgtgggcaggccactgggccagctggtaacatcatggcaggtaaggagaggggcaggctgtgtgggtaggacatgacagtgagcatagcgtggatggccctcttcctggttcccttatctcccctagtctttggaggccaggttctttccatcttactgtccccaagctttccccactctctccactgaggcctgtctgagaacttcaacatgacattgtctagccctctgtcagatctttggtcctatggaccaggaattgagcaccttgatgtccttgtcttactgtccatctgcctgattagctgcatgagtggctcagccctcctcccctctgtctctattgctttctaatactctgaggccttttttatctggttcagaaggctcagaggtgtagaatgccagagctggagggaactttagggaccgtgtagcccagcccccactccagcaaataaactgaggtctagagaggggcgatgatttgccccagagcacaaatgctgagtggaggctggaacccacgtctgtagattctcacacatccgcttcttctgcctggagctgcccccactgagagggtggtaccttgaggccctgagacagtgtcactcagaattaaaaaataataaatgctgtctgtcaaggtgacattgttttttattctgagtgacactgtctcagggcctttggctactttgggatcatcacagctgacccggggaggtagggacggctgggtggggaaagcagagtggccggtggccacaggggccaatggggcagcacagccaggggaaggatgggcgtcttggattgtcgggtggaagactggaggtgatgttgtgcaatgtgtctcatccacagagaaagtgaacaacttcccaccattgcccaaattcatcccgctgaagccatgtttctaccaagacttcgaggcagatattcctccccagcatgtcagcatgaccaagcgcctctactacctctggatgtgtgagtgccatgggatgggggtgggccagggtggctggaggaggcaggaagactgggcgtgctgggcagcggggtggggtgcccacaggcctgactgtccttcagtcccacttgtggcatatgcatggaccataagtcttcccctgccaggctcccagaggcttcttccatgggccacctccccgactgggcctcagtttccctcaacctcccccatctaggcctctcttcccttccttcccctccaccctcctttcacagagcatctggacaggggtccctctctgcagtgtaatccctgtcttcttgcttcccctttcccttccactggagtaactttccagggaacctctggggactgtcaggacctcaggattctggatttggagaggaatccttccctcaaagccttatttgtcttgctttctctggaagattgctcaaagagaggaggattcagctgggagttgggagctgtgggatcaagtttgcctggtcactgtgcttgccaagcagcaggttcctcatttgtaggaagaaagtattggcttggcgattgctgtggttccatgcagctctgtgttgggtggtctatacctgtaagagtctaatgtcaggcacagtggttcacacctgtgatcccggcactttgggaggctgagccaggaggatcacttgaggtaaggagtttaagaccagcctaggcaacacagcaagacccctgtctctacagaaaataaaaaaattaggcctgtgtggtggctcacacttgtagtcccagctattcaggaggccaaggcaggaggatccaatgagcctaggagtttgagaccagtatgggcaacatagcaataccccatctctttaaaaaaactagctgggaatagtggcacatgcctgtagtcctagctactcaggggactaaggtgggaggatcacttgagcccaggagttcaaggctgcagtgagctatgatcatgctactgcactccaccctgggtgacagagtaagagcctgcctctaaaaaaataattaaataatctagaattctttatttagaaaaccttagcatcaatgttctaaggttttaaggctgagagtgtaaaggcctcatttctggtgatctgtagcagggggtgggaaaggtgtcttcttggggggatgggacttggctgtgctgaggctagttagaaggtacctcttaggcatgtgagggggaggcaagctggctatcctgtgctgggtgtgagccccaggatcccaagatacccgcaatgtaactgcagttgggttctgctatatgtgacactgccctgagtgaggcctgcacttagctgcctacctgggcagatgcttgcatgtgccgacaaggtggtaaaatatactgtctttgcagcaggtccctcatggcatggtaggaagaggatggggcagacagactcagtttcaaggcctggcttggcctttgagtgaagaagggatctcccaccatgtaacctgagagaaggggggatgggacaggtgtgggtaagtctgtagatgttgggaagcaaatgaagaagttacctctgatggcttccattttttccatcaaatatgatgtagtgtggagagtgggctcacaacgaggccatgtttgtcgacggatagtgaggacactctccaaagaaacccggcccctaagatttctgggccacacacaaggttcatttgacattggctgatgtgaatttacagtcttcctcatggggtccccttttttcttagcaacattcagctcaggtacagatgagaattatgttcatctagggtgagtgtggccagaaggcagggcaggggagggaataagaaaatgagtaatgaattatggaatctaagctggataaggagaagagtgaagacagaaagaagctgatggctagagagagagaggggctgagctcatgggtatccattccagagaggaagcagaataattgcagcagaggtgtttgagcaagggagctggggcaggttggactggggagagatgtgaaccaatataataggttagtgtcttttctatataaagagcaaataaaatcagttttaacaccaagcctccaggagattttggggcaatgaacagggatagaggaaatacagctgaaatgtacaggaagaaatgcccacccatgaggggccctgagatgggtgacacggtggtcaggccaggcttgtaggtcactgtgtctgacctgggctctgggaactcaacttctgggaacatctcatccagaagctggatttaagggctataaatatctccttaagtcctcactaggcacccgcaggtgctttactcccaaggaaatgtatataacccttgaggtgcttaagggttctattcagaagacaggaccacagatgcctggctgtttgaggccacggttgagccctccttcctttgtttattcagcaggtctttgtggacttagctttgttttcaaggaagggagtgccctgatgttagataatgatgtgctgcacagacccgcatgtgtgttagtaccagcatcacttttatctgtaaatctttgaggtccctgctggccgtgactcagtgacactgtgcctcctagttcagctagatgaggtggggacagaggggggggggcctgggtcctgttcttggggaacttttagtctggttgatgggctgggatttatatctggggaaccttgagagcagcccaggtctgtagaaggtcagagggatgggagatgatgaggttgcagtagcaaaggaagacttcttcaaggagctggcatgagtgttatctaagaaatagattagatagctgggcactgtgactcacacctataatccggcactgtgggaggccaaggcgggtggatcacctgaggtcaggagttcgagaccagcctggccaacttggcgaaaaaccatctctgctaaaaatacaaaaattagctgggcgtgatggcaggcacctgtaatcccagctactcaggaggctgaagcaggagaatcgcttgaacctgagaagtggaggttgcagtgagctgagatcgcgccactgcactccagcctgggcgacagagtgaaattccatctcaaaaaaaaaaaaaaaaaaaaagaaatagattagataaagactgagattccagccgccaatgcctgccccatttaagtgcaaggtagatggcacaatggctagaagagatgtttccacaaggccttttatttttccctttccatgcccatatctcgaaagagaaagtgtaaggtcggtttcccatgtcttgggcttggtgattgctgtgagtctgggagggtcaggggctgaagccattcttgacaaggacaagagcatttctaccaccctgaggctttggggcccttcaaaggggcttgctgggcagaagctctgggttctggaggctgtgctctccagatttctcaggagtgggtgctggggttgaggggtgggggttggttcgagctcccagcttgcgttcttacagtctttactcctctgcgtgtgtatgtgtgtctcctgtgtctctgtatgtatttgttggtacgggttgtgggtcttttgtgtgggtgtgaatctgtgaatgtgtctgcatctctctgtgcttgtctgcgctgttggcctggcttgattgtgggtctctgttgcgttactggtgtgtgtgtgcccatgtccgggtgctcatgtgtctctctatgggcctgggtgtctgtctctatgtgtgcatgtgctcctgggcctgcagtgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagtaagtggttggtgctatccgcagtgcctagccgtctctgcccatctcccctgtctcttctccatatcttttctcacttctttttttttttttttaccctcccccaaactcactttcccttgctcacctttggctcagattgctaggtagggcctgggctttctgggggtgccaagttgaggtgagagggctgagagttagtttctttcctcctcactctacccttgggtgggggaaatatagacagaccaggcctattttttcttctgtcatccccttcctcaggcagctgcatgttaaattttgcctgtggggctgcctgtcttggtggagctgcccatcctagtacctgtggggctagccgacttggtgccaaggacaccatctatccatgtgccaatgggaccagccagccatgtaccattgacactgttcatgtgcaatgaggtcatccaactgtgtgccaaagggaacacccatccacatatcagtggggcttgctgtcttggtgccagtgggtgtctacctagtgccaaatggcattttcaatctttgtgccaatgtgactattcatcaatgtaccaaggctatctgtcttggtgccagtagaatatccatctcaatgctaatggggccttaaatctctttgtgccaatcaggccatccatctaagtgccaattagctactgttttggtgccaatagggtgtccattctagttccaatgagactttctatctctgagcctatgagaccatccatccatgtaccagtggagctagctgtcttggtgtcattgtccatccccttgacaatgagactatttattcctgcctcagtggagccatctatttctatgccaatgaggccgtccatccatgtaccagtgggtggtctgttcatgggaaatccctccctgtgtaatgttgcaacacacaggtctaccacgtggaaacttgcaaagatgtatgggtagaactaaccccttctgacctctcaattaaggcctttaaatgtcttctgtccattatgcacttaaacttggaagggcttgggggccttgaaggcagggaagccctggccctctgcccaggtgacgggagccacctcctctgccgcaggactgacagctccttcagtttcatggcattcttctttaccttcatggctcagttggtcatcagcatcatccaggccgtgggcatcccaggctggggcgtctggtaagaggcaggggtgtggcctggggctggcaggggtggcgttgtgggtgtatcttttgcttacctttgtgtgctaagctgtctagcctatggggcctgagtgatgggttgttgggagagtgagaggattcgggatagtgtagtagtacaaccatagcatcagagggaaggagaacctggcagtggtttcttgggggctgaggggtgtcagggattataggaaaacctgggggaagaaagtgttgtatctgaagagcacctctgagccacagggatggggtcttcttgagccactggcacaggttctttgggtatcagtaagatggtccctctgcatccagtgatatgtttcctccctgtggcaatgagacggtcccttcctctagcggggggctcctgggcacctcttatcctgcccgcagccccacactggcctcttcctgcagcggctggattgctaccatctccttcttcggaacgaacattggctcggcggtggtgatgctaattcccactgtcatgttcacagtgatggccgtcttttccttcatcgccctcagcatggtacgtggtcccctcaagggtgagaaggtggctttgggaaggggccatgttctgaaacaagccctcctccaagttgcaagaggatcccgaggtcttccaagggactcactctggaatggcctgcaggactctcctacagaggcattcatggggagggagcactgttttttttttacagatgggtcccatctatttcctggatgggctgccttttctctttgattaacccttctttacgctctttttcctacaggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtgtgttctgctgtgtcatgtgtcttcctgtggacttgcgtggagcctcacagcgggctgtggggcaggggcatgaaagtatggggggtgggtggatctgtggtctgtcattccccgagacctagagctatacgaccctgtgtggctccttctctgaggcagccttcagtaggtgatgaaattgccacctaggccccctgccttgggaggaggaagtagaagaagcaggctggatcggccgggcgtggtggctcacacctgtaatcctagcactttgggaggctgaggcgggtggatcacgaggtcaggagatcgagaccatcctggctaacacggtgaaaccccatctctactaaaaatacaaaaaattaggcgggcgaggtggcaggcacctgtagtcccagctactcgggaggctgaggcgggagaatggcgtgaacacaggaggcggagcttgcagtgagccgagatcgcaccactgcactccagcctgggcgacacagcaagactccatctcaaaaaaaaaagacacggctggatccctgcgtaagggatggtttggcccagatggtccactgcggctaagggcgggggtagagcagaggccccacctcagctcagggcaggggacccgcagctggttcagccacctcaatgaatacagaggttcctggggcctgtgaaggctagaaaatgaagggggcagggaagcatgccagtgtgtgttcttctgccgccttccctttgcccatttgatgccttccacctggatcgctattgggatcctctatctaacctcctggctgtccttcaagattcatttcaagtcactccttcaagaaggctttcctgcctagaggtgttgcttcctcatggaggatcttaccctgtcattttctgtgtccctgtttgtctcaagaacagggacgcatctgatttatctctgtatcctgtgcacctaaaatagaagaggcttggtaaatattaagtgccacgagccctcttttactaaggacctgccaacatgggccccattcacactaataccatgaagatagcccttttctatacttcgtcataaaaaagtaatacacacacccgggcagcaacttccacacaaacaacacatgtgcaaggagatcaccattatttccagcaaaatgctccccagggccgagcgtggtggctcactcctgtagtcccagcactttgggaggccaaggtgggcggattgtttgagcctaggagtttgagaccagcctgggcaatagagtgagaacccgtctctacaaaaaatacaaacattagtctggcatgatggtgcactcctgtagtcctggctactccataggctgagataggaggatggcttaagcccaaaaggtggaggttgcagtgagtggagatagcaccactgcgcactccagtctgggtgacagagccagaccctgtctcaaaaaaaaaaaaaaaaacaaaaaaaaaaacagctccccaacaagatagcaggctacaacatgcatgtgatgaagctgatttgaagcgctcagtgagaggtatctgcatcaagttgcaggaggagaagagagaaaggagagataatcatgttcctgaggtctcagccctggatcaggaaatcattgaagtattaacatatcctgacattaaggaaatgctgatgtttttggactttggcagtctgtccaacctgcaggtcactcagccaacagtggggatgaatttcaaaacgccacgtggaagctgtttgaatctttttgagatactgtaatattttcaataaacctgggacaacagcaaaaaaaaaaaaaaaaaaaaaaaggccccaagcaacaagcagtgtgtgtggggctgataggagtgaggaaaggaggtcggacagttatgccagcccctatcgagagtcccagcaatacaaagaacagggccagggtttgctccaggatttccccagtggactacaactcccggaaggcagagaagtggactacagctcccagaaggctgcgcgacatacagccagcccggtgctctcgtgaggcgtgccagtcagattccgcgggagagcggcagagataccgcgatatttgggagcggccccgagacgcgcctggcgcgggtgagcagtggaagggggctgggaagctgggttctcgcggcggcgcgggaggggaggttcggggagctgtgtccgcgagcgtgggtccacggctgtctgtgtgtgtccttattttcccctgtgtgcccatgaagctctgtttgcgactgtgcgtgggtaggcggccgtccatctgtgcgacctcactttcccggctgtacgggtggggccgcctggagcaggagggacccccgagccctgagtggagggtttgcatctgtacccgtccagcccgactttgtgctgctctgcgattatttgtccagtgtcgtttaatctagtttaaatgatggccgtgtcagctcctcacactgaacgcttacccgggctgcccaaagtacaaagtgtatttaaaaagttggtaaaattaaaaaaggaaagccatgggatgttggaagtagccctaggcctgccaaaaagtgctgagtgctatttaaaaattaggccaaatcttgtcagaaaagaacttcctgctgtccttgaagtatttggaagcaggtgctagatggtgagcaggagaggttgccaagttggggaagtggtggttgtcctggagcaggggtttccacatctctcacagtggctgggaagtagcaattcgcagtcactgcctttctagtagcccacgtgtgtgagtgtgtgtgttagatacatttatccctcagtatccgcaggggattgctgtatactttttttttttgagacaaggtctcattctgtgacccaggctggagtgcagtggcaggaacatggctcactgcagcctcgacctcctgggctcaagggatcctcctgcctcagcctcctgtgtagctggaaccacaggcataaacaaccatacccggctaatttttattttatttcatttttgtagagacagggtctcaccatgttgcccaggctggtctcaaactcctggctcaagctatcctccttccttggcctctcaaaatgctgggattacaggtgtgagccaccacatcaccctcctgtatactcttttttcttttctttttttttttttgagtcagggtctcactcttgtctcccaggctggagtgtagtggtgcaatcatagctcactgcatcttcgaactccctgggctcagataatcctcccacctcagcctcccaggtagctgggactgcaggcacgtgccaccacgccctccatataatttaaataatctctagattacttataaaacctgatacagtgtaaatgctatgtaaatagctacacacttttttttttttgtggtactattattatattttgaaatggtctctctctgtcacccaggctggagtgcagtggcacaaacatggctcactgcagccttctaggctcaagcgatcctcctgcctcagcctcccaagtagttgagaccacaggcatgtgccaccacacctcactaacttttaaattttttgtatggggtcttgctatgttacccaggctggtctcgagtacctgggtttgctcaatcctcccaccttgccctcttaaattgctgggattacaggtgtaagctggagcagaagcctgggcagccggtagtgaggggctttgatgttaggctaaaggattcaggctcataatggatcttggatccctgcctacccaccacccacttcccttgtttggttctgctttgtcttaggctcagttctcatccttcctgtattgagcttgaacgtataccctgtctggccttgctttccttgctctgtctttagtctggttctgtgccagctccacctttgcccatatagggactggcaggtatccctgaaacctaaaactctgccctgaattaaactcatcagaggagacttaaacatcacaagctgaggctctttgctctgtctgtccctgtctttctggaggatagagaagctgccatttttctggctgtggcttacctgcttggctagtgccctgggatcttgaggctcagtaatcaaagcgtgtagccctataacctgcccacttgccaactctttttgctgctcaggagttcctgtgaattcagcagagcccggggaagtcaggtactacagctacctgtgcaaataggtgactccaacaggttctggttacagtaatagacttactggtttggaatttgatcctctttgcaagcaaatgaaggaatcctgccagccatcacccttcctggaattctcaggttgaactgattggacctcgcctccaaatgttggttaaatgatccactttctattcttcaagtatattaagcacacacatacacacacacaccctcttttttaggaaggtaggtaggtttgatccttagcacagctttgctaagcaggctaagtactgtatttcggactatagtgcctgctgtggggaagcagttgaagtcactaatacagattcctgccccaagtttaactgactgctttctgtaacctgtttcctaggaatgagatcagcttgatgtggaggaggttcaggggcctcagagataaaatttggcttctggttttgcaggaatctacctatcctagcaccagttggctagggtgggacagggtcagggtttgcgatctggcaggtaggtttccctggagaataaagaatgtgcctccatcacctaccaatgatgtgttctgggaagaagctggctggtagcccttctgtaccttgtcagattctaacagggctccccactccctggggtaaactcagttctccaactctggccaagcattgccctggttggggccctgcagtggagcagacattgagattactggcaaatcaaactttgggtgatcttgccctagggaaccagcctgtgcttaacccctgctgagaagtgggataatgcagccaaacatgatcctcagcccacgtgggttgtgctcaagtgctgaaggcaaatcctgggcagagaggctagagagccaaggggcctgtgagtgaagaggagataggcccctgtggatgctcagccatggaggtagccattggacaactcaccagcgctgcttcctgggcagctgcctgggtttcccttgccatgctgattcttttttgagtgcatcttctaggaccttctgtcttggaaggagagccccttactgctctctttcatgtattgactcaaagtttctgctggaaggagcttcagagatcatctggtcctacctctgcatttttcagatgaagggacaggtccagggagggaatgaccctggaccagggtcactccaggtcaggagcacaccatggtcagggcccagggcttctgcttcacaggctaggtatctgtcttctgctcacactgccttggagggtatagttattcattcagcacctgttcaggactgccggctagtggactgctggttggcaattagacccggtcacacattcagggagcttgctggtggagggagaggcaaggaaactgatgtgttaattgagtctgtgatcaccaaaaaggtgcatcccagggaaggactgatctcaaataatttcagacaggtgtcattcctgtcttctcaaactcaacctacagattccccagaggcagctactgtgttttccacaattcctttgcatggtgttctttgtaatcggtcctcagtgatggttgctgatgaagcacgttctgctggcccaacccgccacgtgtaggttttggtgtccatcagccatattatcatgagtgcacacttctagcaacgtctgagagccagaggaagaagcaaaccagctaatctcctggggtggcctgcatcccctttatgctggtttcttcctgggctttgatttgtacggtggtgcccatcttgattaacagggacagggacagagaggcaaatctcttggctccctggagcacccaaacctccctgttgcccagggttccacctcatgagcatctttggaacccatcccttcctgccgcttcctttcaccagtcagcccagtccaccgcagcagctcctctcgccctccagtctctccactaacagggtccctttgacactgtcaccaggtgccagcaccgtctttctaaaaccaaaactcctcaccctggccctcgctgcccacggcattctggcctcaccctgactttcagtctcactttctgcccctctaccaccccccatcacagtccggcctcactagtaagccactccctgttccccaacctgccaccctcctcaggaccttcaccttggcaagattgttccttcctttgaagtgatttcttcctgtctctgaaaaactaactcatccttcaggactcaaccccaatgtcattttttctgggatgcaatctctgacttctagagatggtcaccctgagcagccacgcacctggtacagcccttccccacagcactgcatcattcccttgtgactggcccatgtgtggggaaggtgtctcactttcttatcaaactgtgtgctccctgaagccaggactgctgatcccttccgctgcctcagcctctggcctggggcctaatacgtggtgctccatacattctggtcgactgtatgaatgaagggggtggcccttgttctccttttagatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctggggtgagtatcctcaccagataagcatggcagcctccggcatgggaggccggtgctcccggggatggcccattgctctgcagtacatgcaattttctttttctttatcatgttaatcatgcttgtggaggtcctgtgtgtgtggtgctctgtggaggattcaggagacagagaccagtgcccagtgtaaccaggggctagattagatagtacagacagggcatgaggggagactgggaaaggacccagtgaacggagggtttgggctcccatacattaaccctgagaatccgtgaagtcctgtgtgggaggagggctggctggagaagtgcagcaagttctcagtatcccctcctgccttgggcttccccatccctgctttcattccgccttgaacactgcggctgtgttctccctcctcgtgagacctcatggttgtcttgtcagtcaaatgctctgaaaccccattgtctgaagctctaggttcaaactttgctccttcaggtgttcagagctgccccaggggcccccgactgtgtgctggggtgagggactctagcccccgtccttggccagaccctcaacttggatctattttctatattggggttctggtgcagaagttcaaggctttaaacagcgtgaaatctaacagggagtggccccacttcctagttccacctccagggcccttagttggtctgtcttatcccccttggtctttgcgtggctgggccctgctaggctggctgccctctctgctcctctctcgccttttcacattctgtgcaaagccttccctgtctgccccagcccagcccctgtggttttggccccttcttttaaacttatttgacatagaactataggttgccttagacactgctggtgttactggcccctagtttttggtggggtcttgtgaagttgctgggccccaggcctggcttttccctcttgttatcagctgagcacccaaggtgcagtggccgtatctggcatgtccagcagggggcggtgcttactcacagatgaccacgtggtcacatcagctggggctgggctgggaagtgtttcacttttttactttccaccaacttccacccagaaagtcaccccatcaccccacccccagggctgggataagccatgaagctgccagccagggatgacagccaggccagagtgggggagggaggagagtctcgtggcactctgacactgggtgctgcacttttagggcagtgctgcttaggcccagccacccgctgtgtacccagaagcattggtaggagctgcccagctagagccgtgagggtgggaggcctctgccaccaccccctggggagggagggagccatgcagttcccttttcccatagccccagggcaagtgagtttccggactaggggtggataggggcggggagtcctatcccaggaaacagatgggcagcctcagagcggagggaaatggcaaccctaccgcttcctcccatcccacgcagccagcgtttggtgggaggggggttgtgaggaaagggttgcctggagcagggaggtgctccagcccaccccagggccttttagcctgggccccatgggatggcaggccatgtctggaacaggacttggcttcccctctctggttggagttgatgccaaaagtgaggcagccagagggcactgaactgggagggagggctccccgactcagcctcttggagcttgcctttcccatttgaaaatagggctgattcctgctgcccatcccccagactcttgtcaggctccctgagatgttggctggggtgggaggggtcacagatgaaaatggtcctgtgccagtgactcagcacagagcctggcatgttgaagcactcggttgtgtgtgtttcctggccatcaccctgtcctttccccttgttcatgtcctttgggccagccacatggtgtggggcaaccccactgggaagagccatggaagccacagttcacctgctcttgtggagggcccatgcctttcatctgcagggagacagctctccaagcctggccttgcttattagggccctcgtgaggtgttgggatccaaaggtaatccctggattgccttgtgttggccccagtggtggcgtctatccctgcacactccccttcactccctgatggccctgatctccacattgcctcctgctggatctcctgcaggagcatcattgtcccttggagcagtcactttcagctcttcacctgctgagtcgtgggttcaggtgctcaaggctttccggaacttccttaggtacatccagattttgtctagcacatgaacagctggggtgtgggctgcagggagctgggggattctacagatctggcccatcactgttcctgattgaccagtatgtccagacatcccgggaaagccgctaatgtcaaggtagccaaatcagggagactgtgaggggtggtggagagacatggattagccacaagccacacacaccagcagtcagggagagtagtcactagcagagatgaccttgagtatgttggggcaggtgggcaaccgtgtcacaagagaggcagctgagcacatttctgacgctgggaccctgggcaagtccgttctttttggccataattttcttatccacacagtgaaggaggggcaggttctcaaatgatccatctccagggcctcttctggcactggtgttagaagattctagatgtgagggcaaaaaggactaggacccaaaggcagcctgagagaaggtcctggggctcaggagcttcaggatgccgggggttttgtagttccgtagttgtcatgtaattgagtggcagtaaaatccgggttgtcagctcaggcagtttcttccctggggttggcagcctggcccatgcaggggagcaaaaatggctttcctccatcttgctaggctgcttggctgggctatgagttcaactgacttataaacaaaattaacagggccgggcgcggtggctcactttgggaggctgaggcgggcggatcacttgaggccagttcgagaccaccctagccaacatggtaaaaccccagctctactaaaaatacaaaaattacccggttgtggtgggcgcctataatcccagttactcaggaggcggaggcaggagaatcgcttgaacccagaaggcagaggttgcagtgagctgagatcatgccactgcactccagtctgggtaacagagcaagactccatctcaaaacaataacaacaaaaaacaagatcaacaggagaaaaccatatttagttacatatctgcacatgggtgtaccacaaaatatgagattcccagaagggtgagatggctgaagcctgtatagcagcctgagctacagaaggaaataggggcttggggcttctgggggtggtggcgacacaagttatgggagggtgaggggaggaattatacggtcttgttaggcagataaaaacctctcagataataaaagatgcctcagcagattgtcaataagtcagtcttcctttctcagggagggggactcaggacaaggggaatccctctttaggcagataagagaagttcagagaaagttcctccctgcatttgtttttcccccagtgccttcaggtttgaaataatcagcataccaaagccgcatattatggggtggcatttcctgaactccttcatccacacccttcaaacttgggaggagaagacagacatcgccctagcttttgccagggcaggtgtcagcagaattcagagccaaaaggggatttctaaagatagagaaaacccccaactcaaggagtcagcaggcctcgggctcagagaaggatacatttctagggtgtctgtcaggacatccaggtctgtcgagggtgaggaaaagaaggctctgctcatatgcagtgtggagtaaattctgactttctggaggaccacttgacaatattgagagaaattaaaacatcttcatagtccttgatttacccacaggattaaactctgtggggtgtatttacaaagtgaaaggatgtccattatagcattatttataatttcaaagcaaaactggaagcaaacaaaatatccagcagtagagagctgtggtgcccttatgatttatgggacaatctctcagtggattacttggcaatgattcagaaaaatggggtggctctctctgtgctgaagggagcaatcatcaagatggaagcggaataagcagggtgtaggagctagcaaactggacccccccccccaaggccaaattcggctctgcctgtttttgtatagcctacagctaagaatgatttttacattttaatttttattatttatttttgagacagggtcttgttctgttgctcaggctggagtgcagtggtgtgatcactgctcactgtagccttgacctcccaggctcaagcagtcctcccacctcagcctcccaaatagttgggactgcaggcgtgccatcacactctgctaatttttttgcattctttttgtagatacaggattttgctatgttgcccaggctggtctcaaactcctgggctcaagtgatctgtctgcctccacctcccaaagtgctgggattacaagcatgtgccactgtgcctggcctgatttttacatttttaaatgattaagtcaaaagaaaaatagtattttatgactcggaaaaaaagtgatatgaaattcagatttcatgtccaagacaatttattggaacacagccatacccattcatttacgtattgcctatggctgcattcgtgctactacagagttaaatcattacgacaaagcctaaaatatcatctggccctttatagagaaggtttgccgacccctggtatgcagcctgattccttctgtgtgttcttatactgagttactgcacacagttttttcctctggaggtggttacccttgtgaagggggaccagtggaggaagggaaacttgcatttttcatttttgtatcattctgttcagttttaatttgtaacctatgtgtatatttgtgtgtgtgtgtttttttgtttgtttgtttgttttaagtcagtggggcttttggtgggaatattggggaacattcttgataagtttgtgctttttttttttaaagtgctcactgaggaaagagcagaagacataaggcctggtttgaggatttctctttttttctgggtgggggccacctgcccgctctgtgtcctgatgtggaaactctgagacctttatttgtgcctctgcctgcttggctggccccttcctcctctggcctgcagccctgtcacctgctcctctagggacagagctctgtcggcctctgggcagagggtcccgcaccccagggtccttccctgattgcccagaacaacgttcctgtgcagagcctccctagaccacctccctggtttccttcttgagaattttctgaagttggggaagcacacagaagggttggcatgaggagctgacacaaccagaacaccagctcccccaggggcagatgagagcacgactgtttcctgcagagccaggtgggaaaggtcagggtcacagaagggctggggtggtacggtgagctagatggagccctaccatgtggtctaaatggcccatgcatgggtcataaggggaaaccaggcacagaggaagagggtctcgcccacggccttccagggagtgagtgagttagcagaactgggggcttgaggccaggtttcctgggtcctatcagtgagtgaattgaagagctcagacctggagctcattctctgctcaagctcaccaatgcttgaggatggtggaatttgtggattcctatcttggtctgccttgcagttaggggttacctgtaccccacctatctgttagactgagccctaggagaggccagagcttggatcttatcagccctgcccccaccatataagaggcttagtaaatgtttgccgagtagaggcatcatcatgagccatggaacccactgagccaaccggaactcccttgggggttttgttaaggaggccacctccttcacagctcccgcgcctcatgtgccaaccgcactgggccccaagaatcctttgtcctagaatgtacccaccaactcccctgctcaggttagtgtcagcttcttagctggccgctaggacctgggcacagatctggagcatgccatcgtcaacactggtagacccaatgtcagagtcctctgctgtgcgtcctggcccagaggactgggccaccaaagccctgggttccttgtcttgtcacagattaagtgcggggctaccacttcctctttagaatcctccttggtctccagtggaggcatcatcacgccctactagaaacgcctgctctccagccactcagctgctagttccagttgggctcttctccttttcttgtatatgccagagctgtgctatctgatatatttaaattttcttgtatattccagagctgtgctatccgataaatgtaaatttgaatgtggcagccgcttgccacattcaaatttaaatttaaattaattagaatttaataaaaaattcagttcttcagtcacagcagtcacacctcagatgctcagtggccacatgtggccagtgctgccacaccctacggcacaggtagggccgttcccatcattgcagagatggaaatgctcttcacggataatgctgtagagttgtggttctcaacgggggtgattttccctcccaggggacattggataatgtccagagacatttttggttgtcctaacttagggatggtggtgctactggctcttggttctagtgggtagaggccaggaatgggcttggcggtggagactcaggccatgggatttgtctcatcctgtggctgcgaagtgcctctccacgagttcctttgataatctgccccagacgtagcctggccacactaggggcctgaagtagaaacgggaggtatcactctaaatcctcattccatttctcctgaccagacccaaatcaggattcctgatgtctcttcagcaaagaaaaggaaactagacttgccaactggtttcgggaaggaatctctatacatgctagataaaatgcaggcagcttatgtaatagggtctgtccaagcctcagtcacatacacaaagagatttagcttaaaactattagctgtaaaaacttttctcaggtaggctgagcgtggtggttcacacctgtaatcccagcactttgggaggctgaggtgggcagatcacctgaggccaggactttgaaaccagcctggccaacatggtgaaacactctttctactagaaatacaaaaattagctgggcgtggtggcgcacaactgtaatcccagctactctggaggctgaggcaggagaatctctggaacccaggaggcagaggttgcagtgagccgagatagtgtcattgcactccagcctgcacagagcaagactgtgtctcaaaaaaaaaaaaaaaaaaaaggaaaaaaacttttttctaagtggtgtcagcaggggactaagccgggagctgcctttcaggaattctgtagcatatgggggattcttttttaatgcccagcgctgcttctaccaggacccacaaaggtgtaagagaaagccaaggaaggctcctgccctcagggagtttctgccctgccagggctccttggcatttgctgggaaaaggtcaaggtaaatgagtaaacggtcagaattatttagtatcatagaagataacacatggttttatttatttatttatttattttaatgtgtacagggcccagcccttggctcccaggaccttttggtggagtgaatgaaaataaaagaacaaagcccatagggctgatgaatcagatcaagtgacatccctctaaaaccagaaaaactagtctgggcctgctagacagcactggggtcagtcagggtcacctccaaggagagtcagctgcttcagtgggtcagaggtggggcatcaggaaagacccgcccatcacatactcttcgcattactccttagtgaagaccttgaccccaggaggctccctaacaatgtgactgtaacctgggagggtggctagagagtggagcctctgagaggttaggcaaagagcttagagggaagatctcaagcagggtgagaggcttaacaggaccccgggtggagctccccaggggacagtgggggcctaaaggctctgagaccttgagtgacggtgtagggaaggaagaaagggtagagttgagagggaggcgagaacccctgaatcaagggcattaccaatttggggatgattctttttatttttttattgatggatgattgattgattattttttttttgtagagaaggagttttgccctgttgcccaggctcatcccaaacttctgagctcaagcaatccgcccgtctctgcctcccaaagtgctgggatgacaggcatgagccaccatgcctggcgcccaatttggggatgattctgaaggccagcactaggcaaggttctccgctttgcaaactggaagatggttttgggagctggggagagtggaggacctagaccttcaggaagtagctttccaaatttcagaatagaggcgatgaacctgggacattcttaagtagcaaatggttcaggatggttgggaagctcttagaaatgaaagatggtggtcccatgagcagaagcaggcagtgtattagcagagatgtggtctctggctacctgaagccttctgttgaaggagctggaaaacagttaagtggaagggaggacatgtaaccagagatgaaggaagaatgtggtccagagccccccagggtgagctgaagcttatggcaaaactcaggaggctcgagagggctgttttatgtatttggaagaagaacaatgaagcagtgtctggtgctggaggccagtggtaacattagcagaggataagaagaaatgggaggggctgggcgcggtggctcatgcctgtaatcccagcactttgggaggcagaggcatgtggattgccctagctcaggagttcgagaccagcctggccaacatggtgaaatcctgtctctagtaaaaattcaaaaattagctgggcatggtggcgcatgcctgtaatcccagctacttgggaggctgaggcaggagaattccttgaacctgggaggttgcagtgagccgagattgcgccgctgcactccagcctagatgacaaagtgagactctgttgttgttgttgttgttgtttttaacaaagaaatggggggattctttgatctcattttgttcatcttctcttttgagcttgtggtggtaggagggacctgaaccgaggctgggtgattcatctcctgtcctgggcaagttctctcctggggtgctagggtactgtggttggtgacctacaggaagtgtgggaaacgtcaaaggggccaggggcaggagatggctagtatccatttatcaaaaaggtgaaggaggtgagctccacaaattgctacagatgaggcttgtaagtgctaagaaaagctagattgggatcactaggaacaaggcatatcgattttagtttatgttttggatagtagacaaagtatttttcgatttagatgaggcctttgatggaatcctaggacctctccctagaccacctggggatgttgtcagcatgttatagccagtgaaagatccaacttggaaagagtttcttcttggttctttctcaccccttgctctgctgccacacccacgcccgtggacattgtgggtggcctctgcccttgactttgttctgttcataatttggattagtgtctctgggggctactgatggtggtgctggctgagaggaggagcaacaggattgagctctcaggagctctctgtaggctgagcaaacagcagaccaactctggtgaggggaagtttaccagggacatgtgagggacagcatttgggaccagaaaaataactgctcagatacagcctggcgcttgtggcttagtagcagcatgaatgagaataatttttttgagtttttgctgattgcaaactccatacatcagcagagggatgtggccaccagaagagctgctgtgggctcaggctgcaccaatagacatgacgctctaatttcttcatgaacctaacagtggggttgccttctccgacccctggaggcagagtaaatggctctcacctgtgggttcgtcacttctgggaaatttaatttaattttttttttgtaattttctcctatttttctgttctctctggaactctttaatcgtcagattttttaacctactgaattgattcaattttctcatcttttttctactattatccgtttctttatctttttttttctcctttctggaagatttcttttagacttgtgttgaattttttatttcactgtttataatgttaatttctaagagttcttttttgttccttgaatactcattttaaaaagtgttatgttcttgtttcttgggtgtagtctctcatctttaagttttcttctccctctattgtctctgggtttctattttctgtttgtttgtgtaatctctttcttgctagaggactctcctcagatatctgatactccttggctgttcttatttgggtgccaaaagttgattggaaactctgtcttcactgccagggacttggtactcatctggtattgaaatgttttgttggtggacctctgaattccatatctgaaggtttccttccctaccacatctccctactgccagggttatttgttttttccagaaggaccctatcagtagtctcctgcctggttgaccttgcgttcttagggtcaagtaggggaagcaggcttgggtctctgtttggtctgtagatactcacttctgctccaggactcctttgacctctgttgtgctaactctgcaagggtagtatgtttggctgccttgggtgggaagaagacctggggggactttagctgttccttctacaggtcaggaagtcctcctgtattcagctatctgcctcatgctcacctttgtggtactcactgcctcaagtcctaggctcctgggctctaattggcttgtgtctcagttactgtgtaggctttggatattttcttttctcatctaatctaatcttatcttgtaggatctgctctgctagtgcttcctttcgcttccatcttctgaaagcgcattggcacgtcttaactgctgttggttcctcttctttttgttcttgagaatttacttcttttctttctttgtttttttttttttgagatggagtttcactcttgttgcccaggctggagtgcaatggtgcgatctcagctcactgcaacctccacctcccaggttcaagcgattctcctgcctcagcctcccgagtagctgggattacaggcatgcgccaccacacccggctaattttgtatttttagtagagatggggtttctccttgttggtcaggctgatctcgacctccccacctcaggtgatctgcccaccttagcctcccaaagtgggattacaggcgtgagacaccatgcccagccgttctcttctcttctattccttgacaaggtctcactttgtcacccaggctggagtgcagtggcatgatcttggctcactgcagcctcgacttcctgggctcaactgatcctcccaccttggcctccagagtagctgggactataggtgtgtgccacgatgctggctaatttttttgtattagagatgtggtttcaccacgttgcccaggctggtcttgaactcctggcctcaagcaatctgcctgcctcagtctcccaaagtgctgggattacaggcgtgagccactgagtttagatcgttttaaaaaaaattactttacttttattttaatgggcttctgggagggagcagagtttaccttatttaactaaaagctttttcttctatttaacctttatatgttcttttgctttaaatttatctttttatacaagatattgatggattaaacaatatccaagataagaatctgaattttaatacagaagatgagcctgttatatatttactataattattattatattaggatttacctatgctgtcttatttaatgcttgcttgctttttatttttttatttttttattttttttggagttagggtctcaccctttcacccaggctggagtgcagtaacttgatctctgctcactgcagcctctgccttcccaggctcaagggctccgcccacttcagcttcccgaatatagctgggactacaggcgcacaccaccatgcctggctaatttttgtattttttgtagagatgggggtctcaccatgttgcccaggctggtgttgaactcctgggctcaagcagtctgcctgtctcggccttccaaagtgctgggattacaggcatgagcgtaatcccattactgctcccggccaaatgctttatcatatattctctctgcttctttttctcctttcgtatcctttatgtgtagattgaatttccttctgtgggtttgaaaggtaaaggttattcttcttatggttaccataacttattgtgccctcttctttacctcatcactatcttgtgtcttccccacgaaagagacagggccttcagcatggccccgccctgccctgctctcccaacctgtgctggcccagtggcatctccaggactgggttccggggagggataatgcagccctgctcatttgccatcttactcagaactgggcaaggcttattcagggccatcctagggagactccagcattcagtgggagtttggtttaaatgacctctaggctgggcatggtggttcatgcttgtaatcctagcactttgagaggccaaggtgggtggattgcttgagcctaggagtttgagataattctgggcaacatggtgaaacactgtctctaccgaaaatacaaaaaattagctgggcatggtgacatgcacctgtagtcccagctactcaagaggctgagatgggaggatcacctgagcccagggcagttgaggctgcagtgagccatgatcacacaactgcactctatcctgggcaatggagtaagactctgtaaataaataaataagtgatggacctctgaaaaggtccttgaggtttttttgcaggttctgggcatggtagatcctaagggggagtgagatggagaatggacaagtcaatagaactcagaacgccagactttctgaagttcttcctcagtcttcttctctgagacttctactccttggtcctagctttgttcctaggcgctgtgccgctgtgtcatccaccctgccctgtacaatatgcaggaagcaagcgaggagggggtgcctcagagagacagtaaggaggaatgaggacaaggtggaattggcatgggcacgtcctacagagtgagaggcaggccttagggcaccacgtcgctctcacgtaggaatgtgtgtccagcagcgcctagccttcagcttttcacaagaactcaggaaattgaattttctatgcgaaatcttccaacttggacatgttggctcaaaaatgttaataatcttgtgtaggccaaacagcatgtctataggctgggtctggcccagacatggcccatgactatagctctggctggttgatggttctgtccttgtcacccttgacttttctttcttctggataaatgtccagagaaacaaatgtcctctcctgattcattggtttcccccaaagatgtggttccctatacacccctctccccaacagctacttcctctgggcccctgtactttgccagctcgttagtctaaaatcttgttttacaggctgggtgcggtggctcacgcctgtaacactagcactttgggagactggggcgggtggatcacctgaggtcaggagtttgagaccagcttggccaacatggtgaaaaacctcgtctctactaaaaacacaaaaattagccaggcgtggtggtgtgcacctgtaatcccagctactcgggaggctgaggcaggagaatggcttgaacctgggaggcggaggttgcggtgagccgagatcataccactgcactccagcctgggcgacaaagtaagactccatctcaaaaaaaaaaaaaaaaaaaaatcttgttttacaaatgatagccaacccatctagtgcccttcacactcctgggtgctgtttttcacagccatgtgttctgttaagcagattgcaggcagccctggtttgcgttagtaatttcttagtgaatgggtagtgtacaccaggtaaacctcattctcaccccatgagtgtagggcacacacaggctgggttctccaggagcctgtctgcagcctgtgcccacgaggacttgttcctagaagtacgtgaagggatactgtctgctttctcttcgggtcatgcatgcacagaggacatgccgcgccccagcccccagcgccttggcctgcagagggcagagctgctgtgtggcacagaactcaggacctatgagcctccttgggtggcccctcctgcctgctgtggcctctgcggccctggccttgacttcctttcctgtcacttgcgtgcctctgccactgggcctacctctgcccgagtggcaggagcttgcagctttgtatatacgggcagttggtgactcattcctcagcagcccctcagatagggaagtgaaacagccacacctgatagggcctgacctttgggtgacagcagaagtagctaagcagacatgaggcttgcagctaaggagggaagtcctctctcaagccagcctgtgaagacagcacctgcctgccctgaccctcctgtggcctccaggcctgtggctctggtaacagtttcttcctccctccccgccacccccttcttcttggtgacagctggaagtagcagtggtcacaactgagagagccaaacatttctacagcccccaggacattcctgtcaccctctacagcgacgctgatgaatgggaggtcagtgctggggcccctgggctgagttccattgagtttccaccagcaggacagaacagtcctccctacggcctatggtctggcagctggaacagacaggctgggctcaagtctgtggtcagggccctctgggcagaggcaatgaagaaaacatctgtctagcttctggcctgcaggaggccctagtctcctcccggcccaggcagagctgggctttggcctggtgcctgaggttgagtgtccttgtacttatctgggctgatgaaaccacagaggagctctgttcccaccacccttgtccacgtggttcctggcgtcagggctgaagagaacgcctcacttcccacggccgccgggctctgctgcatctcccctgcggatgggtgggcactggctgattcaccagacgctgagtgtgggcctcacaggggttccctgccaggcattttcaaacattcttagcctagaacatttccggctggcctgtcttccccgcccccaccccctccatttctcactgccccggagctttccactggcttggacaacccaagcatccgcctcaagcagacaggccgggagctccctgccagatgtcagttctcttgaaagccaaaccatgaagggaatagctcagagagacaaggggcacttgtttcctcaggcctggttctctcggctgctggctccatggctagcgctcgccagcttagctgcaggagggaacggaggttggcctgggcagggcaggtcagtgggttcctcagtctcctgacttaccgtacctggcctgccttggcgctgcatcctgcttcctccacactgacccctttttcttccctctgccagatatggaagagccgctctgacccagttctgcacattgacctgcggaggtgggcagacctcctgctggtggctcctcttgatgccaacactctggggaaggtggccagtggcatctgtgacaacttgcttgtgagtgatgtcctggtgccctcgtccgtccctgggcctcacacccagtttgctgagctgcagacatccttgtacaaggagacctgctgctgtggggccccggtctgcccagggagatcgtgctccgccattccccacatcgcccccagtgctctcaccttctctgtagcacatgggcacagccctggtcctgatgggtcagtgtgacctgccactgctccccaggagtgtccccctctcccctgcccttgcacccagccaggtgcccacaggaagacccttcttccttgctctttgtccctcctcgtgggctgcctgggtgtgctcttccactgtctctgcccagccccatcgcctcccgcttcagctctgccttctccgcagatctgggtatacacgtgggcaatgtaattgggggttcacttcttcatagatggctcatatacactttatcacccttgtagctttcctgtatattaggggaagcttagaggggaagaggggagaaagacggggcagtggcgagagccgatgggtggtagggagaaatggaagtccagctgtccaaagtgggcactgtcctaggcctaagatgcctccagggagctgttgcccttaaaggggagctgcctttgtttatatgatcgtcctgggaagatttgggtgtgatttctctcctccttctccctaattgccaccccccacctcatttattgagctttcgcctaccacgtactgtactggggtctgttctgagagcctcacaggacacagggagctcccaggctggaaggagaatgccaggcttgatcacccatgccgttgggaagggagtatcctctggtgaggggtacagtcctgaatgaccccagtcagtcctttctatggagtcaccaccttgcatagtgctgggcctgtggtagacatccaataaatacttactgcatgtatgcggtaactagcagttttacttttgcgagtagctgggagtttttcagagtttcatgtggtgaagaaggtggatgatgaagctgggacaggatgttttttggggtcacagattagtgttcttgtatacttgtcaatgggctcttaaggcactcctcaaagaatctgccagtgatttaagcatcatttgaataagagcacagggtgagcagaagaacaacttgtgtggccaggagcaggggtagggagtgcagagaagagagagcctgggtgcaatgtcatcaagaaggctttccctatagtcccagctacttgggaggctgaggtgggagggtcgcttaagcccaggagttctaggctgcggtgccccttgattgtgcctgtgaatagccagaatagccagtgcgctccagcctgggcaacatagcaagaccctgtctctagttaaaaaaaaaaaaagggaaaaggctaggcatggtgcctcatgcctataaccccagcactttgggaggctgaggcaggaaaattgcttgagcccaggagtttgagaccagcctgagcaacatggtgaaactccatctctacaaaacatataaaaaaaattagccaggtgtggtggtgcatgcctgtggtccccagctactcaggaggctgaggtgggaggatcgcttgagtccaggaggtcaaggctgcagtgagctgtgattgtgccactgtactccagcctgggctacagaggtgagactctgtctcaaaaaaacaaaaaggcttcccagcagcactggtgccacaactgacatggcagctgcagctagaacagttgagtttcttggctgctctcatcaaattgggtcagagttgtgtgtggccagcaccatctcaccaaatctccaggctccctgctggcgggtcagcagcagctggtgtgacaaagtactggcctctgggagctaagccccggcctgggccagctctgcaagggcgctttccttcttcctgcaagctctgcttccccttttccttctaagctgccatcacttcatgaaatccctgggcttccctcctccagagttggctgggaagtgaaacatgttcccaagaccagcccccagatcatttgcctcaaaggttttccctcgaagtcacaaatgtttcaaggaatctcaaattttacaaagtttgaagtgtgggcattggtggcctgtggctgtgtcctctctctgtagctgttttctccctacatccctgaaaggaagttgagcctgctcctccatccgcagacctccctttccagcgcccagggcatggggtgctgtgagggcagcatgctaggtgtgaccgtgctcctggcctccaggcccgtgtccctctgtcctctagcccactaaggccctggcccatttgtgctaaacaggcagtcggacctagaaagagcagacaatctctctgggtcaccagtctggctaggagctggtctcctgactgggatccaggccttctcccctgcccatgtgaattcccaggggcagagcctgaaatgttgaacacagcactggccaaagagatgtcaccgtgggaaccgaggctctcttctcctcctgcctgctttcgtgggttcagagtagctgaggcttgtctgagaggagttggagtgctggttttcaccctggttggtgtgctttgctttgagggcacttagaaagcccagcccagcccttgctcctgccctgcacacagcggagcgacttttctaggtatgctcttgatttctgcagaagcagcaggtggcatggagccaagaggaagtgtgactgaaactgtccactcatagcccggctgccgtattgagagggcttggtgggaaactaatgctggtggctgatgcaagcagccaggtcccagggctgtttgctgtcctgcttcctccctgtccctgggacttgggggaggtgctggtcctgtcctgtcggggcattgttctctggactccttcgctcttttcccagatgagcttcccttcaggggaggggtttccagcctgttaccctgaggagctcacagccctggaagaggtgtctggagtagtcagagcactgggagcttctctctcccccaggcggcccccagcccagggagcctgtgcctgtgggaagcccaggagtcactgccctggagcctgtgttttgtgcctggccctgcgctcagagctttgtagccattctcacctcagtcctcacagctgcccagggagggacctttctagagaggaagccaggccctggccttcagtcccatgtccaggttctcacagctagtaatacacacacagctagtgctctcacagctagagcacagtcaggatttgaactcagggctacgtaatttcaaagtccgtggcacaaaggactctgtgagctggatggctcctttcacaactgctcaggtctgtggcttggtgggacggcctggatttgggagatggtgaggctgtgcagtggaacattgcctgggtggtgcccattgtccgggtgtgggcgtggatgactgcttacctctcagggagcagctccctatctgtgaaatgggacagcaccttctttataaggtctcagtgagggttaatgagatcctatatatgagaaggttttggtaacggcagatgttttcattgccagactttagttggcctcggagagctgatgtcaagtagatgagccccacctgaggagcagcctggtcctttgctttctggtgcaaccaaaaaagcctgccttctgctccccagggttgcttttcccaggaggtgtgagcctacctggaggaggcttaggcacagggatacctgctggaggtctgagcgttggttgagcacctcctgtttgtaggatcctgtgccagagcctgtggggaggtggagagaggcgaggagacatagcccccacccctgagggatgagacagctccctgcaggcaggctgtgcccagtcatctcaagcctacagctgggctgctggctgcagggtctggagggcggtggggagggtggcagacagagtagcaagacccccacttccctggccttcttcacagacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtgggtgtcttgccaggcttatagcccagggctgtagaaggggctcagctttggggtcatatctcagttcagttcctggcctgttaatgaccttagcaaaccattctctgagcttagctttctcagctggaaaatgggaatcgtaattcctgcctccagattggtagggtaaaatggggtggaatgtgtaaagtacctggtagagtccctggcacgcagcccacacgcagttaaggatggctactggaacgagtcccagggtcttgccaggggtcttgggagagatctgatgtgtctggctcaggcaaagacagaccttgccctctcaggccttgggctctgggtggagcacttggagcaatgggcaggggtctgcagggctacaggcactgttggcctgtctggccacagcggaattttgctcccaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatttaggagactccattctttccctacaacccagctgtggtcccagagatcagggggtgttgccaggtgtggctggggaagggtctgggttcacaactcaccggcactctttagtccccgtataacatggtggttaaggataaagatctgaagccagacagcccctagttccaatcccagctctgccgcttactagcagtggcagtttggttcaggacttagccttcctgaccttcacttacctcagctatcttgttatcctaccctcagggagttgttgagaggattcagtgaaattttgtgtgcagaatacccatgccactgagtgcctggaacgtagtaaatgtcaaatcaatggaagttaaaactaggcatgcatatatgccagagagctttcctagcatttactgcaatgccctgtctcattttgggaaaaaggaaatcctggatgctaagttgacacatccctttatgcaagtgacaggtaagcagccaggagggttgaccctgccctgggtcccaggcctcttgcctgcttcttggtttcctctgttctcatcctttcagctttgctggacctgaggcaggggcctgggtgtctgtgcctccctaccccccagtacacatgaccaagggaagtagatccagagacaccatgcactctggcccagaaaccctctgctacccagcttttgacttaattgccatttggtgtggctgcagcggggagggcttgtctgcgtatttggagctgaggctgaggctggcttcctgccctctggcttccaggccaggtgtgagggacatcccatgtgggctctgagagcactgagagtagaggtgccttgaggggaccaggaagcctactggctggaatcagtgctccagcagcctccacagcctttatctcaacagcacttgacttcaccaggtgaccctttgggataaaattgccttagggtatgaaataaactataactaaaatggtagcatcaagaaccaacttctttggctggtttggggatggggcatggggagaacctgggtaactgaaacccggagacggtcccaaaagtccatttacagggtttccaaattccttcttgtccacattgcccttcctctccctcagcaacccactagtaaatggtgaggcttcccaattttatttttatttattttttgagacggagtcttgctctgtccccaaggctggagtgcagtggcgcgatcacagctcaagccattctccctcgtcagtctcctgagtagctgggattacgggtgcccgccaccacgcccagcttatttttgtattatttgtagagatgggttttgccatgttggccagactaatgttgaactcctgacctcaagtgatctgctggccatggcctcccaaagtgctgggattacaggcgtgagccaccgcgcccagccgcttcccaattttaacagaaactgatagcattttctgagtgttcatcgtgggcgaggatctatgccagggattttagggaaggcagtcacccagggagatcaaccacaaagtgcctgtgtgaaaaggccatgggagcagggaagttcacaggccactgtcccagagctctgaaaacagctgtggctgctcagcaggactgcgccttgttggctagaagggaacatatatccctgtggactcaggccagctggaggcccctgtccctgggggttcgtctctccatctcctacccacagcagtcctgcatccctgccgcccattttgaagcggggggtctggatgaatgggtctgggctgggcctaaagagcccagctgttccctgcaccagactggagctaagaggagcaggtgctgcatttagctggccccatctgccaaggaggtgctgagtggggagtgacaatcactgctttccccacgaggggtccaagcacttgaagttaccttcatcttggggagaaatgtttctcagagaagattctagcctccctgatgattttttatagaattctggaagtttcagagaatagaacatttgggtctgaaatgtgcactcttttgtggcagccatgagcccttcaaggctgctgtggatgctgctgggtgggaggcagaagccaccaaaccaaggcccagcttccaccctgggccgcctccagcccttcctgcaccccgctggtcaggtgccgctgctgcctccccactgcctcaggtcaggcccagactcctgggcagtacacacctggccctttgtgatctggctcctgcctacccttctagcactgccctttaccacatgccaaccctgaagggctccgtattctcttgccagactggacaaccttgaacttgtgaggcctcttgcctgtgcacatgctgctgcttttactgggataagactgactcccacacatgcctgtggatgtacctgggtgctacctcctttggaaagccttccctggccaactgcaacctccttgcccaggttgccatggtgcttcccactattattttttatttttatttttattttttgagatggagtctcattctttcgcccagactggagtgcagtggtgcggtctcagctcactgtaaactctgcctcccaggttcaagcaattctcctgcttcagcctcctgagaggctgggattacaggtgtgcaccaccatgcccagctttttttttctttttcttttttaaaatttttagacggtgtcttgctctgtcgcccaggctggagtgcagtggcatgatcttggctcactgcaagctccgcctccctggttcacgccattctcctgcctcagcctcctgagtagctgggactacaggcgcccgccaccacgcccggctaattttttttttgtatttttaatagagacggagtttcactgtgttagccaggatggtctcaatctcctgacctcgtgattcacctgcctcagcctcccaaagtgctgggattacaggcgtgagccatcgcacctggcctgattttttttttttttttttttgtatttttaatagagacggggtttcaccatgttggccaggctggtctcgaactcctgacctcatgatcttcctgcctcggcctcccaaagtgctggaattacaggagtgagccaccgtgcccggccaccactatttattacaacagaattgtaattgttagtttactttgtgtcctcctaacattgggttctcttggagagcaggagttgtcctgttccttacagaacccagtaagtcactccaagcttgtactgatcaaaaaagtggtgtgtgtgttggggctattggttcctgctcctttctgtgcaagagacaaaatttagcaaccacaaaagcaaagattgataaatttgactatagaaaaataggttcactgagcaacaacccaaagtcaaggtcaaaggacaacatgctggggaaattatctgcagctcataaacaaagggctgattctcctaatatatgaagaactcctatgcattgatgataaaaagaccaagggccgggcacaatagctcacacctgtaatcctagccctttgggaggccgaggtgggtagattgcctgagctcaaggagttgagacccacctggcctacctggtgaaaccctgtctctactaaaatacaaaaaattagccagacatggtggtgcatgcctgtagtcccagctacttgggtggctcaggcaggagaattgcttgaacctgcgaggcgggggttgcagtaagctgagatcatgccactgaactccagcctgggtgactgagcaagattccatctcaataaaaaaaaaaaaaaaaaaaaagaaagaaaaagaaaaaggaaaaaaagaccaagaacatgtattaaaaagtgagcagaagatacgaagaattcacattaaaaacaaaaaaaaaaacaaaaccaaaaacccagtcacacaaagggcccttaaacagctactcagccacattcatgaggagagtggtgcaaatcaagctagacctaaaacttttgcctgttagactggtgggggtgtggggaattggtgccctcatgcattgctggtaggagcgtaaattgatggcaacttcactggagaacaatctcggagtatctatcaaaactacgtatgcaccttaccctttgacccagcaattctacttctagggatttgtcccacagatacactcacttctatgacattatgtctaaacagatttattgcaggcttgtatatggtactgaaagaccaggccaggcacagtggctcacgcctgtaatcccagcattttgggaggccaaggcgggcagattggctgagctcaggagtttgagaccagcctggcaacatggcgaaaccccgtctctactaaaaatacaaagtcaggtgtgatggtgcatgcctgtaatcccagctactcaggaggctgaggcaggagaatcgcttcaacctgggaggtggaggttgcagtgagccaagattgcaccactgcacttcaacctaggtgacagagaaagactctgtctcaaaaaaaaaaaaaaaaaattacatatgcaccttaccctttgacctagcaattctgcttctagggatttgtcccacagatacactcagttgtatgacattatgtctgaacaggagatttattgcagcctcgcatatggtgctaaaagactggaaacaccctcactatctaacagccaggagattggataaataaattagtgtgttccttcatacactggaactctacacaaccataaaacaaagtgttgaggaagctgatttgggaagacttctgaggtacattgttaaacagaaaaagcaaggtgcagaagaatgtcacatgcatgcttgtgcagaaaaaatgggggtggggaaagaaaaggaggatatattcttattggcttgtgtgtgcatcaaatgcctttaaaaagataaacagagaaaaacattgtctattgtttttctcttggcaggggaactaactgagtggttgagaaacaaagataggaggcaggccaggactccgtctcaaaaaaaaaaaaaaaaaagataggaggtgacttcatttttaattgttgggccagatgaatatactatctaccacaaaatcaataaatacattttaaaaagagttccttgtggtcaggcacagtggctcacacctgtaatcccaacactttgggaggccaaggcagagggattagtttaagaccagaagtttgagacaggcctaggcaacacagtgagactccatctctaccaaaagaaacacaactaactggacatggtggcacacgcctgtattcccagctacttaggaggctgaggtgggaggattgcttgagcccaggagtccaaggctgcagtgagctatggtcatgccagtgcactccggcctgggtgaggagtgagactctgtctctaaaaaatttaataataataaataaaaatataaaaagatttttctgctctttttgtttgttttttaagacagggcctcactctgtcatccaggctggagtgtagtggcacaatcacagctcactgcagacttgactttctggggctcaagtgatcctcccatcttagactcccgagtaactgggactacaggcacccgccaccatggcccggctaatttttgtatttttggtagatacggggtttcaccatgttggccaggctagtcttgaactcctggccttaagtgatccacctgcctcagcctcccaaagtgctgggattacaggtgtgagcctggcctctttctgttctttatctggaagttcttaaaaatgatggcagggagttactgcaaacaaacacacagacttggcagaggcatctggaaattttctttttgtttttgagactgggtttcactccgttacctgggctgactgcagtgcagcagcacaatcacagctcactgtagccttgaactccagggctcagttgatcctcccaccttagcctccccagtagctgagactacaggcacatgacaccatgcctggctaattttttattttttgcagagatggggttttaccatgttgcccaggttggtcatgaactcctggactcaagtgatgctcctgccttggcctcccaaagtgctgtaattacaggcatgagccacggtgcctggcctgaagatattcatcaaggcctttggagtagaaatgggtctgcttttcttgtcacaagctaacagaggaaaatgaattttgagtatccttgtgtgcttttaataaacctttgagatccctgatctcaaggaacttatgttcttatgggagaaagattcacagtgatcaaataacagcaaacaatgaaagtgagactgtgtggcatggactctacttcagaattgagcagtcaggatgggtcccctggacggaacagaacttgggctggggcttacaggaggaccaaggatacaaagggtgaagacatgctgccatgtgcttgatgtaggacacccagggaggaactccggctccacgtgctggggaggttgggagctgttcagtaggggaggcacatggtgagtgtggcgtgcggtcaagatcagcggggcggtatgtgcaggacagattgggtctggattgagaagctggagtctaggaggaagccaggatgctgagaaggggaatctaggttgtgctgaaggccttgaccacacccctgattctggaaaaggggtgacaaaagtaacaatgtgaagaaaaatcaacaccattaaaaactgtaaaaaccacggtcttttccaaaggtggtgtgtactaaaaacaaaacaaaacacaatatccaacaaacaaacaaacaaaaaacaacccactgtccttgtggccagtggagggagggagactaaatgacactgtatgtgtgtgttggtgcaagatttatagcaatcttcagccccacccatgaaaaataattttgctttgcttattatagtatagtttttttctctctcctgacctcacagtattgttcaatctgtctttgtggccaggcgcagtggctcatgcctgtaatcccagcactttgggaggccaaggtgggcagatcacttaaggtcaggagttcaagaccagcctggccaacatggtgaaaccctgtctctactaaaaatacaaaattagccaggtgtggtggtgcatgcctgtaatcccagctactcaggaggctgaggcaggagaattgcttgaaccggggaggaagaggttgcagtgagctgagatcgtaccactgcactccggcctgggcagtagaatgagactccatctcaaaaaacaaaacaaaacaaaaacaatctgttctgtggttcctgggcactttgtggtgtgggattagaaaaacagattggtggtggctcacgcctgtaatcccagcactttgggagaccaaggcgggtggatcacaaggtcaggagtttgagaccagcctggccaacatggcaaaaccctgtctctacttaaaaaatacgaaaattagctgggtggtggcaggcgcctgtaatcccagctactcgggaggctgaggcaggagaatcacttgaacctgggaggcagaggttacagtgaaccgagatcgtgccattgcactccaacctggatgacaagagcaagactccgtctcaaacaaaaaaaaaaaaagaaaaacagattgagatacagaactgggaagatgggaacaaatggaggagtgaaggaatctttttgtttttttttttttgagccagagtctcgctctgtcgcccaggctggagtgcaggggcgcgatctcggctcactgcaagctccgcctcccgggttcacaccattctcctgtctcagcctcctaagtagctgggactacaggcacccaccaccacgcccagctaattttttgtatttttagtagagatggcatttcaccgtgttaaccaggatggtctcgatttcctgaccttgtgatctgcccacctcagcctctcaaagtgctgggattacaggcgtgagccaccgcgcctggccaaggttttttttttttttttttgagatggaatcttgctctgtcgccaggctggagtgcagtggcgcaatctcagctcactgcagcaattgtgattgaggttctttttaaagccctttgcaatgtgtgattctctgagtgcagctgagcaggactgaactgtgtggagccctagataagacttgggttatgggtacgtgttacatgttctccatattgccaagtgtttctttaatctcatttcaccctcctcacataacagcttcacgatggagtcaattagcatatgtagctgtttcatagacaagaaactgagggccgcacagccagtgcagtgtgctagggttttctctttctgccctacagctacctgcaaacaggctcctgcacaggacttctacccttatttgcatttacctccttggggtcagttgaaacaccccttccaccatacatcagcatccccagatgcctgccctttcagtcccaactggacagctccttcattacctttttctgctcatggcttccttccttcatgtattgtggtttctagggcaggatgaaaatcctaagtgtcacgcaactgcctctgagcaaagaaatcaaccccaataactgacaagttgtttacactgagagcttcctggtggaaccaaatattctacaatatttaagccaggtttggtaccccttgcggcaaggcaatgggaatgatcaggccagaagaactaccagttgtctcatagcaaaggaatgtggggagtgggtgggtgtgaggacaagaggcagatatgtgagcttcagggcttttggaggacatgcagctaatccaggtggaatctgggagcatgtgtcgttcccttgctgcaatgggctcatttcatggtggctttatctgctgagattacatggtgatgctttgcctgctagcctagacagcaggtccttagggactggaggcccagcagactccctttcaggcctctggattcctggaagaggaaggagtgttcaaaggtgaattaaaaggtgccttccatctgtgtaggcaaaacaatgttaccagccatagcgatggacttggaagcagccaacatgagttgaacatgaacacatggatgctgaagatcctttctttctctctttaaattttcttttttttttgagatggagtctcgctctgtcgcccaggctggagtgcagtggcgctatcttggctcactgctagctccgccttctgggttcatgccattctcctgcctcagcctcccgaagtagctggactacagacaccggccgccacgcctggctaatttttgttgtatttttagtagagacggggtttcaccgtgttagccaggatggtctcgatctcctgacctcgtgatccacccgcctcggcctcccaaagtgctgggattacaggtgtgagccactgcacccggccctctctttaaaattaaaaaaaagaaagttttttaactttaactaggtcctgaccagacataaaatttttttaattaaaaaatttttttggccaggtgtggtggctcacacctataatcccagtactttgggaggccaaggcagatgaatcacaaggtcaggcgttcaagacccacctggccaagacggcgaaaccccgtctctactaaaaataaaaaattagctgggcgtggtggcgagtgcctgtaatcccagctgctcaggaggctgaggcagagaattgcttgaacccgggaggcagaggttgcagtgagccgagatcgtgccactgcactctagcctgggcgacagagtgagactccatctcaaaaaaaaaagtaaataacatttttttaagagacagggtcttactctttcatccaggttggactgcagtggtgcgatcatggctcacatacagcctcgacttccctggactcaggtgttcctcgcacctcagccaccagaggagtagccaggaccacaggtgagagccaccacacccaagcaatcttcctgcctcagcctctcaaattgctgggattaaaggtgtaagccaccgctcctggccctgaagatttcctcctctcagaagagaccgtggcctggccctggcttgggagctgatatgttacctggaacttctggaaattgctctcctggcaggggagaagttgaattctggtgtgccatgcttgggggaagctggcatgatggagggaagagagagaaggctgtggaagggaactcaggtttatctggctcctggcctgtgccagaccctgcatttaagcctcctaaacatccttccagatgggcattgttattcccatttaagaaataagaggctgggcggctgggcgcggtggctcatgcctgtaatcccagcactttgggaggccaaggcaggcggatcacgaggtcaggagatcgagaccatcctggtgaacacggtgaaaccccgtctctactaaaaatacaaaagattagctgggcatggtggcaggcacctgtagtcccagctaatcgggaggctgaggcagaagaatggtgtgaacccaggaggtggagcttgaagtgagtggagatcctgccaccccactccagcttgggtgacagagcgagactccatctcaaaaaaaaaaaaaaaaaaaaaaaaagcggctggacacagtgactcatgcctgtaatcccagcactttgggaggccgaggtgggtggatcacgaggtcaggagttcgagaccagcctgaccaacatggtgaaaccccgtctctactaaaaatacaaaaattagccaggtgtggtggcatgcacctgtaatcccagctactcaggaggctgaggccggagaatcgcttgaacccaggaggcggaggttgcagtgagcagagattgcaccactgcactccagcctggatgacagagcgagactctgtctcaaaaaaaaaaaaataaaaaaagacataacctgtgctaggtgtggtggtgtgcacgggcaatcctggctactcagaggctgaggcaggaaaatcgctttagcccaggagtttgagtctacagtgtgccatgactgagcctgtgaatagccactgactccagcctaggcaacgtagggagaccctatctctaaaaaatgataataataagaggaacctgaggcccagaaagaaggatataactgaaattgacccaatagttccatagacagcttttcctgataaacagaaattgacatatcttgtcttaaagctggaaactcaccagattcagacaatgagataccaggtctctcaaaaagtatcaaagaatctcatacacagtttttcctgataaacagaaatggacacatctggtcttaaagcttgaaactcaccagattcagacagtgagataccaggcctctcaaaaagtaggaaagaactgaaactcacagagcatagcatccagacaatgagacccaggcccctcattatcatgattgcttccttacccctcaggagttcctgttttcccttacattgttaagtttcttccctgctgtacaaacccctaattttagccagggagatggatttgagactgagctcccatctccttggccacagcactcaattaaagccttcttccttggcaatcctgtgtctcagtcattggctttttgtgtgaccaacagcaggacctagaccaaacccctggtgtgtcagcaacctaaccacaaaccaagcatggcctcttacaggggaaagtagaaatagtggtgctgctaacacaggctggacctgagctaggaatagaaagaaacacaggctgactgtattttgtctaaactgggcacttctgagagtgaaaaagggcaattaacatgccaggaaaataggcatcaactggactgttctgggcaaaccagcatgtatggtcactactcacagagcaccagaaggaagccatgctctgtgaagcaatggccaccatttacaatttaattctcacagcaaccctaaggtggatattgttgtcccctggccatttctcctgagagcaagaatttgacaaatgaggacgctgaggttcaaataagttatttaactttctttttttttgagacggagtcttgctctgttgcccaggctgggggtgcagtcttggcttactgcagcctccacctcacgggttcaagtgattctcctgcctcagcctcctgagtagctgggactacaggtgcgcatcaccatgcccagctaattttttatagttttagtagagacggggtttcaccatgttggccaggctggtctcgaactcctgacctccggtgatccacctgcattggcctcccaaagtgctgggattacaggcgtgagccactgcgcctgaccggttacttaactttctcaaggtcccacagctagtaagtgaggaagctctggcaggctccaagcccttgctctttctgtgagtcatgttgcctccaaggcccagggccattggaggaagaccagaggaggaggccagctggagggaacaaagcttgggtcttggagggtgacaggccagtcaccagacaatccctgaagtctccatatggcctctcccagggctggcttgcaagagaaggtgagtgtgtagtgggggtttagggcggggtagaggccccccaggcttccacaaggatcgtcctgggcttccaggaaggcgtgaccaaggcagaggcttgcctgggaattttctaggaaagaagtcatgccctgagttgccccatttttatgattggagaacaggaacactgatacatcgaatggcaggtatcctggagccaggactgtcccctctggtctatagattctgccatggccctggctcagtctctctggaactcagagaatcgtggtggtctgggatgcaggaatactccagattagcagcagaaggtgtgcaagcatatgcatgcatgcagaatttgtaagcctcaggggttagttcttgctccattcacaagccagcctgaccctccagagtggaccagtggccacagcatagaaaatggagggcacaggccaaagctcagatggcctttggaatcaccttgacttatgacatcacaggcagatgggtaggaaataggccaccagtcatccagtcaggtggatcacagcacctgctcgcacctgggcctgggccagtgctggctctcggggacaagtctgcctgcggtacttcacacaagcacaatggcctgaggcctctgcaagccaaagttgcataagcaaggactgatcatatgtcttcattcatttattaatttttttaattagtaaggttatttgaagtagttttaagttcacagcaaaactgagtggaaagtacagggagtttccatatcccatatcccactgtccccacacatctacaacctcctttcattcattcattttttttctttttttgagatggggtatcactctgtcacccaggctggagtgcagtggtgtgattttggctcactgcaacctccgcctcccaggctcaagtgatcctcccacccgagcctcccccgtagctgggaccacaggtgcgtcccaccatgcccagctaatttttttgaatttttggtagagacagggttttgccatgttgccctgtctggtctcgaactcctgagttcagacgatccaacttggccttccaaagtgctgggattacaggcatgagccaccatgcttggcctgtgagaaaacatttcaagtggtcagttttcaaggcatgataaatctaagtactggcagccagcctgaaaatgtaacaaaccacagggctcatgcatctagaaggtcacaataaacaaacagaatgtagaagaggggtcagctcataaaagggaaaaaagtttcattattgggaaatctaaacttaagtggggaaggggatggggtataatcttataagggggataagaaaacgtaggcaatatccgggaagattgtaaccccatagtactcaaccaatgaggaactgggggagggacttctgtgctaagggataaattacctgctgtgactgtcccaggcgtgcctgcctgcaagacacctgatcttgcaagaccactattagaagtctcactttaactgttcttcatgcctctaagtccattctttgggtttggacaggtgagcatgtttctcacaacctgggggcctgtctgggatctctgtgcctgcatggagtgggactctggccaagaggggagacatgtcctactcaatttaggtggcctgctctgtcgggcatcccggctccccacagaagccatagacaaacccaagacttattcaggagacagttgagatgacacagggagaaaagcgggcatcgtggcaaccaggcaaccttgtgtgtgagccaaggtggaaaattggactgtaagtactgccttggtggttgggcattttcggcggttgagtgtgtgtgtgactgagacgtatcttagatacaaagtgagtgcggagtcctaatccgtggttctgttctcccgagagggaaatggctggacacagatgaagcgattctcggggtgtgcaagaaacctccagtaaaggggggttgagtacacagggaaactcagacacagagactgactgaaaatgggaaacaggaattctaggcctaggggacaaaggaaagagggagccaaagagactcctctgacattcccccagatagtcctttggggagaatgtggcaggtttggagggacaaccctcgaaccagggacaaggaaaagcaaaagataataaagcattgctgttttatctggcccaaagaccccatttgtaagccttcagggttttggcccaagtttggctcagatgaggattgggtgtgccaagttttaattctctatgtgaatgataaaaccccaccctcacaagaagagatgttatgctctctgctggatcaaggaattagcccccatgtttcccttcaaagaagaagaaaaagagcctagtaaaaagccctcacccagggaaaagccctgggaccccctgtcatacatgccccctccatatgtctcacaaaataggggacaggaagatcaaggggcagcaggagggttagaggaagaaagacctggagaccatggggaagctgaaccaactgctcctttaaatccttatccaaatttgaaaaaagaattagaacagtgtaagagggatattgaaaacttccctatccctttcacacagcaggcatctagcatgttcccttttagggaagttctcgtgggacagggagagattggctttgtaaatgctcctcttacaagtactaatgttaggaatttcaagaaggaaatgaaaccactcctagaagatcccctcggtttagcagaccaactggacaaattcataggacccagcttttacacctgggctgaaatgatgtctatcttaaatatcctgttcataggagaagaaaagggaatgattaggagagtggccatgactatctggaagaggcaacaccctcccaggcaagaagtcttgacagtcgaacaaaaaacttccaaatgtcaatcccaaatgggataataatgatcccagggactaggcccaaatgcaggacctcagagaactgatagttaaaggggtcaaggagcccactcctaggacacaaaatgtctcaaaggcattcgagattcaacaagaaaaagaaaactccctctgcattcctgcagaggccagagatcagatggaaaaaaaaaaactccagattaagttcagagaacccagtaaggcaaagccttttaaaagttaactttgtaactaagagctggccttgtgggccaggaagtgcagctgcaggttggggggtggcaggtgtcgcagagcaggagcagacagctgaaataaaggtagacagtgtgagagagctagtgtgagtaaacccctgataaaagaactaatgtctatagtacacaaagggagtcactggggaccccaggctctgtgtaatgcaatacttagtgaggcagccttgttggctggggtggatgccaggattcttggtcttgcagctggggagattggggttgcacaggtggagtgggtttggagtaggaatttcgtggccgtgggagggaccagctctgcattgaagggggggtcctgagccggttgccaagttgcaataaaaatgtcagagttttcataaatgggctagtgaggagggggctagtgaggaggggatgtcttatcctcctagggcccaatgatttggttgtgaccagatgtgctatctgtttagagcagagtttctatcagcctttacctaattgtgtcacttatctgggagggagagtatctgtgtctgttccaggtatcttgcagcttcaggcacccacccccacaccccagtccacttttagcttccctatcttagtgtgcctaaagggaaaggaatgtgcttattaaggcccactgtttttactggggcccattgtatgagagtgaagtttggtgattacccaggagacttcccccgaatctcgatcccccccaacccccctccttctgtgcttgagctctttatctgtgatttacaggctgagctttcaggcgccatttgttagaagagaagtaatttctttgaactgcatgaggttagaaagggagctatttctgagctgctttttaatagaaggaaagttttctgccagggactcactttaccttgtctacctaaatttctttctgcctcctataacattaggaattatgggtgtatagggacttataccctcactaaacaagtatgtggaaattgtgtaacttgtcaaaggataaaccaaaaggtaattagaaaacaggccacaggaggaagacctcctggactaagaccatttcaaagcattcaagtatattttacaaaaatgctcaaagtagaaagacgaaagtatttactggtgatcgtagatcacctttccagctgggtggaagccttttgcctcccaacagccaccaccaggtatatggtcaaaattatattagaacagattgcacctagctttggcctggtgaaaaatattgattcagacaatgagagccactttacctcaaaggtgttaaggggaattatggaaggtttacaaattagatgggattatcacaccccttggcatcccccttcctctagaaaggtagaaagaatgaatcaaactctcaaaaagcatttcaccaaactaatcttagaaactaaaatgcttggaccaaatgtctcccaatagcactctgcaggattaggacagctccaataaaagacttgggattgttcccttacaagttattatatgggctcctgtatttaggcagagctacagatctccctactatggaaaccaaggatcaattcttaagaaattatatactggccatatcctccaccctgtcatcccttaggttaaaaagacttctaactcaaactccacctcttaagtttgtggttcaccacttccagcctggtgacttcatgctgattaagacttggaaataagacaagctccacccaagctgggaaggtccctatcaagtgctcctgaccactgagatggccctgcaaacagctgaatggaggtggactcactatattcgagtcaagggactggtaaaagagatcccggaagggagggaaaaagatcagtggaaagtgcccgagtctaactttaactcttaactttaaggaacccttaaagtgaactctaagaaaaatctaaaaagaaaacatgagctggccccatttctggaaattaacatggctgggatgggctaatatacaaagagcagaaggtcaaaatggaaactggcagcagactcttctctacccagtcaggttggtgattaatgtgaccaagacagtagcaccccagactataagatttaatgcctgccaggttttaccttgtggaaatttaaaaaatcagagacagatctcacaggcagataaatatctttgccctaaaccaaatacaggttacagtagggcatcaccctaccccagctgggataatatatggtggactacccaatttcagggctggacagtaaacatggggtgggtaactccaagctggagacccctaaagaataaactacatctgtccaagagctccctgccaaataactgccagaatttttttctttttttttgagacagagtctccctttgtcgcccaggctggagtgcagtggctgatctcggctcactgcaagctctgcccctcaggttcatgccattctcctgcctcagcctcctgagtagctgggactacaggcgtctgccaccatgcccggctaattttttgtattttttagtagagatggggtttcaccgtgttagccaggatgggctagatctcctgaactcatgatccgcccgcctcagcctcccaaagtgctgggattacaggtgtgagctgctgtgcccggccccaaagcacactctcttgacactgcatcctctcgctcagcctggggaggatggagtggtgtagcagtcgagggctttgcataaccagatcaacaaggatgcctcatttacaggtccactcagtccatctttactgtatgtatatgtgctctgtgctaggcactgtgcccagtgctgcggacacagtggggaaaagaatccacatgctccctgccctcagggtcctttctgagatagctgcccacaggtaaggaagagtagacaccctgataagcaccatggaggaaaagtacggggtactgagaggggataaccttggagcctaatttaggcaagggcaggggttttcaggaaagacttcctggaggaggtaagtggaagcaagatgagtgaccaggagttcgccaggggaagatgaaccagggcatttcagacccaggctattacatgtgcaaatgtgggaaggggaagagctggctggggcacataaaagttttgtgagtggggcagagtgcagtgggtgaaggagggcagattgagtaggggcccagtgaggcagggactgggtggggatcatggagaggctctgggaagccaaggtggtacttgggaaacaagaactccctctttttcccatcaggtaaatgataaccacacactgcatgtagcctccttagctaatagcttgggctgcattaatagtggtatagcatgcaggtcaaaggaggtgatttttcctccttctggctcagactgcatctgaaggattgtggtccttttggggcccctgctgcccaacatctgcaggagaagagccagcatgctgaaggctttgcaaaagccaggctggatgagcagggaagagcagcctcaggggacaagagtctatcctagaactctgagaaatgacctggaggcaaagttcagccccagagaaggaaaatgtcctggcacctagagcttatggaaatggagggagtgactgagggagtgagcctcctgctctggggaagtttgaggagacactggaggactagaggtgtgaagagggcccctgcttagcttcatgggtggcctagaatcagtccttgccattgctcgagcatctactgtgtgctccctcccttccaccttcgtgctggagactcaccacacatgtcccccaaacacaggattttggacctcacaaatggtggggctgacccaggctagtctggggcggactcaggtcttttttctgctcagactgctttgggggaaaccagggattgggaatagtggtggtctcaggcccatgggctggctgctgctagtcaccctctgaagttatctcccggggcctgcctttcagagtcctgagtgtgttctggtgctctgaaccctccaactgtcagccataccgtcctcacctattcgaaacttgagaagtcaacacatccctcttccacttccccttcaactgtgtgcagactgggacttcccagtcgtctctgggtgttccccaaacagaaggctgccctggctctcataccccagacctctcactcttggctgcctctgtctctgatgttatgttagtccccaggccctcaccttctttcttggtaatggctccaactcattcccatggctctttcccactgccatcaccgggcctccagagctggcttccctggaggtcctgccacctaccttccactccccgcttggcctgtctactctctgctgagttctgagaccagggccagttacagttttttaaaaaaattgaagtataacacatatggtaaagtgcacacatcttaagtgtacagcgtgatggatttttttttctttttgagacagggtctgtctctgtcacccaggctggagtgtagtggtgcaatcactgctcgctgcaacccagccttgacctcctgggctcaggtgatcgtcccatctcagcctcctgagtagctaggatacaagattgtgccgccatgcccagttaatttttgtagagatggggttttgtcatgttacctgggctggtctcgaacttctgggctcaagagatctgcccacctcagcctcccaaagtgctggagttacaggtgagagccaccacacctggctggcctgcatgatggatttttagaggtgcacacacctgtgaaccaccacccagatcaagctcgagaactttttcaggcccattctcccaaaaagctctgtcctctaggctcccacagctttactgtgggatacttggcagataattgccttacattccaactagctagagggccgggacccctcctgtttgctgtttttgtttcaccctgccaacctagcatggtgcagtgctcgtaggaagtgcccctgaggcccattagatggaggggtttagagttcattcacagtgttccagaatctgtgcccagttgtccctcagaaatgtgggagaggtgacagagatggaggatgaggtcaccagagcgcacaggatccctgagcacccagtgtgctggttctgctcaggtgacctgccaccccagggatgatatgcacagggctggaggcagacattctcagcagagggctcaggagtgtggaactccttgtatggacgccctgcccagtggacacaggctgcagcatagctctgcccaaactcccatcccagacccagagacacctgtcttgagtgcccaccatggcaggctcagagatctgaaggaatagggccaggctgtgcttaggggagcctttgaagtcaggcgcctggtgcagaacgctctgggagaggtcagaatgcatagcttctcacctggagggtaagacctccttggctggcttccccctttccctggaacctgtcccttccctctccttggtgcagggcccagctagggagatgataccaccaaaggaacagagtctcagcctagacttgagcagcaagatggggatggcaggtggctggaggtgggtgggaaagcagggcagcatgggtgtatggtgcataaagtccaacagctgtcttggagagctaggtctccaggctgccagaagactagaagatgcttcctctgctctaaggcacaaccctccaaatctttgagggggagagaaagagcccttttctggggtccagatcccagttgtcactgggagggtttcccttgggtggactcttgagtcctggagaccatattgttcctgtctcctctttgactgtagtaaatacgggtctcacaccaggcttggggctgctaggtaaatctttgtttttacatcacatctgctatttcggtgatcgatgcaggccttggatcccagacaccaacatatgtcttcttaaccacttgcttaaggcagcatggtggcaaagtcttattatcagagatggtctgtccctccatgattggtagaggcatggccttgagcatatgaggtcaaagagggagggaaagagaaggaagagaaatgaacatcaatggtcaatgcaggtggtaagtaccttagatgaactgaagtaccttagttcaacttctgaaaggggaagcctgaaaagttaacatttctggagtgtctattctttgacaagcgcttgcttgctcttgtgtgatccacaggatgtcttactatcttcattttactgagaaggaaattgatgctcaggggagttatccaatcagaataaaaaagcaggcagatatggagctggattttgagccaggtgtatccaactccaaggctggctccttctcctccatggaatgtactctctaggggccataagcatgctttcttggtgagatgtcctgtcccacaccaaggagcccctctccagagactttttttgagatggggtctggctatgttgcccaggcttgtcttgaactcctggcctcaagtgatcctcccaccttagcctcctgagtagctgtgattataagcacgaaccgtcatgctcagcttctctaaagatttgagggaagcttccaacatgtaagagagaggccaaaacagcagaacaaatggaactcagaggaaacaaagatgatgcaaagagcagaagaaaatgttgaagaaactgcaattgatcatctcagagagattggaagatatattgcatccacaaaacaggaactggatgccatagaagggggagcaatcagagaacaagaatttaaaatgtgagagagtggtagaaagataaaatcaaggaaatctttcagaaagttacacagaaagactcagagatgaacaacaggatacaaaaaataagaaaattagatcaatctgagattcaacatctgactgattcaacttcctgaaaaagaggacagagataataggtgataaagagttaaaaacacaataaacgttttcggaaacgacagaagtgcttaattgagagtctagtgagtgcctagcaaaatgaatgtatataaaacaaagcaaaatctctcaccaaggctcatcattgtgaaatcttagaacactaggattaaagagaagattttaggaagaggacatttggaatgctgtcaggaggagctctgcagacaaaacaaccataactgatgaaaaataattttaaaaacaaccattcacattctctggaatttttcttaaggccatatggcagataaacatttattggccagatgcagtggctcatacctgtaatcccagcaatttgggaggccaaggtgggaggatcacttgagtccagcagtttaagaccaacctggacaacaaagtgagaccccatctcaaaaaaaaaaaattggccagagacggtggcacatacctgtggtcccagctacacgggaggctgaggcaggaggattgcttgagcccaggaggtcgaggctggagtaagccatattcgtgccactacactccagcctgcgcaacagagcaaaggggcttgaatttaatttgatcagactgtggagaaatttatgcccaagtgattataaaacaatagaggaaccagtcagcagttagtagaggctaacagttgtgtgatactaatatacaggttaacagaaagctcaagaacagacacaaagaaagccatcttaaagccattgtcattccagggtgacagtacacacgcacaaggctgtggcttcttaggcatgacgtcagaaactgcacacagccgggaaataaacttccctaaaatagtccagccaggccactaaataaataagcaaacaacaaaaacaagaagctgtgtgcatgtggcagaggggtagtggttagtatccagagttgctacaatttattatctgaaacattaatatattttattttattatttttttgagacaaagtctctgttgcccaggctggggtgcagtagtatgatctcagctcactgcagctcccacctcctggattcaagcaattctcctgcctcagcctcccaagtagctggaattacaggtggtgccaccaggcccagctaatttttgtatttttagcagagatgaggtttcaccatgttggccagtctggtcttgaattcctgacctcaggtgatccacccaccttgaccttccaaagtgcggggattacaggcgcaagccaccgtgcctggcgaatgttaatatattttatgctataaatatatattattttagcataatatataactatgtatatactatatataagtatattataaattataatttttaacaaaaaattatgggacatgcatagaaacagtaacatgtgacccatacacaagaaaaaagtaggcaacagagctgcctttgagagggtccaaatgtcagacttagcaggcaaagacttccaagcagctattaaacaactaaaggaaaccacacttaaagaagtaaaggaggccaggtgtggtggctcacacctgtaatccctgcactttgggaggccgaggcgggcagatctcaaggtcaagagatcgagactatcctggccaacatggtgaaaccctgcctctactaaaaatacaaaggttagctgggcatggtggtgtgtgcctgtagtcccagctatttgggaggctgagacaggagaattgcttgaacccaggaggcagaggttgcagtgagtcaagatcacaccactgcactccagcctggcgacagagcaagactgtctcaaaaaaaaaaaaaaaaaaagaagtaaaggaaggaggggcatggtggctcatgtctgtaatcccaacactttgggaggctgagctgagaggattgcctgaggccaggagtcaagaccagcctgggcaacatagagaggcctcatctctacagaaaattttaaaattggctgggcacggtggctcatgcctgtaatcccagcactttgggaggctgaggtgggcggatcacgaggtcaggagattgggaccatcctggctaacacggtgaaaccccatctctactaaaaaatacaaaaaattagctgggcatggtggtgggtgcctgtagtcccagctacttgggaggctgaggcaggagaatggcatgaacctgggaggcggggcttgcagtgatccgagatcgtgccactgcactctagcctgggcaacagagcaagactccgtctcaaaaaaaaaaaaaaatttaaaattatccagatgtggtggcacaggcctgtagtctcagctacttgggaggctgaggcaagaggagtgcttgagcccaggattttgaagctgctatgagccatgatctcacctttgcacttcaccctgggtgacagagtaagacactgtttggaaaaaaaaaaaaagctaggcttggtggctcactcctgtaatcctggcactttggtaggctgaggtgggcagagtgcttgaggccaggagtttaagaccagcttgcctaacatggcaaaaacctatctctactaaaaatataaaaattatgtgtgcacacagtggctcatgcctgtaatcccagcactttgggataccaaggcaggcagatcatttaaggtcagaagttcgagaccagcctggcaaacatggtgaaaccccatttctactaaaataaaataaaaaaaattagccaggcatggtggtgcatgcctgtaatcttagctacttgagaggccgagacacaacaatcacttgaacctgggagatggaggctgcagtgagctgagatcatgccactgcactccaacctgagtgacagagtgagactctgtctaaaaaaaaagacaaagaagtaaagtataatgacagtgtctcatcaaatatattgagcatatcaacaaagaaatagaaattgtataagaaaaagtaaaatggaaactccaaagttggaaattacaataactgaaatgaaaaatccagtagaggagttcagtaatcaatttgaactggcaaaagcaagaatcagtgaacttaaagatagattgatagagaatatgcaacctgaagaatgaggagaaaaaggaatgaagaaaaatgaacaaagccttagagaaatgtgggctatcatgaagtacaccaaaatagatataataggagtatcagaaagaggagaaaaagaaaagaagacaacatatatttgaagatgcaatggctgaaaatttctcaaaaatgatgaaaaccactcagttacacatctaagaatcttaaggaactccaagtagtagagagccacactcagatacactctattaaaactctggaaagctaaggacaaagagaatacactgaaaacaagagaaaaatgatttgtcatgtccaagggaatcccaataacaataacagccaccttctcatcagaaaaaatggagggaagaaggcagtgggattacacattcaaactgctgaaaataacctgtcaaccaacagtcttttccagcaaaactagtgttatgggatatttggggtttcgattttatggccagaaacctgtggctggtggcacctttgctcaagttctcgtcctgtgtccaggaagaatgaggaatgcagacaagtgaagggtgaacaagtcaaagaggagctttattaagtgtcagaacagctcaaaggagacccacagtgggtagctcctctctgtaggcaggtcgtcctgttgagtgttcaactctcagcagagaggaggccctggagagggtggttcccctctgcaggcaggtcactctgatgtctgcttctctcagcagagaggaggccctggagaaggtagcttgtctctgcagctggtcatcccattgtctattcagctctggctgagcctggggcttttatgggcctcagaggggaggaagtgtgcaatgattggtccatgggcagccatggtggcctggaaaaggcaccagttcttactccagctgtgggattggcagcctggtccccagccttcaggccttccctgacctgaaggtggggcctcaccggggacctgttttcttctgcccaggaattggtccacttcctgctgctgttcatggtgtcggggcttggtcccaacattgctccaagattggagtgggtgccaacagcagggagaagccaggcagtgggagcaggcacttctgaccctgaaaagcaaggggtgcctttctagtccctcaagaatgcagggatgcctgagtcttcagtctggtttggatggctgcagccgtgcccaggaaggcagggctcctgcctgctctgtggagccagaggtgaggacgatgcctccctgctgcagctggtgtcttggcaatggccactctagatgggtcactgttgccattactagattccaaaaagaaaaatgaaatatagacatttccagataagcaaaaataaacataattggttgctaccagacctaccttacaagatataataaaggaaggtcttcagaatttaagtaagtgacccccaacagtactcaaaaaccatatgaaaaaacagagtgctggtaattaagtataaaagacagtataaatacatatttcttcttctttctgttaactaattgtaaaaagcaattgtataaaacaatgtcaattatcattgggtttatagcatatagaaatgtgatatagtcaataacagcagcacatagtaggtgttcaaaagctgggacctgccgtgttgttgttgttattattgactggcctgtttaggggcacaaaagtggattataggaactccagaaagggatgcttgatttcaatactcagaaaaattttaaaggaatgttaaaatgcatatagaagcattttgaaaatattgactatttacttctgtatccagaaacatgcagactaattgagtagagaaatcccttcctaaaaatgctgaataaaacatcaaatatgtctgtgtgaaagcacagatgaacggatgttaaatagggaaccagtcagaagccagaataacaagagcatgaccccatcagggtgagcctgcaccagggcctgtgcttcctgaggccctggattgtaaatggccagcgtgccaggcacctcctgggcaccacttcagtccgcttggccccagttctgattctggccactgctgaggtgatgagtgttctgtgggcctcatgcaggtgctgcctcaccttgggcacatggggcccacccctcccttcctgtctgagtcacacagggaggatgctctcgggaatcccctggaccagtatgcatatgcacaccccaagttcaggggagttcatgtctgtgaggccactcttgaccaatgagtgacacaagcaaatactcaatgtgtcttttttgtatctcccatttcataagactctttggaagatcctatggaatcaagcacctatcagaggtccccttgaaaatgcgaccttgtcccgggcttccctctttatttgtttctctctccagccctcactcctactccctgggattacgtcccaaattaattacacaaaaacctttgtctgaggctctgcttttaggggacccaaaactaatcaggaaagaggagaaaaggcctgaagtctggtcctgggaggtaggacccttcctctcctccaaatttgggacttctcagaagttaataccctaggggagagagagggaaaaaaactcacctacagaagactttgctgtatccacttagttgtggctggagaagcaatacagggtaaaaaggaagtccgaaagccaacattcatgcagagaaaagcccaaaattatattccctgtatgaccagaaaaacactaagccaaaaaaatgtttaaagtggttctgagttggaagtacttttaggtgcctggcaaaagcaaacaaaaagcctttctggaataatatattttaaacacagattcaaagaattcccacaaagaattacaagaaacatgacctcataattaacaattaataagttcatatggaaacaaaccacaaggagtatgcgtcagcagaaacaataaataaatagcggggtgagacccacaaatactgcataagatagaatgatgagacacagaatagaagataagtattttaatgtatttaatgaagtgaaaaaagatactgaaaatatgagaaagaaacgaataatattaggcatatttatttatttatttttatttatttatttttttgagatgcagtcttgctctgtcacccaggctggagtgcagtggcgtaatctcagctcactgcaagctccacctcctgagttcaggccattctgcctcagcctcccgagtagctgggactacaggcgcgtgccaccatgcctggctaattttttgtatttttagtagagacggggtttcactgtgttagccaggatggtctcgatcacctgacctagtgatccacctgcctcggcctcccaaagtgctgggattacaggtgtgagtcaccacgcccagcctaattaggcatatttaaagatgaaccagataaaacttctacaaatgaaactgcaataattaaaataaaaagactcaaaagacaagtgaaaaagctgaatagacaaaggtgaagacagaatagtaaattgaaaagtagagcttaagaaattaccaagaattcaacaaagaaaggtaataaggtgaaatatgaaaaagaagagacatgggagaaattcaacatttattcatgataaaacctctcagcaaactaagaattaaaaggcacttcctcaactcagtgaaagacatccacaaaaaacctatacctactgtcatattttatagtgaaagactgaagtcggctgggcgcggtggctcacgcctgtaatcccagcactttgggaggctgaggcgggtggatcacctgaggtcaggagtttgagaccagcctggccaatgtggtgaaaccctgtctctattaaaaatacaaaattagccgggtgtggtggcgcatgcctataatcccagctactcgggaggctgaagcggaggttgcagtaagcagaggccgcaccattgcactccagcctgggtgacaagagtgaaactctgtctcaaaaaacaacaacaataacaacaaaaaataacaccgaagtcttttactctaagttcaggaacaagcaaggatgttcacccttaccactgccattccgctttcaactggaggtcctaaccagggctagaagtcaagaaaaatataataaaataaataaaaggcttacagattggaaaggaagaaataaacctgtctctgttagtagaatacataattgtttatttagaaaatcacaaagaatctacaaaaaagcaactacaactaataagtaaatttatcaaggttacaagatacaagatcaacagagaagaatcactatgtttctatatattaggaatgcccaattaaaatgagaattttaaaaacggtgccattttaaatagcataaaaacaaggaatacttggcataaatctaacaaaacatgcaagactgacatgctgaaaacaacaaaacattgataagagacactaaagaagacctaaatagaggcaatgggttggaaaatatatatatattttttcttttttgcttttttacactatccacctggagacagaaaaatccatattttaaagtccaaattctccccaacttgatcagtagatttaatgtaatcccaatcaacagcccagcaggattttcataaaaatcaatatgttgattctaaaatatttatggtaatacaaagaaacttgaatatccacaaaaaattttgagaaaaagaacaaattaggaagactcacactgctagattgtaagaatgtactttaaaaccaggaatactaacaagcaagtttagcaggatcacagtatgcaagatcaatatacataatcaaaaaactttccacaaagaaaagcccaagcacagatgacttcactggtgaattttatgacccagttgaagaataattaataacaattccttataaactgtttcaaaacttagaaaacgagagaacactttccaaatcattctacgaagccaataattccccgatacccaaaacaaagacatcacaagaaaaaacagacagacaaaaatgaagaaaactacagaccaatatcttttgtcagtatagatgtaaaaatcttcaaaacaaatagaatcaaacaatacagcaacatatgaaaaagaatgtacaacatggccaattgggacttttcccaagaaggtaaggttggctgaagatatgaaaatcaatcaatgttacataccatattaatagaataaaagattgaagctttaaatcgggtcagtgatgcagaaaaagcatctgaaaaaaatccaataccttatatgataaaaattctcagaaagctagaaatagaaaggaagttctttgaactgataaagatcatctacgaagagtcctgcactaatatagtacctaatggtgaaagactgaaactgtctgacccctaagatcagcaggaaaggatttttcctcttactacacctgttcaacattgtactggaaataatagccaccaaattagatcctcccttcctgccccaaaatgaaagaaataaatggcatcactgttgaaaaagacgtaaaattacttctattctcagataatacgattgttctatggaaataattattaaatcttatggaagccacaaaaacctattagagataataaatttagcaagcttgcagaaattaagaaaataattcaatttacaatagcataaaaaaggataaattggccgggcacagtggctcatgcctgtaatcccagctacttgggaggctgacacaggagaatcgcttgaaccagggagtcggaggttgcagtgggccgagatcgtgccaccacactccagcctgacaaaagagcgagactccatctcaaaaaaaaaaaaaaaaaaaaaaaaaaaaaaagagatggaggccatcctggccaacatggtgaaaccccacctctgctaaaaatacaaaaattagctgggcatggtggtgcatgcctgtagtcccagctactcgggaggctgaggcaggagaatcacttgaatccgggaggtggaggttgcagtgagccgagattgtgccactgcactccagcctggagacagagttagagtccgtctcaaaaaaaaaacaaacaaacaaaaaaaaaccacacaagattcatatgctgcaaactacaaaacattgaaagaaattaaagaaggcttaagtaaatagaacgatattccatattcatggattggaagacaatattgttaagatggcaataccccctaaatttgtctacacttacaatgtagtagtacactttcaaaatcccagcttctttttgcagaaattgaaaaactgattctgaaatttgtataaaaatgcagcagacccagaattgctaaaacaatcttgaaaaaaagaacaatattgaaggacttacacttcttgatttcagaacttcctgcaatgctgcagcaatcagcattgtgtagtactgacataaggacagacatataaattaatgaaatagaattgagagtccagaagtaaacacatacgtttatattccattgattttttaacaagggtgccaagataatttaacggagaaaaatatcttgtcatcaaatcactgatgttgggacaactggatatctacatgcaaaagaatgaagttgatcccttccttagaccatatacaaaaattaagtccgatctgcaaatggctcagatacctaaatatgatagctgtaactctaaaactcttagaggaaaacgtaatcataaactttcatgatcttaggttaggcaaagccttcttacatgcaacagaaaaagcacaagcaacaaaagatgaaatagataaattgtacttcatcaaaatggaaatcttttggcttcaaaggacactatcaagaaagtaaaaagacaacacagagaatgaggtaaattatttgcaaattatgtatatgatcagggactagtatccagaatataaaatagcaactacagcttaaaaagacatatacctcaaaaattgggcaaaggatttaaacagatatttttccaaagaagatataccaatggacaacaccacatgaaaagattgtaaatattattatccatcagggaaatgcaagtcaaacccacaaggagatgccacatcacacatactaggatggctataataaaacagatggacaataacaagtgttgacaaggatgtggagaaattggaactctcatacattgctatgggaatgtgaaatggtgcagctgctttggacaagcctggcaactcctcaaaaagctaaatatagtgttaccgtatgacctagcaatttcattcttaggtatataccccccaaaatggaaacatatttacacaacaatttgtacacaaatattcatagtggtgttattcataatagcaaaaaagcagaaacaagccaatgttcatcagttgatgaatggctaaataaaatgtgatatatccatacaatggaatattatttgcccattaaaatgaatgaaatactgataatgctacaacttgtataaaccttgaaaacatcatgctaagtgaaagatgccagctacaaaacgccacatattttataattccacttatatgaaatgccaagaataggcaaatctctagagactgaaagtagattagtggctgccagggtataaagataggagacagtgaagactgactactaatagatacaggtttcttttggtgtaataaaaatattctggaatcagatagtggggatggttacacatctttgtgactatagtaaaaaatacataattgtacattttttttttttgagatggagtttcactctgtcacctgggctggggtgcagtggcaccatcttggctcactgcaacctccacctcctgggttccagcaattctcctgcctcagcctcccgagtagctgggactacaggcgcaagcagccacgcctggctaatttttgtatttttagtagacggggtgtcactatattggccaggctggtctcgaactcctagaccttgtgatccacccacctcggcctcccaaagtgctgggattacaggcgtgagccaccgcacccggccaacgatggggttttctaaatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaaaggaatgcttccagtttttgcctattcagtatgatattggctgtgggtttgtcataaatagctcttattattttgagatacatcccatcaatacctagtttattgagagtttttagcatgaagggctgtttgattttgttgaagaccttttctgcatctattgagataatcatgtggtttttgtctttggttctgtttatatgatggattacgtttattgatttgtgtatgttgaaccagccttgcatcccagggatgaagccaacttgatcgtggtggataagctttttgatgtgctgctggattcggtttgccagtattttattgaggatttttgcatcgatgttcatcagagatattggtctaaaattattttttttgttgtgtctctgccaggctttggtatcaggatgatgctggcctcataaaatgagttagggaggattccctctttttctattgattggaatagtttcagaaggaatggtaccagctcctctttgtacctctggtagaattcggctgtgaatccatctggtcctggactttttttggttggtaggctattaattattgcctcaatttcagagcctgttattggtctattcagggattcaacttcttcctcgtttagtcttgggagggtgtatgtgtccaggaattcatccatttcttctagattttctagtttatttgcatagaagtgtttatagtattctctgatggtagtttgtatttctgtgggatcggtggtgatatcccctttattattttttattgcgtctatttgattcttctctcttttcttctttattagtcttgctagtggtctatcaattttgttgatcttttaaaaaaaccagctcctggattcattgatttttttgaagggttttttgtgtctctatctccttcagttctgctctgatcttagttatttcttgccttctgctagcttttgaatatgtttgcttctgcgtctctagttcttttaattgtgatgttagagtgtcaattttagatctttccttctttctcttgtgggcatttagtgctataaattccctctacacactgctttaaatgtgtcccagagattctggtatgttgtgtctttgttctcattggtttcaaagaacatctttatttctgccttcatttcgttatgtacacagtagtcattcaggagcaggttgttcagtttccatgtagttgagcagttttgaatgagtttcttaatcctgagttctagtttgattgcactgtggtctgagagagagtttgttataatttctgttcttttacatttgctgaggagagctttacttccaactatgtggtcaattttcaaataagtgcgatgtggtgctgggaagaatgtatattctgttgatttggggtggaatgttctatagatgtctattaggttggcttgatgcagagctgagttcaaatcttggatatccttgttaactttatgtctcattgatctgtctaatgttgacagtggggtgttgaagtctcccattattattgtgtgggagtctaagtctctttgtaggtctctaaggacttgctttatgaatctgggtgctcctgtattgggtgcacatatattgaggatagttagctcttgttgaattgatccctttaccattatgtaatggccttctttgtctcttttgatctttgttggtttaaagtctgttttatcagagactaggattgcaacccctgcttttttttttgttttctatttgcttggcagatcttcctccatccctttattttgagcctacgtgtgtctctgcatgtgagatgggtctcctgaatacagcacactgatgggtcttgactctatccagtttgccagtctgtgtcttttaattggagaatttagcccatttacatttaaggttaatattgttatgtgtaaatttgatcctgtcattgtgatgttagccggttattttgctcgttagttgatgcagtttcttcctagcatcagtggtctttacaatttggcaaggttttgcagtggctggtactggttgttcctctccacatttagtgctttcttcaggaactcttgtaaggcaggcctggtggtgacaaaatctctcagcatttgcttctctgtaaaggattttatttctccttcacttatgaagcttagtttggctggatatgaaattctgggttgaaaattcttttctttaagaatgttgaatattggcccccactctcttctggcttgtagagtttctgctgagatatcagctgttagtctgatgggcttccctttgtgggtaacccaaccttactctctggctgcccttaacattttttccttcatttcaactttggtgaatctgacaattatgtgtcttggagttgttcttctcgaggagtatctttgtggcattctctgtatttcctgaatttgaaagttggcctgccttgctagattggggaaattctcctggataatatcctgaagagtgttttccaacttggttgcattctccccgtcactttcaggtacaccaatcaggtgtagatttggtcttttcacacagtcacatatttcttagaggctttgtttatttctttttactcttttttctctaaacttctcttcttgcttcatttcattcatttgatcttcaatcactgatactctttcttccacttgatcgaatcagctactgatgcttgtgcatgcatcatggtgttctcgtgccatggttttcagctccatcaggtaatttaaggtcttctctacgctgtttattctagttagccattcgtctaatcttttttcaaggtttttagcttctttgcaatgggttcgaacatccttctttagctcggagaagtttgttattactgatcgtctgaagccttcttctctcaactcatcaaagtaattctccatccagctttgttccgttgcttgcgaggagctgtgttcctcagttgggaatgcagaaatcacccgtcttctgtgttgcttatgctgggagctgtagagtggagctgttcctattcggccatcttggaaccactgactctcatcttttaaagatgagatttggacacacagccaaacaatatcagaccctgtctcaaaaaaaaaaaaaaagattaattattcacctatcatgtgacccaaccattccactcctaggtatttactcaaaagaaatgaaagcatatgtccatacaaagactatacatcaatgttcatagcagctttatttgcaatggccccaaactgaaaataatccaaatgtccatcaacaagtgggtggtaaacaaatggtggaacatccacacaatggaatactactcagcaataaaaaagacgaactagtgtgtatggtgtggatccctaagtgaatgaatctcaacaattatgttaagtaaatgaagccagacaaaaaagagcttatcctgtataattccatttatataaaatcctagaagtgggaggatcgcttaaggccaggagtttgagaccagcctgagcaacatagcaaaaccctgtctctaaaaaaaataggaaaaagttagccaggtgtggtttgtgtgcccacagtcccagctacttaggaggctgaggcaggaggatcacttgagcctaggagtttgaggctgcagtgagctgtgattataccactgcactccagcctggacaacagagcaaggcctcatgtctaaacataaataaataggttgggaacagtggctcacgcctgtagtcccagcactttgggaagccgaggcaggtggatcacaaggtcaggagttcaagaccagcttggccaagatggtgaaaccccatctctactaaaaatataaaaaattagctgggcatggtgacatgcacctgtaatcccagctactcaggaggctgaggcaggagaatctcttgaacctggaaggcggacattgcagtgagccgagatcatgccattgcactccagcctgggcgacagagcaagattccatctcaaaaaataaataaataaataaaataaaaataataaataaataaaaatataagatgacattctagaaaatgcagattaacctgtggtgatagaaagttgactagtggttgcctgggagcagggtgggtgaagaatcaaattaacaaagaagtacaagggcacctttggggctgatagatgtggtcatcttttttttttttttttttttgatatggagttttactcttgttgcccaggctggaatgcaatggtgcaatctcggctcactgcaacctccacctcctggactcaagagattctcctgccccagccttccaagtagctaggattactggcacctgccaccatgcctggctaatttttgtatttttagtagagacagggtttcaccatgttggcgaggctgttctcgaactcctgaccttaggtgatccacctgccttggcctcccaaagtgcaggatttacaggcgtgacctatcacgcttggcctgcacgtggtcatcatcttgattgtaatgatttgcacacctgtgtcaacacttatgaacacttgtgtacacttcaaataattcagtttcttgtacttcaattatacctcagtagagctatttttaaaatacgtatctttgattagatcatggtcttaacaaagccgctctaactcaaattttggagaaatgtgacatgagacaaggtatcacatgatgttaagaaattattgcagccaggtgtagcggttcatgcctgtaatcccgcactttgggaggccaagatgagaggattacttgagcccaggagtttgagacgagcctgagcaatgtaatgagaccccatctttacaaaaatatcaaaaaattagctgggcatggtggcacatgcccatagtcgcagctactcaggaggctgaggtgggaagattgcttgagcctgggaggttaaggctacagtgactgatcacgccactgcattccagccagggccacagagcaaaacctcatgttaaaaaaaaaaaaagataaattattgctaattttttttttttgagacggagtctcaccctgtcgcccaggctggagtgcagtgacacgatctcagctcactacaacctccgcctcttgggttcaagcaattctcctgcctcagcctcctgagtagctgggattacaggtgcgcaccaccacaccctgctaatttttttgtatctttagtagagacggggtttcaccacgttggccaggctggtctcgaattcctgacctcaggtgatctgcccgccttggcctcccaaagtgctgggattacaggcgtgagccaccgtacccggcctgctaattttattagttatgaaaatgtaataaaatgtcctaatttatttttaaaatgtgaggagggatgggaggccctcaaatgggctccataaacagctctggagctagcttccacctcatggccaaccaggggtggctatgcgctagcctgcaggtctccaacctgtccagcccagttgtcttggagatggggatgggaagtgggcagagagaagctctcaatccttctgacttccttggaaatgtccttggagccattgtacttaacagtaaatctttgccttctgcacagggactctttgtcttaaccctctggggccgctggctctgaggcagtcgctgttgtctagatcaagtttctgtctgtacacctctttctttcttgctggcagagacaccatttgtatgtgtgtcacactcctcccaggggctcaggaaaatcattctattctacccagctcaaggggtaaatcctgattggtgtaggctagtcttctttgcagagattggtttaggagttggcatgtgaatcaatgagatttgagaaaaggatggggagggagaccgtattagtcctttcctgccactgtaacaaaataccttagactggagaattgagagatagcataactgtattgctcacagctacagaagctggaagtccaaaatcagggcaccagcagattcagtgtctgatgagagcttagtctctgcttccaagatgggaccttgttgctgtgtcctctggaggggacaaatgttgtgccctcccataacacaaaagatgaaaaggcaaaaagagatgaatgctgtttcttcagggcgcaaaaggtggaaaggcaaaaggaagacaggccagctagttccctcctgcccttttgtaagacacgaatcccatccatgaggacagagccctggtggcctaatcatctcctaaaggctccacctcttaatactgctgcactggggattcagtttcaacatgaattttggaggaggcacaaacactcgcaccatagcagagtcttctgggaaatgtttccttgctcttaaaaagggctccaagggctaggcatccttcctctcatagcggatattgttgtttctggatatgacgcctagagctgtggcagctctcctgagacaatacgcagagcccttcctaggacagaccaagccagtacgcatgggagaggaaagacaggaagaacctgagcctgacgctgctgctgagtcacagattagcccattctggagctgccatcacctccccgcttcctgctgtatgaattaataaactttccttattgtttttttgttttgttttgtttttcagatggagtttcactcttgttgcccaggctcaccttcttgattcttgccgtatgaattcataaacttttttttttttttttttttttttgagacggagtttcactcttgttgcccaggctggagtgcagtggtgtgatctcgactgactgctgcctccgcctcccaggttcaagtgattctcctgccacagcctcctgagtagctgggactacaggcgcctgccaccacacctggctaatttttgtgtttttaggagagatggggtttcgccatgttggtcaggctggtctcaaactcctgacctcaggtgatccgcccgcctcagcctcccaaagtgctgggattacaggcgtgagccatcgtgcctggccttattgttgaatccattaaagatgaactaacataggctgggcacagtggctcacgcttgtaaccccagcactttgggaggccggggagggcagatcacgaggtcaggagatcaagaccatcctggctaacacggcaaaaccccatctctactaaaaatacaaaaaattagccgggcgtggtagctggcgcctgtagtcccagctactcaggaggctgaggcaggagaatggcatgaacccgggaggcaaagcttgcagtgagccaagacagcgccactgcactccagcctgggcaacagagcaagactctgtctcaaaaaaaaaaaaagctggtcacggtagctcacgcctgtaatcccagcactttgggaggccgaggcgggcggatcacgaggtcaggagatccagaccatcttggctaacacggtgaaaccctgtctctactaaaaatacaaaaaaattagctgggcgtggtggcaggcacctgtagtcccagctactctggaggctgaggcaggagaatggtgtgaacccgggaggcagagcttgcagtgagccgagatcgtgccactgcactccagcctgggcgacagagcaagactccgtctcaaaaaaaaataaaaaataaaaaataaaaaacaaaaggtgcaagatacaaggtgctagacttcaacaaaattgctcattaaaagggaccatgaaaaaaacagaaaaagcaagctgcaggctgggagaaaacatgtgcaaaacatatatttgaccccctccctccaaaagaaatccatctggaaaatataaagaatgcctacaaatcaataataagaccaattacttgatttttagaaattggcaaaagtcttcaacaggactcttacacaagaagctacttaaatggccaataagcacatgaggggatgctcaacatcattagtcatgaggaaaatgcaaattaaagccacaaagctaccaccatgcacctaccagaatgactaaagtgaaaaaaagtaataacaattacacatttgacaaggctgtggagcaactggaactctcatacactgctgatgtgagtgtaaaactgcacaaccactcaggagacctgtttagcagctttgaataacattaagcactcacttaccttatgacccagcaattctgctctgaggtatatatttaagagcaatgagggcataatgtctgcaagacttatacaagaatattcatagcaactttattcatatggccaaaaccaagaaacaatcaaaatgcctatcatctaggagaataaacaaaatatgatatattcatataatgatataggacttagcaagtaacaaaacaaactgctatggatacatgcgataacatggatgcatctcaaacacattatgtcaagtagaagaagccagatggagaatttgtgctaggataatatcatttttatgaagttcaagaacaggcaaaactaattgatggtgataaaagttagaacagtgggccgggcacggtggctctcgcctgtaatcccagcactttgggaggttgaggtgggcggatcacttgaggtcaggaaatcgaaaccagcctggccaacatggtgaaaccccgtctctactaaaaatacaaaaattagtcaggtgtggtggtgcgcgcctgtaaccccagctacttgggaggctgaggcaggagaattgcttgaacctgggaggtggaggttgcagtgagccaagatcacgacactgcactccagtgtgggtgacagggcaagactctttctcaaaaaacaaaacaaaacaaaaaaaacagtgcttagctctgggttatgtgaatatcagctgtacaagggcagaagggaactttctgatgtgatgcacatgttctatatcttgagctgagtgtcagttacatgggcatgcaaacgataaaatgtatcaagctatacattcaaaatttgtgtatttttctgtgtgtaaattatacctccatagagtactacattcatgcattgcttaatgataaggatacattctgagaaatgtatccttaggtgattttgccattgtgcaaacattctggagtgtacttacacaaaactagatgggatagcctactacacacctaggctatgtgtacagcttattgctcctaggctaaaaacctgtactgcatgttactgtactgaatagtgtaaggaagtagtaacacaatggttatttgtgccatggtaatttttaagctccattataatcttataggaccactgctgtatatgtggtccaccattgaccatgacgttgttgtgcagtgcatgactgtatttgcattttttaagaaataccattcaccagagaagctggtctattcaatttttaaaaagagtttagcagagggccgggtgcggtggttcatgcctgtaatcccagcactttgggaggccgaggcaggcagatcacgaggtcagaagatcgagaccatcctggctaacacggtgaaaccccatcactactaaaaatacaggaaattagtcgggcagggtggcaggcgcccgtagtcccagctactcgggaggctgaggcaggagaatggcctgggaggcagagcatgcagtgagctgagatcacgccactcactacactccagcctgggcgacagagcaagactccgtctcaaaaaaaaatagtttagcagagttgccagatataaattcaatatctaataaattaaagtttaatgaatgtatatacatcatcaagttagaaaatgcaaattaaaaatttacaatagcaatgaaaaatataagatattgaaaataaatctaacaggccgggcgaagtggctcacgcctgtaatcccagcactttggaaggctgaggcgggcggatcacgaggtcaggagatcgagaccatcctggctaacacagtgaaaccccgtctctactaaaaatacaaaaaattagccgggcgaggtggcaggcgcctgtagtcccagctactcgggagactgaggcaggagaatggcgtaaacctcggggggcggagcctgcagtgagctgagatcgcgccactgcactccagcctgggcgacagcgagactccgtttcaaaaaaaaaaaggaaaaaaaagaaaataaatctaacaaaagatgtgtaaaaacctttttttaaaagaagtggggtcttgctatattgcctgggctggtcttgaactcctgggctcaagcaatccacccacctttgcctcctaaagtgctgggattacaggcataagccattgtacccagtcctgtaaaatcttataagccactgtacccagccctgtaaaatcttttttttttttttgggacggagtctcgctctgttgccgaggctggagggcagtgccgtgatctcggctcactgcaagctccgcctcccaggttcagccattctcctgcctcagcctcccaagtagctggtactacaggcacccgccaccacgcccggctaattttttgtatttttagtagagatggggtttcaccgtgttaaccagcatggtatcgatctcctgacctcatgatctgcccgccttggactcccaaagtgctgggattacaggtgtgagccaccacacccagcctgtaaaatctttatgtagaaaattatagcaccttactgaaaggcaataagaaaaccaattggtgagcaacaacatgtttgtggaaagactcaatgctgtaaaactgttatttctccccagattgatttaatactgtttccatcaaatcataacaaaactttgcacacatttcaccaaaaaaaaaaaaaaaaaaaaaaattagtgcctagatcctataaatcaattaggaggacaaaaaattcaatagaaaaatgtttaaaaatatgaacaggtgctgggtgtggcggctcatgcctgttaattccagcactttgggaggctgaggtgggcagatcacttgaggtcaagagttcaagaccagcctggccaacatggtgaaaccccatctctactaaaaatacaaaagttagccgggcgtggtggcagtcctctgtaatcatagctactcaggaggctgaggtaggagaatcacttgaacccaggaggtggaggttgcaatgagctgagatcacaccactgcactccagcctgggcgacggagtgagacactgtctcaaaaaaccaaaccaaaccaaaacaaaacaaaccataaacaggtatttcacagaaaacacaaatggcccattaaatatatgaaaatatactcaccttcattagtaaaaaggggaaatgtaaataaaaccacaaattttcatttcatgcccactagtttggaaaaaaattagaagactgacaaaatgctggtgaaatgtaactattaaactgcagtgggactagaggtgagtacactcactttgaagaaaagttttacattatttggtaaaagtgaacattcacacaccctgagacccagcagttctactcctggagatatggatggaatagtcacagagcactgtttattagatcaaaaacaaaatagcccaagtacccattacagtagagtgaataaatgaattgtggttcagtcacacaatagaatactatattatagtggaacagaaaactatagctccatacattaacatggatgtagctgatgatattttccagacggccaccaccatacagcccgtctcatgtgctcttctcaccttttgagatgccagtgacatattacatctttcttgtagtcccacaggtccctgaaactgttttttttcccctcctgcagtctattttctctctggttcagtttcagtctattttccctgtggttccaatcaggtcatttctattctgtgtttcagttcacggattctttcttctgtcctcccgttcttctgttgagcacatccactgagctttaaaattttagtcattgtctttttcagtttgagcatttccatttggtgctgcatatgttaactagcttgatttagccatttcacaatgtctacatatatcaaaacatcatttgtataccataagtatatataatttttttttggtcaacaaaaataataaaatttctatttggttctctctctctctctcttcctccctctgtccctctgtgccaatgcctgtaagaatacttttttattgtttttgttgagacggagtctcactctatcgcccaggctggagtgcagtggcacgatctaggctcactgcaagctctgcctcccggcttcatgccattctcctgcctcagcctcccaagtagctgggactacaggtgtccgccaccacgcccggctaattttttgtatttttagtagagacggggtttcactgtgttagccaggatgttctcgatctcccgacctcgtgattcgcccgcctcggcctcccaaagtgctgggattacaggcgtgagccaccgcgcccggccaattccagcactttgggaggccgaggcaggtggctcacgaggtcaggagatggggaccatcctggctaacacagtgaaaccccgtctctactaaaaatacaaaaaattagccgggcgtggtggcgggcgcctgtggtcccagctactcgggaggctgaggcaggagaatggggtgaacccgggaggcggagctggcagtgagccgagatggcgccactgcactccagcctgggcgacagagcaagactccgtctcaaaaaaaaaaaaaaaaaattgctgtgattacaggcatgagccaccgctcccgtccttgactggtgattttctactgaaacccagacatgttaggtattacgagactctgggtcttactgaaaccttgcttcccacgctgctactccagcacaggaggggaggtgctgccgcgttgctgtgaggtggaggcggaagtccaggttccccactcagcacccatggactctagagaagggggcactgtgccttactttggagggtgtgggagtcctagattctactagaccagcactggctgtgcggggtgggggtgtcaccttactgctctttcatggcctccactttcaccatattctcaggatggcagtgaccttggagtggagagaggggatgtgattgggcaggagacgcaggaggcttcaaaagaactgtgaatgttttattttgtagttgagcagtaggtatacagatgtttctttctttctttctttctttctttctttctttctttctttctttctttctttgagacagagcctcgctttgttgcccaagctggagtgcagtggcacaatctcggctcactgcaacctctgcctcccaggttgaagcgatcctcctccctgagcttcctaagtagctgggattacaggcgtgcaccaccacgcccagctaatttttttgtatatttagtagagacgggattgcaccatgttggccaggcttgtctcaaatttctgacctcaggtgattcacctgcctctgcctcccaaagtgctgggattacaggcatgagccactgtgcccagccggtatacaggtattaattttattattattatatattacggaatgttttaaaaacagaaaaacctaaccacaacagagtagaaatatgctgtgtttagaatatttgtaacacagttagctgagctcctcagacatagcaatatccatcgtctgtagtattaagcactatccatgtgccaggtgctgtgccaagcacttcacacacatcatcttatttatccctcaccacactcctaggggacagatactaacccactttacatacaaggaagctcaggctcaaagaggttaagtcgcttgcccagaatcacagagtaatatgtggctgaggtgggacgggagcccaggcctgtctgcagagactgtattcttcaacccacagcatccgaacaaggatgaaaccaattaatatcattcattgtaatcatggcatgccatgtcctacccacagctgataaaatccgacagaaagcattagactcccacaggatgggtaatatgtcttgggaggaccttgtgggcaaagtgaatacaagtggcagctgcacccaaacaagcccagggtcaggacccacccaggtgagcagagcttggaattagccagtgaggcaggagctgtggctgaggcctgtccagccgtgtggcagggctgtgaaggcaggcagaatagcaagggagggacgccagagatggggaaccatgaaagatgtctcgcctcctgtttcagagggagggatccaactcgcggggcaagagcggctggaactggagggagagaatagtgtctgcaagagcagaataccagacatcagagttagcaatccaggcaggagccagaacccagggccacagagagcatggtctgccctgtcccaccgctttctctgtgacacaggggaaagaggttacagaaattgagtgataatggctaaggtgaatcagccacgaactatagccctctcaggagctgcaggccctgccctacccagcctgcccaactggtgggtggcaaagacctgtccacccactaggacagggcaagaggcagagctaccagttaggagctcacgtggtcactgtccatgggaatggtggttcaggccaacaaaatcagattgtccagcgacaattgtcaattcccactgtaaggccacagccctgggatgggaatcctggttggactacagctcacagtcaaggttggagtatttgtgtagcccagattcaggctgagtccctagcagctgagagcctgcctaggatacaggaagtgtagttgggcatctctgggtttagacatcaaacaaggaagggcggggtgaaatgaggaaaagtgaccaggatggcaagggacccacaccttcccctcagagctgctgcaagggcagttctcctagccccagtacatcctaggcgccggttcacagctggtagcctcctgtaacctggactagctggacaagttgggccaaatagattgttcctttggagtctgattattatgaaatattctactttttctctcataatacttcttgacttaaagtttgtataatatttccatattagctttcttgggattagtgttgacatgaaatattgctttctaacctttgactttcacctttttatgtccttatatttatatttattatatttatttatttatttatttttgagacagtgtctcactaggtctcccaggctggagtgcagtggcttaatcttggcttactgcaacttccgcctccccatgtccaagcaattctcatgcctcagcctcctgagtagctgagactacaggtgtatgccaccacgcccgattaattttttttttttttttgagaccgagtctcactctgtcacccaggctggagtgcagtggcgccatctcggctcactgcaagctccacctcctgggttcacaccattctcctgcctcagcctcctgagtagctgggactacaggcgcccgccaccacgcctggctaattttttgtatttttagtagagatggggtttcaccatgttggcaggctgttctcaaatgcctgacctcaagtgatccgtcagccttggcctcccaaagtgctgagattacaggcgtgagccatcgtgcccagcctacgtctatatgtgtatgtgtgtgtatatatatatatatatataaatatattttgtttgtttggtttttgtttgtttgtataatatttccatattagctttcttgggattagtgttgacatgaaatgttgctttctaaccttttgctttcacctttttatgtccttatatttattatatttatttatttatttatgtttgagacagcgttcacgccattctcctgcctcagcctcccgagtagctggcactacaggcgcccgccaccatgcccagctaattttttttgttttctttttagtagagatggggtttcaccgtgttagccaggatgatctcaatctcctgacctcgtgatctgcccgcctcagcctcccaaaatgctgggattacagacgtgagccactgcgcccagacttaatcaatatttttttaaataatttcattttgttctgctgttagctttttttttttttttttttgatggagtcttgctctgttgccaggctggagtgcagtggtgcgatcttggctaactgcaagctccgcctcccgggttcaacaggttcaagccattctcctgcctcagcctctggagtagctgggattacaggcgcccaccaccacacccagctaattttttttttttttttttttgacagagtctcgctctgtagcccaggctggaatgcagtggcacaatcttgctcactgctacctctgcctcctgggtcccagttcaagcaatttttctgcctcagcctcccgagtagctgagattacaggcatgtgccaccatgcccagctaatttttgatatttagtagagacggggtttcaccattttggccaggctggtcttgaactcctgacctcgtgatccacccgcctcagcctcccaaagtgctgggattacaggcgcgagccactgcacctggcctaatttttgtatttttagtagagacagggtttcaccatgttgggcaggatggtctcaatctcctcacctcttgatctgcctgcctcagcctctcaaagtgctgggattacaagcacgagccactgtgcctggcctactgttagctttttaattgcattttcttttactactattttagtggtcatcttagagattataaaatgcatccttgatttatttcaatctacattaagttagaacatttacaatttatacttaaatgatgcaataaccttataacagttaactcccatttagtacccaccctctttggttttattgttgtcatatatttacttttttgattttttttgagacagggtcttcctgtgttgcctaagctggagggcagtggcatgatcttggctcactggaacctcaacctcctgggctcaaacgatcctcctgccttagcctctccagtagctgagaacagtagctgagaccacaggcatgcattgctgtgcctggctaattttttttaaaattttttatagagatagggtcttgttatgttgtccaggctggtctgaaaatcctggcatcgagtaatccttccacatgggcatcccaaagtgctgagattacaggtgtgagccaccacactgggtctcatatacttgcttttatgtgaaaaatcttatgagatgttgttttaaatagccaatatttgattctcattggacacatttttactctttccttgtgctcttcattccttcttgcagtaccatcagggctcattttccatcagcctgaaaaattccctcagcctgggcaacatagggagacctcatctctacaaatacttaaaaaaaattagttggatatggcggtgcacggctgtggtctcagctactcaggaggttgaggcagggggatagcctgagcccgagaggccagggatgcagtgagctgtgacagcgctactgcactctagcctgggtgacagagcgagagcgagacctggtctcaaaaaataaaagacaaaaacaaaaataaaccttctctagtttttcttttcttttcttttcttttctttttttttttttttttgagactgggtcttgctctgtcacccaggttggagtgcagtggcacaatcacagctcactgtagcctcgaactgcagggtagctgggactataagtgtgcaccaccactcctggccaattttttattttttgtagagatgtggtcttaccatgttgctcatatggtcttgaatttctggcgtcaaacaatcctcccaaagtgctgagacaggacccatgagccaccgtgcaaacctcctcaagtatttcttatagtgcagatgtgcactagtaacaaagcacattctttccgcttttgtctgtctgacaacatgtttcttttactttattttttgaagtgggcatataattgtagcttggcaggttttttttttagcattttattttattttatttttggaagagagtctggctctgttgcccaggtttgagtgcagtggcacaatctcggctcactgcagcctcgcctcctggattcaagcgattcttatgcctcggcctcctgagtagctgagattacaggcatgcaccagtatgcccagctaatttttgtagttttagtagagatggggttttgccatgttggccaggctggtcttgaactcctaacctcaagtgatctgcctgcctcggcctcccaaagtgttgggatcacaggtgtgaaccactgtccccaactctttttagcattttaaagatgtcatttcattattgtctggcttccatagtctgccatcagttgtattgctggtatctctgtctctctctctcttttaaaatgtggtttcttttaagactttctactttgtctttgattttcagtaatttaactgtgatgaggctaagtgtagtttactttatgcttactctgcttggagctcattgatattcttgaatctatggcttgatgcctttcatcatatttgtggaattctcagccattatttctttttctttttttttttttttttttttgttgagacagagtctcactctgtcacccaggctgaagtgcagtggcacaatcttggctcactgcaacctctgcctcctgggttcaagtgattctcctgcctcagcctcccaagtagctgggattacaggcacgagccaccatgcctggctaatttttgtatttttagtacagacagagtttcaccattttggtcagggtggtctcgaactcctgacctcaggtgatccgccctccttggcctcccaaaatgttggaattacagggatgaaccaccacgcccagccttctttgtcttttcttttcttttctttctttctttttttttttttttttgagacaaggtctcattctgttgcccaggctgctggagtgcagtggtgcagtcatggctcactgcagcctcaccctccctggctgatgtgatcctgatcctcccactaaagtagctggaactacagttgtacaccactatgcctggctaatttttgtattttttgtagagacagggttttgccatgttggctaggctggtcttgaactcctgggctcaagtgatcctcccacttcagcctcccaaagtgcttggaatacagtcgtgagctaccatgcccagcccattatttcttcaaatactgcttctctcctattccctctcttctctccttaaggaattccaaacacgtatgttagaccttttgagcacatcccgtgcatctcttatactcagttctgtttttccttctattattctttttgctttgtgcttcaatttgaataatttctattgactggtctttaagttcacgagtcttgccttctgctgtatatagtcttttgctaaacctatccagtgagttcttaatttcaaatatattttgcagtccaaaatgtcagttttttggctgggtgcagtgactcatgcctgtaatctcagcattttgggaggctgaggcaggtggatcacttaagctcgggagtttgagaccagcctgggcaacatggcaaaaccctatctctacaaaaaatacaaaaaatatctgggtgttcccttttcccttccccttccctttcttttcctttccttttctttgacggagtctcgctgtgtcgcccaggctggagtgcagtggcacaatctcagctcactgcaacctcctccttctggtttcaagtgattctcctgcctcagcctcctgagtagctgggattacaggcacccgccaccacgcctggctaatttttgctttttttttttttttttttttttttgagacagagtctcactgtgttgcccaggctggagtgcagtggcacgatcttggctcactgcaagctcgcctcctgggttcaagcgattcttctgcctcagcctcctaagtagctgggagtacaggtgcatgccaccacgcccagctaatttttgtatttttagtagagacggggtttcaccatattggccaggctggtctcgaactcctgacctcatgatccgcccgcctcggccccccaaagtgctgggattataggcgtgagccacatcgcccggccaatttttgcatttttagtagagatggggtttcaccatgttgggcaggctggtctcaaactccgaccttgtgttccacccaccttggcctcccaaagtgctgggattacaggcatgagcaccacacccggccagatacttattttcttggcccattgagactgtgacttcctgcttggtccacttccttgcacctgagtttgggaaatggcttcatggagaaagcaatttaaatgtgaggcttgtccaggcgaggtggctcatgcctgtaatcccagcactttgggaggccgaggcaggtggatcacctgaggtcaggagtttgagaccagcctggccaacatggcaaaaccccatctctactaaaaatacaaaaattagctgggcgtggtggcacacgcctgtagtcccagctacttgggaggctgagtcaggagaatcacttatatccaggaggcagaggttgcagtgagccaagatcatgctactgcactccagcctgggggacagagtgagaccctgtctcaaaaaaaaaaaaagtgaggctcacctcatgtgcattccttctccaacgaccataaccctgcattggctgctgtccagtgcctacaaactgttgttggatattctattttgcccagtatttatggttgtttaccatggtagggtaaatctgagatcaatgagtctgccttggctggaatcaggtttctccctcaggggtttgagtggttgaggctaagttgaaagggtgtgtttcagagcagccacaaagctgtctggactctgaggtcatgcccaggaagctgagagatgaggaaatggaaaaaatgagtttgcggaagctgggaggacaagaaaaagctgaacaaatgcagggtggttgtggggtgtttgtgagggaagggagcggatgctgagagagctcaggaagtgccataggaccactcaccacaccctgttgtcttgaatccctagtgcccacacgcagtaccactctccagccccagggtccatgcctggacaaggtccaggtcctactcttggagtcctgtgagggcctgtctcccttactgataataatcccccagactcaagggaatccaagggacctgctgatctggcaaccaaaaggactcaacctcccaccaccccaacaggtaaagaaaccaaggcacagagaggttaggttcccttctgagggccacacaggaataagttgtacagccaggataaatacccacatactgtaaactcatgagcctgagctcttaacaaatgggttctcctacctcccatgaacaagcacaatccagtctcttctcatgaaagaaaaccttctggactcaagcccccaaggcggcccatgagctcaagtagcctgtgccccctgcacccttggaaggcatgagcttccttgggcctatacatggaagacaaggctctgaacaggtagcaaaaggtctggttatgaaccttgctctgttaatgatttgctcgggaaccccaggcaagtcaccgtccttctctgagcctcagttttccccaacacttgtgaggctattgtaaattgatgataaacccatgtgggaggctgggcatggtggctcatgcctgtaatcccaatactttgggaggccgaggctggtggatcacttgaggtcaggagttggagaccagcctggccaacatggtgaaaccccgtctctactaaaaatacaaaaattagccaagcatgatggcgcacacgtgtggtcccagctactcgggaggctgaggcttgagaattgcttgaacccgggagacagaggttgcagtgagctgagattacgccacagcattccagcctgggcaacagagcgagactctgtctcaaaaaaaacaaaacacaaaaacctatgtgggaaacagcccttggggctcccggtgcccagcagtgccgggcctgtcactgaccttgctctaggatgattcacagggacgtcgtgggtggccagagggctcgtgggtggccagagggccccttgcctgcagcagcaagagcagaatggctggtgtgccaagcttcggggcaccagtgggcaataggagaattctgtcagtgctggggaagggagtaaggaagcaagaacagccttcaggcgtgggtctcccagccacaggggctgtaggggagaccccggaaggaggatggggcagctgtcttagaataccaatcacccaaaggagcccatattccatgtttaccaggagtaccagggtcctcaatatcgtcttcacttgcatttatttgcattttttgcttataatttgtcatttggtggggtctcatttcatatcacagtctctactttttcctccctatttgggcacagggagaggtggaccttcagctaagtcctcctcggggaatttcattttaactctcaatataccttcagactccattagacccaattttaattttaatttttaaccaacctttctttcttctttcctttccttcgttctttctttctttctttctttcttttttttgacagggtctcactctgtctcccaggctagagtgcagtggcacaatctcagctcactgcaacctctgcctcacaggttcaagccatcctcctgcctcagcctcccgagtagctgggacaacaggtgcgtgccacaacgcctggctaatttttgtattttttggtattcttatttttagtagagagggggttttgccatgttgctcaggctggtcttgaactcttgagctcagtgatctgcctccctcgacctcccaaagtgctgggattacaggcatgagccatcatgcctggttgaagtttcttttttgagcagttcaaacgatttatgaggattattttattacttttattttttcacggaggtctcccaaaaccaaagagaacttttatttatttatttattcatttatttttttgagatggggtttcgctcttgttgcccaggctggagtgcaatggcacaatctcagctcactgcaaccttcacctcccggattcaagtgatgcttctatctcagcctcccaagtaactgggattacaggtgcctgacaccatgcccagctaattttttttttgttgttgttagtagagacagtgtttcaccatgttggcagactggtctcaaactcctgacctcaggtaatcctcctgccttggcctctcaaagtgctgggattacaggcgtgagcgactgcacctgtccactttcttttttttttttttaataaaaaagaatgaagggctgggtgtagtggctcatgcctgtaatttctgcatttccagaggccaaggagggcagattgcttaaactcaggagttcgagaccagcctgggcaacagggtgaaaccctgcctctatgaaaaaatacaaaaattatttgggctcagtggcacacccctgtactcccagctacttgggaggctgaggtgggaggattactaagcccaggatgcagaagttgcagtgagccgctgcactccagcctggatgacagaggagaccctgcctcaaaaaaaaaaaaaaaaaaaaaaagaagaagcttattttatcttgtaattatcatatggatctactggatcatttgtaaatctaaaatatattatgagatcttcatgatcttatttttcctatatcataaaacattttgctattgtattccctcaggaactatttcatcattactcatcaattattcccaacccatgctttgaaaaaaagactaaaatagtaagaaaacagaagaatgatggaattgcctgaatgactcaatagtgacatgagtcattgctatttcaccaattttcagttttcttattgccttgtccaaagcattaggaccgtctttcaagaaagtgtaaaaagtccagagatatcatctttgtatttttttttagctttcattgcacacagttaagaattcagaattgttcattttcctacaaagaggaaagagaaggaaactgacagaggaagacatttcacagctattagagcaatcagtagatgaatgcaacgcgacaaacagcagcactctagactgtaatgatgaggtaaaagcatcgtatgagcaaaatcttcagatgatgacatcatgcatgaattttctcaaacccaagaattgtccctattttcccaggggtaggggagaactagagagggatggctctttgcccagggtcactcagctcttgctctgtcctgttgctcagagatctgtgactgagccagcccctcctgtagcatacagtagatgctgccccgcaggatgggacagggctggaccttgaggtgaagaggctgtctggatacctgctcctgactgctagctcttcgcccacctcacctgccacctgtcctttggcgttgggttcttgaggccgtggtttccctctgggtggtgactcagtgcccacagcccgccttgcatgtgatcttcccctcccctgggcctcactgactgccccagcaagaggcagctgtggtttcccctgaagcagcaaccacgaactgccaagcccaccccacccctccgtgtcctagccccaacctcggggcctcagctgaaggagagatggggaggcctcataggcccatggcacttggtgtttacaacgagcttagccctcacagcatgagtgtggaaagtattatccctattcaattgatgaggagagtgaggccaacatgtgtgaggggcttatttcatttatgcattcatttattctacaagcgtctctcaaaagcccactaaaacccaggacagtagacccagagacacgatgtccagatgtacctcaggaaggactggccctggcggcgggagggtcgtgagtgctcagctctccagggattgcccccagctgcagagatttgcctcctctgcctcggcctcccatgcctttctctgggcagcctcatatccaaggactaatccagctgggtactaattcaggcccggctatttaagccctgtgtggggcggtgacaggtcattcggagctcccagtgaggcagctgaggccagggttgggcctgtcttgcagctggacttcttctccctctgcccagtttggcctctttgccttcccttctccaggtgctgtctgcaagagctctccctaacagacatccctcacagtaactccgagcccaaatccacttcctgaggaacccaccctgcaaccctcggctttcaaagagtggccagcctcatggcacagaggcatgtaaaccacccgggtggggagagaataggcccagggagacacagccaccggggcccagaaagctggctttggttttgtggggggtgtgggccgcagagttcaggattggggcgtggcagcaaggcaggggcccaagcgcctgaaaaccacagcccacccccttggcttggagaagggcgaggtccccacctgtctaccatgattttctcagacccagtctgctccaataagcagcccccgctcggctggaccgtctcccaatttcccttcccaaatacatactctgactgtgggtctagatgcctcctacatcctgagtgccttgtggccagccagcagcagcagcagagctgcccagaggaactgtgctggatctagtagggggagaagggagaacaggcccttctgggaccccaagatcccgtgcagggagcacatctgggttccaaacccacaaaaggaaacgtggccaagaaagcaaccaatctccacccccggcagggttgggctgcaccgccatactgtgactgtgctggctacagtcccatggcgatggggaactcacagccccgtgcccctccaaccagaggtccctgggctgggcaacttagataattaggaaggtcttccttcccttaaggtcctcctctggcctctggagctatgggatctgctgttctttggtaccagtaatccacatgtgaggccccatttttctcctaagtcactgtaggatcttgggcctcagttctccatctgtttagcaagggagagcagaggagagccagtccttccacttcccacctgccctgacattttatgactcagtgatacactgacgcctgtcccgttctgcctccttgccttctctcctccaagttgcccagctccatcaccttccctgcccctcccttgaccttccacctcccctgggctgacaagagctgagggtggtcagaagtcggcccggcttcccacctgacacagaggactgctcgaaggagatgctggtcactaagagcagggcagcagctgtaacaagccagcattctggaagctcctggaaatcatattgcagaatgctggcctggcaaggggtgagggtaagggtctagggtggggaacagtgagttctatatagcaggggagccaggacaagtgctgtccatgctggaatgcttcgttctgagcaagaatgacatcacagacaacccctgctccatgcttattaccatgggctgcccaaacccccacccacacagggagggcagcgggaggggacagaaatgaatgggcacaagctgtggcataaattctggtggaggatggagggaaacgatgccagagcatctagccaggccatagcctcacaagctctgtccctgagacaggatttctgcaacactggagagggatggtacccagccatccatgacttctgtgccaggcccgacttgtgtttaattgtatacattattaatggaactggtggcaaggggctggggctcagtctgtgaccagcatcagggctcagtctatgaccaggttcagtgctttatctaggaccaggaccaagactcattctgtggtaggatcagggcttagtgagtgatcaggatgagagctcagtctgtgacgagatcatgggctcaagcctatagctcacattaaggatcccctccgggtggggctcagagccagggacattgtggaaagtgtctgaaggcaaggtggggtcagctgggagagaggggagaagtggaagcatgaaggccaagaggtccctgggcctgaggccagctgtgtgaaaacagaaaagagagtcaggactccagctctgccactcactggctgtgtgattttggagagttacttccctttttgaggtctatgttgtcttgtgcgtaaaatgggaatattaggccgggcacagtgactcacacctgtaatcccagcactttgggaggccgaggcaggcagatcacgaagtcaagagattgagaccatcctggccaacatggtgaaaccccgtctctactaaaaatataaaaattaaagcccaggcgaggtggctcacgcctgtaatcccagcacttcgggaggccgaggtgggaggatcacgaggtcaggagatcaagaccatcctggttaacacggtgaaaccccatctctattaaaaatacaaaaaattagcctggcatggtggtgggcgcctgtagtcccagctgctggggaggctgagacaggagaatggtgtgaacccaggaggcagagcttgcagtgagccaagactgcaccactgtactccaacctgggcaacagagtgagactgtctcaaaaaagacaaaaaatgagctaggcgtggtggcaagcacctgtagtcccagctacttgggaggctgaggcaggagaatcacttgaacccgggaagcagaggttgcagtgagccaagatcacgccactgcactccagcctggcaacagatcaagactccgtctcaaaaaaaaaaaaagggggggaatattagttaggtgcagtggcttacaacgttaatccagcactttgggaggccaaggcgggaggacagattgagcctaggagatttgagaccagcctgggcaacacagtaagaccctgtctctataaaaaatttaaaaggtagctgggcatggtggggcccgcctgtagtcccagctacttgggcggctgaagcaagaggatcgcttgcgcccagtaattcaaggttgcaatgagctacaattgggctactgggctccatcctgggtgacagagtgcgaccttgtctctgaaaaataataataataaaatttttaaaagtgggaattttgacttctgttctgcctttgagatagagtcttgctctgagtcaccaacatgcaagttactatttcacaaagcaccaagaacccttatcaatacctgcctcccaagattattcacaggagtgagaatgcacttcatgagacagcagaaaaaatggggaggggttgtttgctcaatttccaaaggagaattgcttcagacaggaaaatctcaaaaggaaacagccttactgttgtcatggcttctcctcacagttcttctggtcagtttttattccccaaaataatgtgtacagagtatttacagtcagagaatgctaaaggattacaacaaaaataacacgctctttaccccacgtcagcctgctcgccaaaagcagccatttcaacttattcagttgtttcttctggtttttactccctaaataaagcattgatttcaattctggttatctcccaagaggtccaatttagatgctgtctctagggctccctattgtgacagaggaggttcacttacactctttctcctctcctttcaatatcataccaccacaactcttggttacattcacaatcactaaaaagtgtttatggctgaaacaactaatatactatctttttcaatctcctttcccccacagagttaatcattgtctcatttttttcacttgcttattttctttgacccatgattagatcttctgcaaaagcccagtaagataattctcaatactgattttcactatcagttccagttccttaatttttttttcccttgagacaccctttctggagccctcagttctcctgcctccatctgagccagaagctttccagatcagcagcacagtcgtcatccagaggcttccctttgccaacattctgcaacgtcatttcttctctttcctctatggatctctgatttttctgggttccatttcttctttcttggtttatgcccttttagggtggagcacatcctccagttccttcctgaggaagttttcacggaagacaatttttttttttgtctgaaaatgtcttattttctaccctcacactgggttgatactttggctgggtatataatgattttccctcagcaactttaaggcattgtttcataaacttctagtttctaatattgctgttgagaggtctaatactgatctggctcagattctctctctctctcttttttcctttttttttttttttttgagataagagtcttgctctcttgcccaggctggagtgcagtggcacgatctcggcttacctccacctcccaggttcaagggacttttgtgcctcagcctcccagggagctgggactagcaccaccacacccagataatttttgtaatattcttcccctgagatggagtcttgctctgtcacccaggctggagtgcagtggtgtgatctcggctcactgcaacctccacctcccgggttcaagcaattctcctgcctcagcctctcgagtagctgggattacaggtatgagccactatgctacccatttttttttttttttttgagacagggtctcactctgtcgcccaggctggactgcagtggcacaatcacagcccactgcagccttgacttcccaggatcaagcaatcctcccacttcagcctcccgagtaggtgggactacaggtgtatgccaccacccttgtctaatttttttagttttttgtagagctgggcctcaccatgttgcccaggctgttcttgaactcctgggctcaacaatcctcccaccttcgcctccccaaatgctgggataacaggcatgagccacggggcccagccaatctttaagttctttaaacaaatgtttcagttttcagagtatatgttttgcctttctttaaaaaaaatttatttctggaagatctggggctccgaatccagctaggatggctgtggttccgctactgctgtctgggggtttgtggaacaccgtgggagcgtccaatctggctgttactcgcggctctatggtgaagctgctcgaaatgcactacagtgtccatctgcagtcacacgatgtgctctatgggtcaggtactgggcagcagtcagtgacaagtgtaacctccatggatgacagcaacagttactggagaatatgggtaagatcaccacagctggtgagaggggaacccccatcaagtgctgccagcccatccggctgacacatgtcaacactggctgaaacctccacaactttctgaaaaccaggaagtgggtgcttttggtgaggaaggtgaaggtagtcacctggatgactggaccatactctgtaacgggccctactgggtgagagatggtgaggggtggttcaaacattcttccattgaggaaccgctgtctgtcacaggagaacgatatggtggacccatcagtgggcaaaaagagacgcatggtctggcctagccaagccgagcaacgactggaaagccatggaaggcatcttcatgaggcccagtgagttgttgaaggcaggaggccaccatgcagaggtaggagtctggaggctctgagccactgtcactacacagtttgtagacatctgtgctgcttcaccttgggatccctgccacaagttccccaggagtggccatgttactactgagatgaagatgtgcaatggaaaacagtggctgtgttcacaagctccagccctgcacatttgaattggctgctctcccagacttgggtcagtactttctgagtagaggacttgctggtgacagggtggatgctttttattcatactggtgtgtccggaattggtgggttcttggtctcactgacttcaagaatgaagccacggacccttgcggtgagtgttacagttcttaaaggcggtgtgtccggagtttgttccttctgatgttcggatgtgtttggagtttcttccttctggtgggttcctggtctcactggctcaggagtgaagctgcggacctttgccgtgagtgttacagctcttaaggcggtgcgtctggagttgttcgttcctcccggtgggttcgtggtctcgttggcttcaggagtgaagctgcagacctttgctgtgagtgttacagctcataaaagcaaggtggacccaaagagtgagcagcagcaagatttgttgcaaagagcgaaagaacaaagcttccacagtgtggaaggggacccgggttgccactgccagctcgggcagcctgcttttattctcttatctggccccacccacatcctgctgagtggtagagtccagtggtctgttttgacagggcgctgattggtgcgtttacaatccctgagctagacacaaaggttctccacgtccccaccagattagctagatacagagtgtggccacaaaggttctccaagtccactctgtatctaccagagtagccagatacagagtgtccactggtgcattcacaaaccctgagcgagacacagcgtgctgattggtatgtttacaaaccttgagctagatacagagtgccaattggtgtatttacaatcccttagctagacataaaggttctccaagtccccaccaatctcaggagcccagctgggttcacccagtggatcctgcaccggggctgcaggtggagctgcctgccagtcccgcgccgtgtgcccgcactcctcagctcttgggtggtccatgggactgggcgccttggagcaaggggtggcgctcctgggggaggctccggcagcacaggagcccacggagtggggtggaggctcaggcatggcgggctgcaggtcccgagccctgccccgtgggaaggcagctaaggcccggcgagaaattgagcacagaagctgctggcccaggtgctaagcccctcactgcccggggcggtggggccggccggccgctccgaggtccgctgagcccacgcccacccggaactcgcgctggcccgcaagcaccgcgcgcagcccgggttcccgccgcgcctctccctccacacctcccggcaagctgagggagccggctccgggcttggccagcccagaaaggggctcctacagtgcagcggcgggctgaagggctcctcaagtgccgccatagtgggagcccaggcagaggaggcgcggagagcgagccagggctgtgaggactgccagcacgctgtcacctctcactggtaagacacactgaggggacatccctcttagctgtgaaacttctagtcctcaggagcttggcgtcctggattgttaaacttcatgactttatcccaattttctttctccaaaatgatgttttttttgagacaatcttgctctgtcgcttaggctggagtgccatggcctaactcagctcactgcaacctccgcctcccgggttcaagcaattctcttgcctcagcctcccaagtagctgggattacaggtgcccgccaccacacccggctaatttttgtatttttagtagagacaggattttaccatgttggctagggctggtctcttaactcctggcctcaactgatccacccccctcagcctcccaaagtgctgggattacaggtgtgagccgccatgtcgggcctccaaaatgattttttttttttaaagaaagaattttattattagcctctgtgttatttattaggtgtgctatttcatgatttgctttatccttgagtcctaaaactcttttgagatgctgggaaccttcaatgtgggggccttttaagagctttagttgcatccgaaccttttctctttctactttcatttctccgcaggtacctcatttttaatagatttttgactaattatggccaaagactctcaaagaatacaacacaataaacagccaaataattttattcctaagttgttggggtgatcagacccaacaccaggccgtgggggatatgaagtcccgcggaatcaaacccatgagaaaagacaagagagaaagtcggaccaggggcccaactatagggaggctgggaaggccctgagctctgggagcccaggctatttattggtgatcaaacaaagaaacaggtgttgaggattgtaaggaagcagtgtatcaagcgaatgagctacagctgtgatggtttagcattttctttgaaacatatggctacttgagataatgggagtgctagaagcaaggagccagcaaatctaggcacattccaaaggccacgaggggttttagaccctggaccgccgacatgtaccaagccctgctcagcttctctcccaacactcagcttttctcccaacagtaagtattttattctttttgatgctattgtatagaattgctttcttaatttcatttttatattattcattgctagcataaagaaatatggttgacttttatatattgatattatactcctcaaactgattgaattcattagttctagtagttgtttttagtggattccttaggattttctctattcaagatcatatgctccgcaaatagagatggctttacttcctccatcccaatttcagtggtatttgaaattaaattttaattgccctggctaactgccctggttggatctccaggacaatgttgagtagaagttgtgagagtggacatccttctctggctcctgatcttagggggaggtttcagtttttcaccattaagtatgaagttggtgttgggtttttcataggtgaaccttaacaggttgaggaagttcccttctattcctagtttgctgagtgtctttatcataaaagagtgttggattttgtcaaattctttttctgcatcattgagatgatcttgtggttttcttccttattctactaatatggtgcattggattgattcattttcgtaagtccagccaaccttgcattcttgggaaaaatcccacttggtcaatcttacatgttgctggattcagttagatagtattttattaaagatttctatatctatattgacaagggatattggtctgtagaatttttgtttctgtttttgttgtgatgtctctctggttttggtatcagaataataactggcctcatagaataggttaggaagtattctttcctcttctgatttttggaagactttatggagaattggagttcatccttcaactgttttaaaattcactagtgaaatcatccctactttttctttgtgagaagttttttgatcatatatattgatcttgcatactgtgaccctgctacatttgcttattagttctattagtacttaaagtgcattccacagggccaggtgtggtggctcacacctgtaatcccagcattttgggaggctgaggtgggaggatcacttgagctcaggagttcaagaccagcctgggcaacatagtgagaccccccccatcattagaaaaataaaataccctccaaagaattatctacatacatgtcttctgcaattaaagacatttttacttattattttcctacctacatgcctttgttttcttttccttccctgatttcaccagcttgaaattccagggtaatgttgagtaagagtggggagagagaatgtccttgcctttttccttatcttaggagaaaaacattcagtctgcaccattaagtattaagttagcagtagttttttggtaaatagtctattgtgaagtccccttttttattgctgattttggcaatttgtgtattctctctttttttcttggtctctattaaagcttgtcaattttgttgatcattaaaaaaagaaaaacgacttttgggctgggggcggtggctcacacatgtaatcccagcacttaggaaagctgagacaggcggatcacaaggtcaagagattgagaccattctggccaacatggtgaaaccccgtctctactaaaaatacaaaaattagctgggcatgatggcacatgtctatagtccatcccagctactcgggaggctgaggcaggagaatcacttgaacctgggagagggaggtttcagtgagccgagactgcgccactgcactccagcctggcgacagagtgagaccccccatcactagaaaaataaaataccctccaaagaattatctacatacatgtcttctgcaactaaagacatttttactcattattttcctacctacatgcctttgttttcttttccttccctgatttcaccggcttgaaattccagggtaatgttgagtaagagtggggagagagaatgtccttgcctttttccttatcttaggagaaaaacattcagtctgcaccattaagtattaagttagcagtagttttttggtaaatagtctattgtgaagtccccttttttattgctgattttggcaatttgtgtattctctctttttttcttggtctctattaaagcttgtcaattttgttgatcattaaaaaaagaaaaacgacttttgggctgggggcggtggctcacacatgtaatcccagcacttaggaaagctgagacaggcggatcacaaggtcaagagattgagaccattctggccaacatggtgaaaccccgtctctactaaaaatacaaaaattagctgggcatggtggcacatgcctgtagtcccagctactcgggaagctgaggcaggagaatcacttgaacctgggagagggaggtttcagtgagccgagattgcgccactgcactccagcctggcgacagagtgagacttcatctcaaaaacaaacaaaacaaaaagcaaacaaaaaaaaaggccgggcgcggtggctcacgcctgtaatcctagcactttaggaggctgaggcgggtggatcacgaggtcaggagatcgagaccatcctggctaacatggtgaaaccccgtctctactaaaaatacagaaaaaattatctgggcgtggtggcgggcgcctgtagtcccagctactccggaggctgaggcagtagaatggcgtgaacccgggaggtggagcttgcagtgagccgagatggcgccactgcactccagcctgggcgacagagcgagactccgtctcaaaagacaacacaaaaaaacaccaactctcttttttttttttttttttttttgagacagagtctgactctgtcgcccaggctggagtgcagtgatgcaatctcggctcactgcaagctccgcctcccgggttcacgccattctcctgcctcagcctcccgagtagctgggactacaggcgcctgccactatgcccggctaatttttgtatttttagtagagacggggtttcaccgtgttagccaggatggtctcgatctcctgaccttgtgatccgcccgcctcggcctcccaaagtgctgggattacaggcttgagccaccgcgcccggcctattgtttttttctatttcattgatttctgctcttatctttattattttcttcttcttactttgggtttgatttccttttcttttttgaactacttgaggtggaagcttagattattgatatttgattcgtctcccattgcagcataagcatttaaattatgtaaattataaatttacttataaggctgggcacagtcgctcacatctgtaatcccagcactttgggaggctgaggcaggcaaatcacttgaggtcaggagttcaagattagcgtggtcaacatggtgaaaccctgccgctgctaaaaatacaaaaattacccaggaatgatggtgtgcacctgtaatcccagctactcgaggatgaggcaggagaatcgcttgaaccctggaagcagaggttgcagtgagctgagatcacgccactgcactccagcctggacaacagagcagatcacttggctggtcttgaactcctggcctcaagtgatctgcccaccttggtctcccaaagtgctgggattacaggtgtgagccaccacacctggcaccctgatgggattttgactggtattgcattaactctgttggttgcattgggaagagtttgtcacttaaccatgttgatttttctactttataaacatttatgtagatattttttagtttctctcatcggttttgttttgttttctgcatactgctcttgcacatgtttcgttagatttttacaaagtaggaatctgtttcttatgcagttctaaatggtacttttcaaaatttccaatttatttattgctaatctataggaatacaattgattttttttttccttctacaaatgtctgaggtaggaaaacaaggctgcccagcttgtggcagccctgataatcctcaaaggctgatcttggcctccagccctgactgaggagaaaaggggccacccatagccccactggcacaattggtttttctatgctgacctcatatcccataactttgcttaagtcattcattgtaggagctttttgtagattctttgtgattttctataaaggcaattatgtattttgctaacagaaacaggtttgtttcttctttgccagtctgtaggccttttatttgtttttcttgacttcttgcactggttagggcctctagtaaaatattgaatgggtgtgttaagaggaggtatccttgcttcttcctgaacttagagtgaaagaattcagtttcttaccataaaatatgacagtagatgtagggtttttgtgaatgtccatcattgagttgaggaattcccattagttcttagtttgctgagaggttttcatcaggaataaatgttggatttcttccatgtcttttaacttctctttcatatttcaccattttttcattctttgctgaatttttagtaatttcttaaactgtttattttattttatttttgagacagtctcactctgttgtccagactggagtgtggtggcgtgacattggctcactgcaacctccgcctcccaagttcaagtgattctcaagcctcagcctcccgaatagctgggattacaggtgccggctactatgcccggctaatttttgtatttttggtagagacagggttttgccatgttggccgggctggtctcaaacttctgacctcaagtgatctacctgtctcagcctcccaaagagctgggattacaagtgtgagccaccacacccaacctcttttgaggttttaaatcttaataattatagtttcattcctgagagttttatttggttcatcttcaaatatgcctaattaatttaattagtttatttgccatattttcagtatcgctttacaattctttttttttttttttttcagacaaggtcttgctctgttgcccaggctggggtgcagtggcaccatctcggctcattgcagcctccacctcccgagttcaagcaattctcctgcctcagcctcctgagtagctggaatcacaggcacgcaccaccatactcggctaagttttgtatttttagtagagacagggttttgccatgttggccaggctggtctctaactcttgacctcaagtgacccacccatttggctttccaaagtgctgggattacagctgtgagtcaccgcacctggcccgttttacacttctttaaacatattaaaaattttttttcagctgggcatggtggttcatgcctgcaatcccagcactttgggaggctgaggtgggcagatcacctgaggtcaggagttcgagaccagcctaaccaacacggagaaaccccatctctactaaaaatacaaaattaggtgtggtggctcatgcctgtaatcccagctacttcggaggctgaggcaggagaattgcttgaacccgggaggtggaggttgcagtgagccgagattgcatcattgcactccagcctgggcaataagagcaaaactccatctctctctctatatatataataaatatatatataataatatatattatatgtcatatatagttatatattataattatataatctataaatatataaaaatatataatatataatatatatttataatatataatatatatttttccgtgtgtgtgtgtatatatatgtgtatatatatgtatttttttttttttttagagagagagagatggggtctcactctattgcccagcctggtcttgaactcctggctcaaacaatcctctagcccaggcctcccagagtgctgggattacagccgagcgcccggcctgaaacacttattttctatcctgcatctcatcattctattttatgtagtatttgtgggtctcatcttgttattcgttgtttctgctgactcatgcccttgtggtttgtttctttttgagtttattgatgtttaattatgaacttatgttccttgaaattctttgtgggaagtctttgaatctgtgtttaaaatatattcttccagaaaggatttttgtttgcttttgccaggcgcctaggggtacttccaactcagatccacttaaaaattgtttttggcttagtgtttttccaatcacatagggaatatgatgttgggcttttctctgtgtgaatatcagcttgttatgcattttactggatttctttttagcctgtgttacctctccagcacagctaagtgggtacggcaaagtcttctgtggctgagttgttttctccccatttctcccttagggcactggcttttgagaagtcccaaatttgggggagaaaggaaatctttgataacctacttcccaggaccagacctcaggtcttttcttctctttcctcattttgtttcccctaaaagcaaagcctcagacaaaggtttttgtgtaattaactttggaagtaatcccagggagtaggagtgagggctggagagagaaagaaagagggaagcccgggacaaggtcgcattatttaaggggacctctgataggtgcttgattccataggatcttccaaggagtcttatgaaatgggagatacaaaaaagacacaatgagtatttgcttgtgtcaatcattggtcaagagtggcctcacagacatgaactcccctgaacttggggtctgcgcatgcataatggttcaggggattcccgagagcatctgccctgtggggtcagtgagactcagacaggaagggaggggtgggccccatgtgcccaaggtgaggcagcacctgcatgaggcccacagaacactcatcacctcagcagtggccagaatcagaactggggccaagcagactgaagtggtgcccaggaggtgcctggcacactggccatttacatcccagggtctcagaaagcacaggccccggtgcaggctcaccctgatggggtcatgctcttgttattctggcttctgactgattccctgtttaacacccttttatctgtgctttcacacacacatttttggtatttcattcagcatttttaggaagggatttctctattcagctagtctgcatatttccagatagagaaataaatggtcattgttttcaaatgtttacatatactttatttttaaatttttattatttgagatggagccttgctctgtcgcccaggctggagtgcagtggcacgatcttggctcactgcaacctcctgctactgggttcaagtgattctcctgcctcagcctcctgagtagctgggactacaggcgcgtgctaccacgcccggctaatttttgtatttttagtagagataaggttttgctatgttggccaggctggtctcaaactcctgacctcaagtgatcctcccacttcggcttcctaaagtgccggaattacaggcgtgagctactgcgcccggcctcaaaatgtttatatatacttcaatattctttttgttattatttgctaagtattgaaaccaagcattcctttctggagctcccataactcactttgtgccctgttttgaaaaacaggccagtcaataatgacagcagcaacgcagcagctcccagcttttcaacacctactgtgtggctgacacctgctgtggctttataggcattatgtcagtgaattctcaaaactaccctaaaatagtcactctggttcccttttttcatatattttttatttttaaaattgagacaaggttttgctgtgttgcccaggctgatttcaaattcctatgctcaagtgatcctcccacttcggcttctggttcccttttcccagccactggttcccttttcacagaagaggaaaccatggcctggaaaggggccaaggccacatagtatttacgtcaagcttgtccaacccacaactcacgggccacatgcggcccaggatggctttgaatgcagcccaacacaaattcataaactttcttaaaatattataatttttttttttttttttacaaaaaattagccaggcgtggtggtgcatgcctgtagtcccagctacttgggaggctgaggcaggagaattgcttgaacctgggaggcagaggttgcagtgaactgagaccgtgccactgcactccagcctgggcaatagagtgagactccatctcaaaaactaaaatataaaataaaataaaataaaaatttttttggcaaaattttttaagctcatcagctatcattagtgttagtgtattttatctgtggcccaagacaattcttcttcttccagtgtggcccagggaagccaaaagattagacacccctaataagttgttgagccaggattgtgtccaaagcttccccacttttactacatcgcatgcctttctatggaaaaaagccttcccttcttccctagtacttctcccaaaacacacactcatatagagtagcacttgagatccagtgccccttggcagccgattgcagtgggtaagctgagctcagggttgcaggccagcagggcggcagtcagcacacagagctttcctatccccccaggaaacctgcaaggaccccagtaggccttagatggccagtgttggcaaatcctaactgggaggcaaactgggagagcccactgccgttgcagactggttactgtccccgctggagccctgtggaagtgggtagaaatccaggcctaaggagggtaccaagccagagccacctgccccctagtaccccagcctgggggggccacccagtgagcatttctgtctcctcgggtgctgtagtcaaggtgaaaagcaagttgcaacctgaaggctgggcattccaggtatagggcttcttctggttaaaatgtgtgggtacggggactaggggaggcttggaaggggctgtccccagagtttctatgagtgaatatatactttgaaacacttagaaccttattgtcagcatggacagacagggaccttggggacagagggacattaaggccaacatcttgttttatagatcagtaaactgaggtccagagacccatggcctagcgaaggaggttcaagtgcaggccttcctgaccacagtgcaccgccaaggctccttctctacaccactgcatgtgtgcgtgtgagtgggcagctgcacaccatcgtatacgtaaacgtgtttacgcatggagtacatgtgctttatggtgcaggggtgaaggcacaaaggcgtgtgtatgggggggctggggtgttatactagcaggctgagcagactgtaacaaggggacacacatctctcttttgggccaacccatgtttggagaagacaggagctttctcatgcacaagcgccaagagaggaaagtgaacccaggtttgggcggtctgtggtgacttgtgccatggaccatgtggaagcctgaagatgcctggggccttcgtagtaccattgcctttagcctcccgtggccacctgcagcaactgccatcacccttactgtggacgggagttgcactgctaaagtccccacggccctgcaggatggccagagatgtctgccctcactccgctaccctctcagtcttctttgaccactctggtcccccaacctcaatgtcgaccccacatctgcaagtgacatcactgtccatgtagctctgtaagtcttcaaactgggagtcagcctacctcctgccatcactgaccttcaagcaatccagatgaaaaatgcctctgggcattttggggacaggagatataaggaatgagtcataaatatcctgtcatataaaataggatgctatgaaacactccccgggtcatgtcaaaaggagacaggagccaacctgaatacacttccaccagccaaaggcgagattttttgagcaccagtaagattaataactgcaatggattgacaccaatcagacatgtttaaatccactgattcacacatatttaaaaataactagtttttcaccttagggggatgctaggcagctggtaaataaagggaaagcattaaatatttgtcatgtcttttgcatatgatctatctctcaggataactaaataatcaatgagggcaagtttcactttgtagaaatatgcaggttaataaaataagaaataatacagttataatgtcactattttgcaattcctcatgaatttaagtaatgatcatccatggctgcagatgttgcaaaatgagacacaaccagaagttaggtgcttcctgatggaagcacatatcaccatctaggaggtggtcttgaaaaaaatagttggacgtgaatttgttcaagcctccctaactaaatacagaagacagaagacatgttaaatggtaccacagggttgcaatcaaccaaattcagactgtgggaaactgcaaggataaacaacctagtttccagcttggtgcggtagctcacgcctgtaattccaacactttgggaggctgaggctggtggatgacttgaggtcaggagttcgagaccagcctggccaacctggtgaaaccctgtctctactaaaaatacaaaatttagctgggtgtggtggcacacgcctgtaatcccagctactcgggaggctgaagctggagaatcacttgaaccctggaagctgaggttgcagggagccgatatcacgccactgcactccaggctgggtgatagcaagactcggtctccaaaaaaaaccaaaaaacaaaaacaaaattaaaaaaatcccccaatttccttaacaaaacagtattacaaaacaaaaagagacggaggggaaacttgcaggttttaagatttatcaaccaagccctatttatagactttatttgtatattaattcaaacacctgttaaaaaagaaaatgaggccaggaatggaggctcacacttgtaatcccagtgctttgggaggctgatgcgggtggatcacttgaggctaggagttccagattaacaaagtgggcaacaaagtgaaaccttgtttctacaaaaattttaaaaaattaccaggcatggtagtgcacgcctgtagttccagctactcaggagactgaggcagaaggattacttgagcccaggagtttgaggttgcagtgagctatagttgaaccactgaactccagcctgggtgacaaaacaacatcctgtctcaagaaaaaaaaaaaaagaaaaagaaaaaattataattgaagaaatagaaaacaccaactggattataatttccattaatgacttattattgatttttatatgataaagtagtgacttctttctttctttcttttcttccttgcctttcctttctttctttctttttttttttttttttgagacagattcttgctctgtcacccaggctgtagtgcagtggctcgatctcagctcactgcaagctctgcctcccaggttcacgccattctcctgcctcagcctcccaagtagctgggattacaggcgcccgccaccacgcccggctaattttttgtatttttagtagagagggggtttcactgtgttagccaggatggtctcgatctcctgaccttgtggtctgcctgcctcagcctcccaaagtgctggggttacaggcccaggaacaggataatgataatatctgttccaaacagtgtcttcactaaataatcccaaccagtaagaaatagaatcatttcaatcacaagactcaagtcactccaaaaagatgatgctaagagctgttgatcacgtgttcctacagcgatccataccaacatactgatgaagctacagctaaggtattaggctactgtgctcccatctaggaagtgacccccagggattcttcaccctgtgctttcaccagcactctgtatatgaacttaaccacctcagcactcccccctgcttttgccatgtcttctgtgtttggatgttgagtattgctggatggaaagctttgctatcagcagaacaatggttgaggttgtaaaagcctactaagtgccattctaaaatgggtcgttgtgctgtatgaaacaacaaccacaacaactcagaagcttcaaacaataatcctttattgtcacgctcatgacctgtgggtcagctgtacaattcagctgaaattgaatcgtaccttggttgatcgaggctagactccaagctgcaggctgagttcagatctgctcggcatgtccctcgttctcctgggaccagcggctacccagggattatggcctgttcctggagactcattcctggacccagaaggaaggagcagcagctatatggggcacgttcttgtcatggcagattactgcagcatgagaaggcatgtccaactgagcaagcacatttcaaaacttctcatgtcaggttcacaagtttcctactggccaaagcaagtcacatggccaaacacaaaatcaaaaggtgggaaagtattctctgtccaccatggcaaggatgtgggtggataattatattacaagggacaaataattcaatctttcacagtctttggggatccagggcactgcctttgttcatgccccagcacttctcatcaagacaaaagaacatcctgctaggagactttcctgccactagcagagccccttcaaacctagtggcagctagagtgattttttttttttttttaactagctctcctctagttttgtctgtttgtgtgtatggtaaaaaaatgcataagataaaatttaccatcttttttttttgagacagagttttgtcttgttgcacagggtggagtgcaatggtgcattcttggctcactgcaacctacgcctcccaggttcaagctattttcctgcctcagcctcccgagtagctgggattacaggcatgcgccaccacgcccagctaatttttgtatttttagttgagacagggtttcaccatgttagccaggctggtctcaaacttctgacctcaggtgattcaccagcctcagctcccaaagtgctgggattataggcgtgagccaccacacccatgcctggctcccctttccttttttttgttgttttttttttttgttttttttgcatagagtctcaccctgttgtccagactggagtacagtggtgtgaactcggctcactgcaacctctgcctcctgggttcaagcaattctcctgcgtcagccacctgagcagctgggactacagccgtgtaccaccacacctggctaattttcgtatttttagtagagacagggtttcaccatgttggccaggctagtctcgaactcctgacatcaagtgatccacctggcttggtctcccaaagtgctgggattacagacgtgagccactgtgcctggccaaaatttaccatcttaaccatttctaagtatagagttaagtaccgttagttaaattcgcattgttatggaagagctctccggaatttttttagcttgcaaaagtgaaactatacccatgaaactaacacctctgtatttccctctccccagcccctgacaaccactattctactttctgtttctatgaatttgactactatagacaactcatgtaagtagaatcacatagtatctgtgttttggggactggcttatttcacttaataagatgttctcaaggttcaaccatgttgtagcatgtgtcagaatttccttcctttttaaggctcaataatattccgttgtatgtatatacctcattttctttatccatttgtcagtggacacttgggttgcttttgacctcttggctattacaactagtgctgctgtaagcatagtgtggaaatatctccttgagatcctgttttcaattattttggctgtaaaaccagaagtgagatggttgggtcataggatagttctatttttagtgttttaggaacttccatattgtttcccatagtagctgccccattttacattcccaccagcagtgcagaagcattccagttttcacacattattgccaacacttgttattttctgttattttgatactaattatcctaatacgtgtgttttttttcttttttattttggagacaagagttttgctcttgtctcccaggctgaagtgcagtgacgcaatctcagcttactgcaacctctgcctcctgggttcaagtgattctcctgtctcagcctcctaagtagctggaattacaggtgcctgccaccacaactggctaattttttgtatttttagtagagacaggggttttaccatgttggccaggctggtctcgaactcctgacctcaggtgatccacctgcctcagcctcccaaagtgctgggattacaggcgtgagccacaatgccgggcctcaattttttaattaaattttttattttgagataattatagattcacatgcattataagaaataatatagacagattccatgtactcttcacctggtttccttctcatttcctcagtggcaacatcttgcacaatagtacaatatccacagccaggaaattgatattgatacaatccatagatcttgttcagatttcagcagcttacatattcagagtgacattttaaacaagcaaatctgatcctatcacttacctgcttaaaacttttccaaggatgttcattacataattgtttgaactggtttatttttgagacggagtctcgctctattgaccaggctggagtgcagtggtgtgatctcggctcactgcaagctccacctctgggttcatgccattctcctgcctcagcctcccaagtagctgggactactggcgcccaccaccatgcccggctaatttttgtatttttagtagagacggggtttcaccgtgttagccaggatggtctcgatctcctgaccttgtgatccgcccgcctcaccctccgaaagtgctgggattacaggcgtgaaccaccgcgctgggcctgaacttgttaaaaaatgagaaccaacctaaatgtccagcagcagcaggatggttgaatagattacattgcgtccatataataggcacacaatccagccaggaaaacttggagcagtcgtatgtacgctgatatgggctgggttccatggtctattcttttcctacggaaaaaagccaggtacaggattgtgaatacctggccgggcacggtggtgcacgccgtaatcccagcattttgggaggctgaggcgagtggatcacctgaggtcaggagtttgagaccagcctgactaacatggtgaaaccccatctctactaaatacaaaaaattagtggagtgtggtggcacatgcctgtaatcccagctacttgggaggctgaggcaggagaatcacttgaacccgggaggcagaggttgcagtgagccgagatcatgccattgcactccagcctgggcaacaagtgcgaaaccctgtctcaaacaaataaataaataaaaataaataaattgtggataccttttgggtataaaggcatacaatataggaaagggtacatagtacactgaccacagtagttgtctcagcaggctgagattgtgtagtgggatggaaagttaattcactctgttttgtagtggttctcaaagttctgcgtttgaagaacccctcaaagttcaggacccctctacactctaaaaattactcagtgtccccaaaaacattttcattaatgagggttatcagaaattaaagctaagaaatttaaaaaatatttacatattaattcatttagaaataacaataggccaggcgaggtggctcgtgcctgtaatcccaacaatttgggaggccaaggcaggctgatcacttgaactcggaagttcgagaccagcctggccaacatagtgaaatgccatctctacaaaatatacaaaaattaggctgggcgtggtggctcatgcctgtaaacccagcactttgggaggccaaggctggtggatcatgaggtcatgagatcgagaccatcctggctaacacggtgaaaccccgtctctactaaaaatacacaaaattagctgggtgtggtggcacacgcttgtagtcccagctacttgggaggctgaggcaggagaatggtgtgaacccgggaggcggagcttgcagtgagccgagatggtgccactgcactccagcctgggcaacagagcaagactccatctcaaaaaaaaaattatatatatatatacacacaaaaaaattagtcaggtgtggtggtggtgtgtgccagtagtcccagctacacaggaggctgagactggaaaatcacttaagcccaggatgcggaggttgcagtgagccgagattgtgccactgcaccccggcctgggcaacagagtaagaccctgtctcaaaaacaaaaaaaaaaaaaagaaaggaaataacaacaataaagcaattatatgttaatataaatgacagttttgtaaaaagtaactatcctttccaaaacaaaaacatttagtgagaaaaatgactttgttttgcatttttgcaaatctctttaatatctgacttaattgaaaaatcttcattctcatatctgtttctgcattcgatctatcagaatacattgttttggttggagtatgtgaagaaaattcatgtcagtaagatatgtagttagaaaaaagagactttaaatagccttttgtgggtattctttgatagcacatcgactggacaagcagcagtttctcaaagcaatgtagaatctgaaaccatagcaatgacatattcatactgttacattaaaactcattgttccggctgggcgccgtggctcatgcctgtaatcccagcaccttgggaggctgaggccagacgtattacatgaggccaggagtttgagactagacaggccaacatgacaaaaccccgcctctactaaaaatacaaaaattagctgggtttggtgatgcacatctctaattctagctacttgggaagctgaggcacaagaattgcttgaacccgggaggcagaggttgcagtgaaccgagattttgccactgaacgtcagcctgggtgacagagcaagactctgtctcaaacaacaaaacaaaacaaaagccattgctctctcttgtccccccacttttttttttaagacagggtttcactctgtcacccaggctagggtacagtggcttgatcatagctcattgcaacctcagactcctgagctcaagcaatcctcctgtctcagcctccttagtagctggaactataggtgtgtgccaccacacctggctaattttttattttttaaaataaagatggggtcttgctatgttgcccaggccggtctccagctcttcgcctctagtgatcctcccacctctacctgccaaagtgttgggattacaggcatgagccactatactcagccctgtcttgtaccttaagtgaatcttttatgtgagtgtagttctgtaacattatgcatttgtcatttggaaagtactgatagagttatgcagatcatccaatttttgacacattttgttagacaatattgaaaaatcatgtgtgttaatatcactactaatctcataagaaaattgtttaagtaaggctgggcacggtgactcatgcctgtaatcccagcactttgggaggccgaggtgggtacatcacctgaggtcaggagttcaagaccagcctggccaacatggtgaaaccccatctttactaaaaatacaaaaattagccaggtgtggtggcgtgtgcctgtaattccagttactcaggaggctgaggcaggagaattgcttgaacccaggaggcagaggttacagtgagctgagattatgtcattgcactccagcctgggtgacagagcaagactccatctcacacaaaaaaaaaaaaaagaaaagaaaggaaaaaaaaagtgtttaagtacttagaagcttgttaagctcacaatggtggatacacattttccaaaattctaacttttgcttgaaagctcaaattttatcattggcaacaaatgctgtcagttgcttttatggagtgacagtttcactttatttattgttaagaaatgtctgctaaataccagtcggaataaccatagtttgtcagtctttcaagtaaaaatggtgttctatgaaaaaagcagctagtttggctgacaactcagacaatcacacaagcgcttttccttagagaagcccatcatcctttggtaagcagcagaagtgctttctacatactcctcctttcatcacacaaaatatcaagcatagaaagatatatactgctcacagattgagagttaataaaagtattttttactgttccatcaaggtcattcataaatgaaatgtttttaaattgcaaatacatggcaatgaagaatacaatgctagcctgggcaacatactgagacaccgtctctacaaaaaataaaaaaatagccgatgtggtggtacgtgcctgtagttccagctaattggaggctgaagtgggaggatcgcttgagcccaggatgtcaaggctgcagtgtcagggaggaaaaacgttttgtctgcactcaggttcattgattagaggtctgtgaattaaactgacaaaggacagaataacaggagaaaaggcacacaacttttatgaatatttacctgcatgagagttcacagaaaagaactgaaactcaaagaagtcattagacatggggacttacacaacattttaacaaaggaaagagggtttgggcatcaagggtgacaaattgtggggaagtggctaggaaatatatgggggaacgaatggacgatagaggttattttagtaaggtctgtttatgcaaaatcatcttggtattcacaaagggaaatttatgccctgttttttgcagctaagaggaaagcagagaactcatcctgcaactgttgattcccagttgcattccactcaaaatagttcttctgccaaagtggcttattttggagtggcatattttgatcctctcaggcactactgccttaacttgtgttgaagcaatgacacgttcactcgccattgctctcaagcagtcagtcaaatgataacacatcatttgaatgaaaagggcatagaatgtctgagtattactataaacatagttttgaccttgcagatctctaagtatcttggggacctccagggtccataggccatactttgacaacactgctgttccgtattgtattacttgtttacttactttaaccaacaaataaataattttttcagacaggatcttgctctgttacccagactggtgtgcactggcataatcataactcactgcagccttgacctcccgggctccattgatcctcctgcctcagcctcctgagtagctggggctactggtgcatgccaccatgcccagctaatttttgtattttttgtagagttggggtttcaccatgttgcccaggctgatcagaaattcctgggctcaagtaatcctcccacctggcctcccaaagtgttcagattacaggtgtgagccaccacacccaaataaacaattttaaagcacctcttccatggctctctactgctgagtgtaaagtacagatgccttggcctaagatccaaagccttaagtgactggcctttgcctctttgccactggcatgtcctcgctctttatccaaacacaggtcaagccacagaagttactgggattcccagaacgtatttgcatgcgtttctgtccctgcgtccatctccattttctcccaagcattctttaagcccaagtaccacagtcaatctctctgactcctccaagaaaaggccattgcagccatgattagtgaagggctgcagatacacaagtaaggtgggatgcactgcaactcacctagcatcctcccagggcttactctgccataggatctctggtgccagacctaaaaatgtgtgcggaaggaatggaggcaggtgctggggagaggggaggcctgccaggaattctagaatgcaccaaaaaaggccacttccttctgttgccaaggtcctgggtctctatgctttagggcaagggtgtctggggatggtccttgtgaggggcaactggggaccctagtggggcaggcctagggctgccagataaaatatagaaagcttagttaaaattagatttaagataacaaatactcttttagtataagtatatcccaaatactgcatagaacctcctcatcctaaaaaaaaattcaatgtttatctgaaattcaaatgtaatggagtcctgtattgttgtttggtaaatctggcaatcccgtgtaggcctttgctattcagctcgctgagcaaagtggcccctcttcacttaccttgccacctaccagacctgcccagacctggtcctggctgcctccaggcagcacagcccactgaaaggaaccctttccgtcccaaagctgcccagagcctgagaacagaagcaaactgcgcgcttggatggatatggcggattaggctatgcctttggagaactaactcctctcggagaagggggctctctctcacagccaggaccttctggggtgcctatgcggagacgccctccttccttgacccacttcttctccccactccccgctgatgcccagccctctctctaaccttcctgagttgctgtctctgcaactccccctgccaggactggctatcaatcccttcagaaactaaagcccagtccagcccctgggaggcctcctgggtgtctgggattcccctggtgggatgcgtctggcctgaggttggagacaatgatgcgttcttcctcccagccagtggcttctctaccagccagactgctttgccttttctccttttaaggacctgagggcaaactctccttccctctgggaggacttctttcttccaaaggtcccagaggggggtgtgtcctttagcttgaggccctcgctttcctccattctcatgaccttgcccccttccctgtggagggtcttgttatgctgaaggcacctttccctccttccggactggcgttcctagcatccccacggaaaccgaaaatgcctcctgcagaaccatctggccacatggctccaatctgccctctctcccacccccggtttcccctcctggaagggggacacagggaaggaggcttaggcaaggcatccctggcgtgcctcagtccctgaggcataataatataatgattgttgctgtttcatgccactaagccttggggtgttttgttacataactgtaactggaatgtatttgatcacaggctccatcctgcaccaggagcagcctcgggttcgcgtgtgtgggagctgcagaatgcctgtacaaacttctataccctccccatgtccctttgcacaaacagcccccattggccatcctttgggcctagaagttcatatcctgctgcctgttcatgtcctgggaagcaacgtgggttggaggccagctgagctctggaaagtgggcttggggtctagaagaaggtcgtgggctccacatgggttcaagccttagtcccaatgggccgaggagcagaagaggaccacagtgaggttctctaaagcatatggcttagacaagggccccatgccacagctaagggcagtactagctgagcacttcatatctttcatctcttgtttgtttgcttgagaaagaggatctccttctgttgcccatgctggagtgcagtgactattcacaggcgcaatcacagctcacggcagacccaaactcctgacctcaggtgatcctcccacctcagcctcccaagtagctgggactacagacataagctactgcacccagcactatccgtcatcgcttgatcctcacccagtcctgttccattgggcttatcgtcttcattgccccagtgagagcaccaaggctcatagaaaagccagtcgcttgcccagggtcctgggacatatgtctgaagccaaggccaggagctctccattataccatatggcctcaaaggccctccttggttcaaagacacttgatggagcattttgtagaaacatcatctccttggctttgtttaaaatcaacatcaccacccacagccccccaccacacacacacaaaaaatatatctgtgcacagtggctcacgcctgtaatcctagcactttgggaggccgaggcaggcggattgcctgagctcagtagttcaagaccagcctggacaacacagcaaaaccccatctctactaaaaatagaaaaatattagccaggtgtggtggtgcatgcctgtagtcctagcttcttgggaggctgattcaggagaattgcttgaatctgggaggcagaggttgcagtgagctgagatcacatcactgcacttcagcctgggtaacagagcgagactctctccaaataataataataataataataataataaaataaacttcaaaactaaaacaactttaggctaactgggaaaactgaaataggaagacctcgccttgaccctagggaatgaagccaaaactcagagggctggaggtatccagctgcctagctgctgtccagctaggagcacagtttctttggaggtccccaaaccatgctggtggagcctcatctatctctttagctccccatcaaagggatcactttatcagctgcacagtctttaagcccaacgtccacagcaggactctcttttaaaacagtttggccttgagagaggcagtccgcttgttatctatgttttgttttgtgttggcttcctggcgagttatcagggagactttggtttctttgtcttctgttatctccctgctgggtttcaaagctgccctctgagctgctgtcagcctgagctgtgtcttcccctgcagggacagagagccggaggtggaaggggccacaactctaccagagccttcccttccagctgttgtctcctgggcgcccacccccagtgcctggaacttgccagctctcatcaaggctggctaggtgtcacttgtggcttctccaggggcatataacatcaagagagtgggcctcatagggccaagatcaggggaaaggaggggggtttgaaacaccctttacaaaaattataactaaggaaattatgacagtgaaagagatcagacctaactgactccatcttgcttctaacctttaagttgtcctggttcattcctggacatagacagaactaactttgggaaggaattcagtttatggtttgactcggaaacaaaattgataatagacctttcctgaaaagacccccttcttgcctaggacccgcctttgcacaactaacaaattagctacaagatgagaagctgtggtttaggggtcatgcagcctctggctccaagagtctgaacctccccaaattgctcctgtggataatatcactattgtaaaacctagatcagcgcttgagatattttgcagaccctgcactggatggatcaactgataccacccagactggtaatctggctcaaccagttctgccatcctacccaggaacagaagacagcaagaaaacatcacttaaatcccctattcaatccatctccaacctaaccaatcagcactccccgcctcccaagctcttacccaccaaattatcttttaagactctgatccccatatgcttgggaagactgatctgaataataataaaactctggtttcacccacagctggctctgtgtgaattactctttctccattgcagttcccctgtcttgataaatcggctctatctaggcagtgggcaaggtgaacccattgggcagttacatgttcacagagcagccactttctttaaaattgaggggctgagagtggtggctcatgcctgtaatcccagcatcttgggaggccgaggcaggtggattacctgagggcaggagtttgagaccagcctggccaacatggtgaaaccccgtcgctactaaaaatgcaaaaaaattatctgggcatggtggcagtgcttgtaatcccagccactccagaggctgaggcaggagaatcacttgaacccgagaggtggaggttgcagtgagctgaggtcacgccattgcactccagcctgggcaacaagagcgaaactctgtcttgaaaaataaataaataaaataaacttggggaaaccaacatagacttgtcactttacctttatatgtttgtttgccaactacaatacaaaaagcaacttatggccgggcacggtggctcacgcctgtaatcccagcactttgggaggctgaggcgggtggatcataaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagcaacttatattgcttaaaaagaaagaggatgttttaactcccagtgaataggaagaagccctttgaccctgaagtcctgtgaagggaaacaggcttagaaaagttggccctcctcaggagattgccaagtagtttaaggtttgggggaaattaaactcttcccagtttgggggatgcatctgaggggagtatcctggggcatagtgatgcaattacccgtcagtgaaaagaagacaaaggaggaaaaaaggaaacagctctttttttctttctccagagtctgaggctcaaaggaattccagtgatttaggatgcactcgtgaggagtgcaggcggaaaatgattggttacccatctggaaaggggaaaaacatgtccctttgttcctttctctttccagtgaatacccagggtacataaggaagataaaaaaaggcatccctttctttcttctgatcttatatccccaagttgcagaaactttgcaggtgccacccatgggtgcaagtgtgaccttcacccatgtagcagggaggcctaatgggtagggatattcgcacttacctatgtgccaccctatcctcctgctgttggtaacctttgggttccctataccttctctatgccatggatgtgagcatgacttccatccatgaagcaggagggcctagttggcaggaattagtcatgctcacctgcgctgtgcctccttcctgaggtcaagcttctccgccctgcagaacataatttggccacagctttgtgcaaaggaatatgagatgtcttttctgtgtctcatggtgcttggcactacattggcaaccaaggaaatgacagggacatttttgccatgaatttacttgcagataccaaggcacactttacctcatctgtgctactcttaaccttccagtttatacttttgatgattaagccaaatgctcattctacccagtaatatctgtggtttgcaacaacatccttaacatttaacactgtatataaagaagagataggaaccatgagagccatgaaagaaagaaagaaaagaacaataggaaagactggaggtcctagggccgacacccttatgggcagttggggcctggagttagtcaaggagcctttggataacaccaagatgtggccttggtgagataccctcagttgccccaggacctccttctggtcccatgcgatggctagacctccatgaagggaaactagattggaacaaagccaacattcccaacacccgaaggtgatgggggattgacattgtcctccccagcaagcctgtcctccatttcttaagtctggcagctgtgctagttgcttttaattggctgacagaggcctggtattttttctttcattttggctactgtggagtctgaaaaaaggacagaatgagcagatccagccaggcacagcagctcatgcctgtaatcccagcactttgggaggtcaaggcaggcaaatcacttgaggtctgaagttcgagaccagcctggccaacatggtgaaaccccacctctactaaaaatacaaaaattattctaggtgttatggcacatgcctgtaattccagctacttgggaggctgaggcaggacaatcacttgaacctggaagatggaggctgcagtgagccaagatcacaccactgcactccagcttgggtgacagagtgagactccatctcaaaaaaaaaaagaaaaaagtaagaaagaaaagatccacttttattcacccttccacagatcctggatgagcccccaaaatgttacaggatccttggggtgtcactttgccagctggaaacctctgtggccagtggcacctttgcccgagtttttctctggcctgctgggctcattctgcccactcacactggcaggctgctcttggctcacgctaccggcctggatcccacacctgccaggggtgagccaggcgtagtgtagtgaggggtatgtgagcgagcatgggctccaaccactgtgcacagccaggcactctggctgcagcagggtgagcagctccaggtgctggcatgggcaatggcttcctgcaaggctgcagctggaccaggcataccataagtagctaccacagttgatgctggggaatgttatggtgcccagaagcttggagatgccaggaaccacagagccctaaagggtgtcacggccctggtttggggagctcctaggtctaggctccctgaagggctgtagctcttctctccttctctcttctctccttcttgtcatgtacaacatggtgagcaaggggcatgtttcagccctgtttgtgttgtagctcttttagccctgtcatttggcaggtcccaagttcttgtcctgcatccaggaagaatgaggtatgcagacaagcgaagggtgagcaagatgaagagaagctttattgagtgacagaacagcttagaggagacctgaaataggtagctcctttctgtagccagggtgtcccaatgagtgttcagctctcaggagagacggtagctcctctctgcagctggtcatcatgttgtctcttcagctctcagcagagagggtagctcctctctgcagctggttgtcccatcatcttctcaagtctggctgagtccagggcttttatgggcctcagaggggaggaagcgcatgtcagttggtccatgggaaaccatgtgcagccccagaaaaagcatcacaagttcccactctggtttgtgggaccagcagtgtagtccccagctacaggccctcgccagcttcaaggtgaggcttcactggggaacttttcctttctgcccaggagcctgtctcctgcctctgttcatgatgtccaggctgttcataccaaagggcacctggaggccagtgccaagctgccctcagcacccccttggcctccctctggtgcttgctggtgcccaaagtcaggagggggctaaggtggcagggggctggcgtgttaacactgccctgagtgtacacacacatggctgggttgcgacagtgcccaggcttggccccaaccttgctctgagatcggagcagttgccaggagttgacagagatcaggcagtgagataagacacctcagagcctgcagggggaagggggtggccttcctagggctccaaaagtgcagagaggcctgggtccacagctgcagctgagtggctgcagctgctccttgggagggtggggcttctacctgctcccagcccccaaaagcacagggaggcctgggtccacagctgtgacttgggtggccacagccacgcccaggaatgccaggcccctgtctgctcctggctctcactggctccttggagtgtggcactggcctgggcccagctccatatcagggcccctttctgcccacccctccatgctcaattacactgctcccccgtcagtgggtgactcagcccagcctcatcacagtggctcccagggcagtggactctagggggctcccagggacaggctccagggagtgcctgcctgcctcctgtctgcattttccctgcagcagtcatgggcaaggtgcaggtggtgctgtagccccagtcaaccccacacaaacaaaccaaatgctcttggggctggccccaagagtccccaactgtgcccttggccaggcgtgcaagattgtgaccacggtggagactctgggtctgggagcaggttctgcccagccatgagaggatgggggtggtgcagctgactgcctcagggatgcagggcacaggggacatggggcacaggagtcccactactgccactgctgctcccacagctgctcctgccaccaccgcccatgcctccctactgcagccagtgtgatggcagcagccactttagacggccccctgctgccatcaaaagcagaggccaggcaccgtggctcatgcctgtaatcccagcactttgggaggctgaggcaggcaaatcatgaggtcagcagttcaagaccagcatggccaacatggtgaaaccccatctctactaaaaatacaaaaaattagctgggtgtagtggcaggagcctgtaattccagctattcgggaggctgaggcaggagaatcgcttgaaccctggaggcggaggttgcagtgagctgagatcgtgccactacactccaggccaggcaacagagccagactccatctcaaaaaaaaaaaaaaaaaaaaaagcacagcagaattttttaagaacattgttctgttctaaaaaaaattgtaaagggttataaaaggtttataagaatcttaccttggctgggcacggtggctcacgcctgcaatcccatcactttgggaggccgaggtgggtggatcacgaggtcaggaaatcgagtccatcctggcgaacatggtgaaaccccgtctctactaaaaaatacaaaataaattagccaggcatggtaacgggtgcctgtagtcccagctactcgggaggctgaggcaggagaatggtgtgaacctgggaggcagagcttgcagtgagccaagatcacgccactgcactccagcctgggtgacagagtgagactctgtctcaaaaaaaaaaaaaaaaaaaaaagaatcttaccttatggtcaagctaattaaaactggatacacttatagaattttattaaaaactagctttagcattaaagatgcactaatgcatacatgaaatttagtttttttttttgtttgaaaaagatttttatgtaacattaagagacaatgaaagatttttgtttgtcttttaagtgaactacaaaaagcactggtgggaggggagagagaagagacagagtcagttggcctcatgtcttcattgggtattgtttataaagctgaatctcctctctatcagaataaagatttttccttaaaaaaaccaaaaaaacaaaaaagaaactttttttgagatgaagtcttgctctgtcacccaggctggagtgcagtggcacaatcttggctcactacaacctctgcctcctgggttcaagagattcccctgccttagcctccctagtatctgggattacaggcccatgccaccatgcccagctaatttttgtattagtagagacagggttttggcatgttggccaggctggtcttgaattcctgatctcaagagatctacccaccttggccttccaaagtgctgggattacagggtgagccacagtacccaggctaaaaaatttttgagttattattttggttaaatgaatgacttatggtaacctaggattctattttgtaatatccaatgttttaagcctttgatatttaacaaacctttcaaaatcaagctctaagttaaaaagagaaaaaaattaggtgccctgaagtccaaaaagacatattcagcttatttaatgtattaataccatgcaggaaacattgtcaaatataaaatggtgtttaactttctttgggttatatttatataaatttgtttttagtatgtgttgcaaaattgtatagggttcctgtaattctgatatgctacagtatatgttattaataattataattgttgtgttgaattattgtgtgccacagaggtaacaaatttccttgtcaactgtgtctttgactgtggcttccctaaatgcttttgtcatccacagtcaattgctgtctttccttggtcctctttagaaagtggttttataatcagctattaaatgttgacaggtgctcttgaatgaaagtttctgataactatggagattattattattattattattattatttgagacggagttttgctctttttgccctggctggagtgcagtggcgcgattttggctcactgcaacctccgcctcctgagttcaagggattctcctgccttaacctcctgagtagcttgagattacaggcgcccaccaccatgtctggctaattttttgtatttttagtagaaatggggtttcaacatgttggccaggctggtctcgaactcctgacctcaggtgatccatccgccttggcctcctaaagtgcagggattacaggcattacccactgtgcccagtcactatagagattattacattacaataaagaaaaaaactttcaggactctcatggagagctgaaatgttcatgaatatcaagcagaacaggagttaactgaatagactcaaccaatagaaaattaaagcaattttttttttttttgcttaaaagattgctgatcctttttgtttctcagagttaagaaaacttttcttttgagctattttcagcttttaacaattgagtaaagtatattcctgtgaacaaaatttgaagcatatttgtttctctttacccgatttctccagattttggaaactatttgtgagtattcttaacttaatggcaatatagttatttgcataagtacaataagaatgttttcttttgcaacaggacacagttggagaaactggttattttaccaaaactttgactggaatgacgtgctttcctttaaggaattaaacttgacttatagagccaataaaatccccttgggaaaactggcctcataccttgtctacacagtccctgtacagggttcctgatttgtgataagtaaagaatgtcactttctgagagtcccaggagccccgagttatcttgggacctcaagaggagaggaatttacccaactcataggcatttgagggtacaaacccatggctggtctcagctttaaaaaagtcttatctgagattcttttggaacacagttccttcaaagccaattttttaaaatttatttttatttattaattattttgaggtggagttttgcgcttgtcacccaggctggagtgcaatggcacaatctcaggtcactgcaacctctacctcccaggttcaaacgattctcctgctttagcctcctgagtagctgggattccaggttcctgccaccacgcctgcaaagccaattttaaaagcctatgtgaggccaggcacagtggctcatgcctgtaatcctaatcccagcactttgggaggccgaggtgggtggatcacgaggtcaggagtttgagaccagcctggccaacatggtgaaaccccgtctctattaaaaatacaaaaaaattagctgggcatggtggtgggcacctgtaatcccagctacttgggaggcctaggcaaggagaatcacttgaacctgggaggcagaggttgcagtgagccgagaccgcaccattgcactccagcctgggagacagtgtgagactctgtctcaaaaaaaaaaaaaaaaaaagcctgatgtgaaaaataattattcttgctgtgccttatgcaaataatcagaccaagtataatacaactaaagtttattttccaaacaaatcagtcctattataatttgtttttaataaaaataaggactgcagagagaaaaattatgttccaaaaactacagtatacttattgttagttgtttttgagtttttatttgtatttttcttcaatttagactaaatcctgaatgttttttggactacaagtccccaaactaatgctttcaaatctttacttctaaaacggggaattgcactccttatcctagaactcattatttgccttatagtacactgtcaatttaaatgctgtactgaaactatagatgatgaagccaccatggcaaaattataactgagacagtgaaagagatctgagctaaccaagtccatcttgcttctaacctccaagctgtccttattcattcatgggcgtaggctgaactgactttgggaagaatttggtttatagtttatagtttaaaacaaagatgatgacagacttttccaaagggaaatccctttcttgcctggggaccagactgcctttgtaggactaacaaattagccacaagattagaaattatggtttaggagtcatgctgctggaggctataagattctgaccctccctaaactgctcctaagatcggtgcttgagatattttacagacctaggacttgatgatcagctggcaccacccacatccataaactggctcatctgatcttgtggtccccacccaggaactgactcagtgcaacaactgtctctgacctgaccaatcagcaccccagtgctggctcattggcttctccccacccaccaagttgtccttaaaaactctgatcctggaatgctctgggagactgatttaagtaataaaacttcagtctcctacacagctcactctgtgtgaattactctttctctattgcaattcccctgttttgacaaatcagctctgtctaggcagtgggcaaggtgaacccattgagaggttacaatgagaatagtaacacctttgtcatgaaagccccagaaccccagctcagtatgctgagtatgtgggagtatgctcagacagctcagacagctgcaaagcagttccattcctctcaccttggggtcaacacctacccgttccatgccccctgtcagcaggaagaatccagagcgattgacaaccttttcccatcttcatagcccacaccttaagaataagatactatgaaaccaaaagggggggattgaaactgcctttgcaaaaattataactgaggaaattatgacagcaaaagagatcagacctaactgactctatcttgcttctaacctttaagctgtcctggttcattcctgagtataggctgaactaactttgggaaggaattcagttcatggcttgactctgaaacaaaattggtaacagccctttcccgaaaagacccccttcttgcctggggaccagtctgcctttgcaggactaacaattagctacaagattagaaattatggtttaaagatgggtgcagtggctcacttctgtaatcccagcactttgggaggctgaggcaggtggatcacttgaggtcaggagttcaagaccagcctggccaacatggtgaaaccccatctctactaaaagtacaaaaatcagctgggtgtagtggtacacatcaatagtcccagctaccctggaggctgaggcaggagaatcacttgaacccaggaggtggaggttgaagtgagctgagattgtgtcattgcactccagcctgggtgacagagggaggctctgtctcaaaaaaaaaaaaaaaaaaagattgtgttctctactcccagccccaccctctcccaaaaaaggacagctggcaacctcgcatgattcccaaagcctgggctacactggccactgggcagatattaagacccagatctgaggaaaggaggttcttggaatctcacagggctgcctggtcctcacacgcatcaggctgtttgctcaccgtgcttcccgtggcacactcacactcacactcatcattcacactcaggtcaggcatctcctccttccagcagggctggcttcatgggatgagagctgtgaggtcacacagagccctgtgctcagtagggccctgtgcttagtttaatcctctgctgctgacatcttgaaatctgaataagaagccttgcactttcgttttacactgggccatacaaataatgtaacatacttccataacatctttttcttttttaaagaattttattaaccatactattccttgcaaagcagggtgaattcataggcagtgtgcccagagttggcccataatatctttctgatgtcacctctcaatctaagttgaatctggtgcctctcctgggctcacacagcccccctgctcactcccctccctaacagccctgatccctctaaactgtaagcctttactcacttatctctctaccctctagactgagctccttgagggctggggcagtctatctgtacaacaccatacttaacacacagtaagtactcattaaatgtgtgctgaaatgaacagaaataggaaggcctggtccagttccctacatgattctggccagagcagggtttaaacccatgtctcttactttagggcaaagacaacccttgctaccctctcactctcctgatcgatagccaaaggctaaaatcaacccagatcaaagccaaatataaatttgtttttctgacctagggcccaaattaatgcattttgtttttctcaaaggtactctgttgttttctagaacagttcaagccaactaatccaaaaatcttaacactcaagggggagtgggggccctgctgggtcacagggggttcaaactggttccagaggaactggtgagctgtgggcagtccacattcttatgtgtgtgggggggcagaggttggggggttcagtggggaatgctgaggctggattttacaggggtcagaaaaggaagggaggatatggcttatactagttctgccaaatctaccatgtaacctccttacagccattcattcattcattcactcactcattcatccattcaaacaggggatgaggagggtgtgccaagcaccagaaaggaagggcacaggtctgctttctagagctgcagtctccatgaaagagtttttgaaggatggaatgaccaggcctgggcaaactgacttctggacaattctggagtgtgggtacagatgatcagtgcttggctggtcagaaaagggaaagccaggaatgtgggggaggtgaaaacaaaatgtttctattctctaaattcacaaaagggcagggaagggagcggccaggctcagtggctcaagtctgtagtcccagccttttgggaggtggccaaggttggaggattgcttgaggacaggagttcaagaccagcctgggcaacatagcaagaccctgtctctaccaaaaatacataaattagcagggtgtggtggcacatgcctgcagtcccagctactatactcaggaggccgagttgggaggactgcttgagcccaggagtttgaggctgcagtgagccatgatcgtgccactgcactccagcctgggtgacagagccagactctgtcttttaaaagcaagtaaaaaggcggggggtgggggactgttttgagaactagtctgaagccaggaacaagtcacacagacttattttcaacctggtccaatcagtcattgatcacgttacttcagtcccctgagagccaaccaatcagcaacagcttcattccagggaccatgcttctgagagccagccaatcagcaagggtcttactccagtgatttgcttctgaaagtcagccaatccctaactgccaagactgaaagtcagccaatctgcacacagtccaacttttgaaaatcagcgaattgctgaatgccatgctttccataccctatataatatcagctctagggttgctttggatctggggtttttgtaagtaaagttagatttttttttttcggtactgcaagtactgaattcagcctcattgtctctgaaatatatcctggagaaggaggacttgaactcttacatgtcccagtggcccatacgggggtctgtggtactgccccctccccccacacacccccatcccaaggctgggcaggtccctgggccccctggccacagccacttcactagcagtttcagggcctcctggccacttctctaaaatcccatcctgttctttctcctgtggtttcctgagaagtagggagggaggctgtggttaaagagactgggtggagggggtttctccacaaagccttccatggggcccacaggcaagggggaggggctcagtctaaggggggtacactgaggggaagacacagcctgctctccaagtggcagtctgagagggacactgatggatggggggcacattccagggcatcacgtctgactgggtaacgtagtctgatgggagaggcaggatgcctaagtgtgcccaggaaaacaactctggtgatccaaggccgcagagggtcaggtctatcttctggggcatgtactaagtactgaggtgggttggggacgaggatgcagagagtaagtcagagaaggcttcgtggtggaagtgaagcttagggccagagcgcctcccccagccatgctgctgggtcagggcatggaagaggacaacagggctcacccctctttcttctcccaatcctctcccgcagtgtcccacaggccaagcctctgatgaggtaaacccaaggctggagatcctttcagaagagagctcctgtgggctttggaagaggggacccgggttggcctggaagaagggtgggatgggccactgagagtggctggagcaataaacagaatgaggttgctgtgaaggttccggatcctttgccggctctgccccgtcccaccccttcccaaacaccgtctccacccctcccctccccggcagaacccagtcttctctgtgcagtgggtacagtacccacccatgccccctcccatgcccagcagtctggctggggtgctctgtccttggcctctccacccccaccgtcatccccatgcaaacctcaaagaggctgacttggcgtagcatttgcctgcacttacctgtggctcttctgtttggagccagccagaaactcctgagtttggttccaaggtgctctacccctcctgcctgcgggaggactaggttcctcaatccttctcctgaggtcaggctgggactagagtgaggcaagcaaggtgcctagggcaaaattttaaggaggcttgccctcccaggtgcacctgaatggccctgagggccagtgcccccttaaattgtgggcccttaggtgcctccttgctttacccaccatgcccccagccagccctgaccctgctgggtgttctggcctcgagagtctgaaatcttataaaatatgccctaaaagctggtagtccggagtccttgggctggcctgggcagccaggtgcctgtcctccccatctcctgcccttagcccttttgggagaggaagccagaagtgctgaagcctggggcggctgggactgcgagatcggtataaggatgggggacctccaccctcaaggaactgaaaaccatgtggaaggaacagaatggtctgcccgcaggggaaaccaagcaaaccaggcctttgattgggaccaaagacagatgtgaaacccaggactctgagctgaccttgactccaccgagctctgccctggggatcaccgggcacctccaagagagatctgaatggctctgggagatgccaggctgaaacaggggacttaggtcccaggtctctgatggaaattagctgtggaaggggacaggtgtgagcaccaggaaagataaggcagtaagggaccctgcctgtgtgtgtcaggagcagggatctgagaggggtctcccacatctccatgcccaggcctcagtacttgggggggtccctggggcaaccctccccctatctcggccactggggctggggcctgtgccctgggtcctctctgcaggtagcatggtcatgccagagcccttgggcatcctttcaaaacttaccttgagccaggagcctccctgttgagatctttgtctaattgggtcttggggtgtcccttggagaggtaccataagccgagatagccgctctctaaggggcgaggggagttagggttgggcgtgtgtcaggtgagacacatggaataacaggagcctttcattactcacagatccatgagagaagccagcgccgatgagggccaacaggaatcccggagacagcagggtgttcaagtagcaggtagagagtgagagagagaggggacctgtgggaccaaggcctttatggggtccagggcgtcacccaggcaggtttcctgaggggagtaataattgggtttaggccaggtgccggtggctcacgcctgtactttgggaggccgaggcgggtggatcacgaggtcaagagattgagaccatcctggaaaacattgtgaaaccccgtctctactaaaaatacaaaaattagctgggcgtggtggtgcgcacctgtagtcccagctactcaggaggctgaggcaggagaatggcttgaacccgggaggcggagcttgcagtgagccaggattgcgccactgcactccagcctgggtgacagagcgagactccatctcaaaaataaataaataaaataaaataaaataaaataaaataaaataaaataattggtgagtttagagcaagcagggtcacgctatggctgagagagggtcactggcctatctgcaacagtccatgcgggctgtggggtcagcgggaccagtcaagtgggctgtatgtagctgtcccacagggaggcagtcaccgggagatgactgtctaaggtagatatctggattgagcacatagaggaactgggaggaagcagggagctggaaacagtgtcaaggttgactgagccctgcttctaatgtaagaaagtccagattatattcaaaacggatgccagggcaacattaaagtacaggaattcactacactccctctgtgcctgggtcactgtttatggtcctcaggagggggggccctgctcattggcctcttctggtactcgggtggggttggggtggtctgtagccccatgagggcaggatgggggcaaaccaagtgtagggcgagcatccccctatgtcttgggaggtactgagctagagctacaatgtgtggatggggggtgctccccaattagtctaggctgcgccttctgcattccattctctgcatgtctggaaggcctgagctcatgggacagaccccaccctggcacctggtgggcggggcattgctttcaagaggtcacctttgtttgggaaaggaaaaaacaaagacgacatagctggctggcgattctgagtctcacctcccagggtgtggagtgagcccaaactccttgcctcccacatctcccctgccacctttcccagggccgggaaacccccaggaggatcgagactcagcttccacccaacccctagaagacctctaatggtcaggcctccagccttggcttgcatccctccagtgatgggtagctcactgccccccagagagtattaggtcattaaaacaaaaacaaaaacaaaaacagattttggaggtggaactgagaggcagtggcctggggaagctggaaggactggatcatgagccagaattgctagggcagacaccacaccactgaccccacacctggaacagtgtctggggctatgtcagctaatggggtaaggttccagggaggcagattccagctcaataagaagggccaggccgggtgcggtggctcacacctgtaatcccagcactttgggaggccaaggcgggagaatcacgaggtcaggagatcaagaccatcctggctaacatggtgaaaccccgtctctactaaaaaaaaaaaaatacaaaaaaaattagctgggcatagtggtgggcgcctgtagtcccagctactcaggagtctgaggcaggagaatggcgtgaacccaggaggcagagcttgcagtgagccgagatggcgccactgcactccagcctgggcaacagagcgagactccgtctcaaaaaacaaaaaacaaaaaaacaaaaacaagaagggccagccatggtggctcacccctgtaatcccagcactttgggaggccaaggcggctggatcacttgagcccaggagtttgagaccagcctggacaacatggtgaaaacccatctctacaaaaaatacaaaaattagctgggtatggtggcgcacacctgtagtcccagctgcttgggaggctgaggtacgagaagtgcttgaacccaggaggtggaggttgcagtaagctgagattacaccactgcactgcagcctgagtgacagagcaagatcctgtctcaaaaaataaaaaatgaaaagaagaaggactacagacttcctctcagcagagccaggggccagtgataaggtgttttgggggagctaatgagttctttgtcactggaggagtgcaagtagagagtagcccatcatcaggactgccagggcttccggaaggtccccagctaaagggataggaccctacctactctggaaggatgaccaggaaatgtatcctgtccccaaatcccagctggcctgtctgagatggctggggggtgggggatggggaagtggagcctgggggtcacctgcgcgtcccactttcaggaatacccgcctctgggcatcagtagtttgcccttagcttcttcctccagccacatttccatctcggctggtcccctgactcaaccccttctcacagccaggtgaaggcaggactggggtcagatgccaactgtgcctagcattggattaggacacccctgtctccctcagactcttcagggctggacgctgcctacctctagtgccttttggacccaggtgggtgaggcggcccttctgagggccgcggcttgctgctggggtaaagtggctgatgtctgacaatagaccttcccctctcgcctgaccctcccagggagagtggcttcccagccaggctcaggcagggccaggctgcttcacaggcagtgggggtgcgctcacagggaagtggggtttggcgacactgcccaggggaggtgtttggggccagaagtggatctctgagccctaggaccctacaggtctgcccactctgggtgtggggcagcaatatgcaagtcccccctgcagtgccccagccagtcctcgggcgtcccttctccctctccctcctgcctgatggcccagggaagccaggtctggacagtccccaaggagacacctgccttaaactcccccccaggagatgtgccttccttctctcagcctcagtttccccatttgaaccatctttatgagcctgtctcatgtgaactgaggtctgggaggttatcctgccagggctgggagtagggttggaggtggggaggtcttggaggccacagaaagaaggaggccgtctcagccctgggaactgacatcatgcgtgtggccgtcagccactggcccaagggtgacagattctatcctaatagaatagaataaagcctatctatctgccttttattctcaccatgtgctggtaattctgaacaatgtcagtgatacaatacttctttctgaaaaagtattttattggtcaaagttctaaacgattgcatgattactgtggaatgttaataatttataaaatgagcttcaaagtaacacctttattctttattagcagcttatttttaaataaacattgtatgctatgtgaaagtcaaatcagagaatgatttccctgttatacagattgcagacttagctgcaatcctgtatttgtatttcatttgtaattcctaaccagttcctccttcctcccttctttgctatagttgctattttccaagccctgtggtacatgtccccatgtttaatcagttgattataaataaacagtggtagaacactgattgtaaagacaaagacacagaacatgagttccttcaattctgccactctatatgacagcttggaggttttatctgtgtttggaattgaaaacaaatagcggaaaccaggagatgtcatgtttttgtttttgtttttgagatagagtctcgctctgttgcccaggctggagtgcagtggtgcgatctcggctcactgcaacctccgcctcccaggttcaagtgattctcctgcctcagccacccaagtagctgggattacaggtgtgcgccactacacctagttaatttttgtatttttggtagagatggtgtttcaccatgttggccaggctggtcttgaactcctgacctctagtgatccactcgcctcagcctcccaaaattctgggattacaagcgtgagccaccgcccctggccatgtttttatttaataaatgcaaattttagttcattattgtcttagtctgttccttctgctataagaaaattacctggctgggtgtggtgcctcacgcctgtaatctcagtactttgggaggccaaggtggagaatcccttgaacccaggaagttgaggctgcagcgagccatgatcacaccactgcactccagcctgggcaacagagggagatcctgtctaaaaagagggggaaaaattatcttagagtagattatttatttatttatttttgagacagagttttgctcttgttgcccaggctggagtgcaatggcccaatcttagctcactgcaacctctgcctcctgggttcaaatgattctcctgcctcagtctcccaagtagctgggattacgggcaccctccaccatgcctggctaattttttgtatttttagtagagaggggtttcaccatgttggccaggttggtctcgaactcctgacctcaggtgatccacctgcctcggcctcccaaaatgctgggattataggcatgagccactgctcccggcctagagtagataatttataaacaacaaaaatgtattgctcacagatctggaggctgggaagtccaagatcaaggcaccagaagattcagtgtctggtgaagcctgctctctgcttccaagatggtgccttctcattgcatcctcacacagcagaagacacgaatgctgtgtcctctcatggtggaaagccaaaagggacaaacaggctccctcaagcccttttataagggtactaatcccattcatgagagcagaccctcacaacctcatcacttcccaaagcccccacctcctaacaccattaccctgggggttaggtttcaacatatgaattttgggaggacaccaatattcagatcatagcaattatgaaatatatttgtttcatttcatgatacttactgtataatcatgtagagggaagggttaaagaatgttccactgtgagagtcaaatgtgctatgtgtatgctgctggcttgtacagctctgcaaaaggggacccagccagttccatgcctggggagaccttgactccatgaggagggctggggaagtggtcagcctctctggtcagaggaatggcctgggccggacctccaatcctgggcttcccagcccaaccataacaactctccatctcagctcaattcatctatgaatgaggttctccagggatagcctacagccgccttattgcactgggtggaggggcagagggacgcaatagctttaggttagccctgagcaaatgctgataaggagcagaagttccaagggcaccaacttgggccaggcagggcagactggacagtggctagaaaactggcagatgccctccagccttactctgccatcctctatcctaccctgccctctcccctgtcatgatagaagggatacaaaatatacctctgtggcataaggattattttgagtgggtgacatttgagaatcaacagatgcaggaagaaactttttttttcttttcctgaactccctttatctgcctaaaagctgagcctcccaaaagaattcaaatgtcataaatcccctccccagagtttgagagtttcccagtcagggaagatgggctccttttatgagactagaagagaaatcacaccaagataagagatcaactaaaccaacattgtcacaaaactatcatatctcccatcttttctcctaagggtccatttacctttcctaaaaggcgcttgtcttcccaaaagtgtcttttctcttttttccttcccctattaagatgttacgtcagcctcaaattctaaatcactttttgagtcacattttcagtgagttccttcttttctatgtgaataaattttgtctttcagattagaaattattagaataaaaaaattagaataaaaattattctaattattctaataattatataataattattctaattattctaattattctaattattctaataattattattctaataatgttgtctttgtgcctattactagtttatcagtttaatttgcaggctctgaagcactgaactgaacctatgtgggtagaggaaaagtttttcctcccaacatgattatttactcacttacttatcttcttttttttttttttttgagacagagtctcactcggtcacccaggctggagtgcagtggcgcaatctcaggctcattgcaaccccgcctcttgagttcatgtaattctcctgcctcagcctcctgagtagctgggattacaggcgcctgccactccacccagctaatttttgtatttttagtataaacagggtttccccatgttggccaggctggtcttgaactcctgacttcaggtgatccacccaccttggcctctgaaagtgctgggattataggggtgagccagcgtgcccagcctcccaacatgattagaataaaaataatcctggccccagccacggtggctcacccctgtaatcccaggacactgggaggccgaggcaggtggatcacaaggtcaggagatcgagactgtcttggctaacatggtgaaaccctgtctctactaaaaaaatgcaaaaaatctgctgggcgtggtggtgggcacatgcagtcccagctactggggaggctgatcgctccactgcactccagcccgggcgacagactgagactccatctcaaaaagaaaaaaaataataatcctaggtaaccttcgttgcacatgtgctatatgccaggtcctgttctaaacctttatatatgttatcgaatgtattcttcccaacaaccctttgagatgagtgctattgttacatccactttataaatgcaaaattgaggtgcaaagaggttaagtcactggcctaaggcacagagaataggtgatggaactggaatttgaacctagtgatttccagagcttaagctctaaatttgcacgaggctacaggtgttgtgagtcctgcttctggctctgccaccactggctaggtaaccttgggcctcagtttccctgtcttcaaagtgaggtggtaagttccctcttggctctgacagtcctcaatcacaagacactggggctggcaaggaggacactaacttgagcgtgatctgtctacatggtcagcagagggaatgtcatgctaccagactccattagctgctgactgggggctttgtactgaaggcctgagactcaagcattctacccagctctgctactgccttgctttggggctttgggccagttgcctgcccctcctgagtctcagtgcctttgtctctcatctgcttggtccttagtctatgggagcagaggagcggtataaactatatagagtaaactcacagtacagagtctgttactgcctgatagtctgttactgcatgaactgtgactctcaagttccagtgctacagtgaccacagcatcttatcagtttcaacagaagagggttgattatttgcatatttatttatttatttgagatagagtctcgctgtctctcagtctggagtgcagtggcataatcttggctcactgcaacctccacctccagggttcaagcaattcttatgcctcagccccccaagtagctgggattacagacatgcaccaccaggcccagctaatttttgtattagtagagatggggtttcaccatgttggccaggctggtctcaaactcctggcctcaagtgatccgcctgcctcggcctcccaaagtgctgggattacaggtgtgagccactgcccccggcctacaaacctgtctctgttagcagaatacataattgtctatgcagaaaatcacaaagaatctacaaaaaagcaactataactaataagtgaatttagcaaggttacaggataaaaggttaaccgagaaaaatcattatgtttctatatattaggaatgactgattaaaatgggaatttaaaaaacggtgccattttaagtaccataaaaaacatgaaatacttggcataaatctaacaaaacaaggtgccaagtcaattcaatgaagaaataacagtcttttcaacaaattttgctggaagaattaaacattcaatttttaattttaattttaattttattattttttgagatggggtcttgctatgttgccaaggctggtcttgaactcctgggttcaagtgttccacctacctcagcctcccaaagtgctgggattataggtgtgtgccaccacacccagctaatttttgtatttttagtagagacagggtttcaccatgttggccaggctggtcttgaactcccggcctcaaatgatctgcccaccttggcctcccaaagtgctgggattataggtgagccactgcgcctggcctaatttgcacatttatcagaactacagccagatttgagaggtttgtggagccaacatatgcattaatcctatcaagatcaacaagtttagctactttgcatataaccaatcatgtgaagaaatgaatggcaacagccctagggaacctgtggcataatctgagatattatatagatataattttttttggatataatatttctatatagtattttttatatatgatatataacatattatgtatatacatcaatagtatatatgtatgtctttgtctcaggttcctggcacagagctcctgaaacccttggtgttttctcagtaatagaagtgtgttttgttattcataacaagcccctttgttatacctgaatttatgctaatggggtgactttgggtggggctcctagatagctacagggtgctgctcactagaaagaggaaacgtgattagagggtggaaacagggaggggacctgaagattgggttataaagacaataagggttggaagcttccaggtcgatgaatgcttctaagtgctgcaggtggggagtgggtgtcctcgatggacttgccacaacccacaccccacataccttgacctaggtatctctcccatttggctgttcctttatatgctttttaataaacctgtaaatgtaagtagtgttttcctgagttctgtgagtcattctaggaagttagagaacttagggggtggtcatgggaactcccaatttttagccagcctagtggaagtgtgggtagcctgggcagcccacttgtgctggcctctgaagcactcttgtgggactgagccctttaacttgtgggatcttgtgcttactacggatagatagtatcagaatttaattgttggacacctacctggtgtcagagaatttatctttttttttttttttttttttttttttttttgagacggagtctcgctctgtcgcccaggctggagtgcagtggcgggatctcggctcattgcaagctccgcctcccgggttcacgccattctcctgcctcagcctcccaagtagctgggactacaggcgcccgccactacgcccggctaattttttgtatttttttttagtagagatggggtttcaccgtttttagccgggatggtctcgatctcctgacctcgtgatccacccgcctcggcctcccaaagtgctgggattacaggcgtgagccaccgcacccggccaattttaaattattataaccaggctcaaacacatctttattaatcaaaataggaaccattacaatgaatacatttttgtgctttgggatttgacaaactcttggaaaagattttctgcatcctactggttgtggaagtattttccatgcaaaaagtgtcaaaatgcttgaagaagcagcagtttgttggcgagaggtcaggtgaatatggcagatgaggcaaaccttcatacatagctcaattcattcaacttttgaagcgttggttgtgcaacatatggttggcattattgtggagaattgggtcctttctgttgaccaatgctggctgcaggcattgcagtttttggtgcatctcatggatttgctgagcatacttctcagatgtaacagttttccaatccagaaagctgtagtggatcagactggcatcggaccaccaaacagtgaccattgtaaaagttcaagaaagaggaaagaaacacgaaacacagctgacagttaaagacaggttttcttttctttcttttttttttttttttttttgagacaagagtttcgctcttgttgcccaggctggagtgcaatggcgtgatctcggctcacagcaacctctgcctcctgggttcaagccattctcctgcctcagcctccagagtagctgggattataggcatgctccaccacgcctggctaattttgtatttttagtagagacagggtttctccatgttggtcagcctggtcttgaactccagacctcaggtgatccgcccacctcggactcccaaaatactgggattacaggcgtgagccaccgtgcctggctggttttctttagataaaacctgagaggtgctcctggccgatttttttggtcaaaagcgctttctcttacagactaagaggatatattggttttagggtgagggggtttatcagaagcttggaatgtttatgtgtagggagaagcttatggcagggttggaatctctctgggaggaggggaggttattttggggcagacatctttccggcctggtgtggggttatcttggggctagcatgtctgtggtcagggaggagtttggaatgtttctgtctggagatgttatttgtggtttatggtcatgctgaccttagccattaggctgatgccctttggattaagcagttttttattaaggtgaactttagaatgaggggcttgtccaagatggcgatgctcctgctctgtcaaacatgacccatttttggtgcaagtttggctttgggaagtgctttggagcttcttcttggtccaatcactgagttggtcatcgctggttgtataaaatacacttttgttgcatgttacaatccgatcgagaaatggttcattgttgtgtagaataagagaagatgacacttcaaaatgacgatttttaaagttttcatcagctcatgagccacccacttatcgagctttttcacctttccaatttgctgcaaatgtgaatgagcatagaatggtagatgttgagttcttcagcagcttttcaggtagctgtaagaggatcagcttcgatgattgttctcagttggtagttgtcagtttctgacggccagccactattctcctcatcttgaaggctctcatctcctttgcaaaacttcttgaaccaccactgcactgtacgttcattagcagctcctgggccaaatgcattgatgtgagttgtctctgttactttctgatccattttgaactccagtaagaaaactgccagaatttgctttttgtctaacatcatttccatagtctaaaataaacagcaagtaacaagtcataagcaaaaaaacataaagtgagaaatgcccattaaaatgatgtataacataaccacatttatttaagaatgtattctaatatcaaacagtgagttctaaaaatgcaaaaaccataattatttttgcactcacctaatataatacaatatctgggtaatttataaacaacagaaagtatttctcacagttctggaggctgagaagcatattgtgtctggagagggcctgttcctcatagatagtggcttctgtgtccttgtaaccacccaacagtttcaccttgcccgttgcccagacagctgatttatcaagacaggggaattgcaatagagaaaaagtaattcatgcagagccagctgtgtgggagaacggagttttattattactcagatcagtctcctaaagcattcagggatcagagttttaaggataagttggtgggtaggggccagtgagtcgcgagtgctgattggttgggtgggagatgaaatcatagggagttgaagctgttctcttgcactgagtcagttcctgggtggggccacaagatcagatgagccagtttatcaatctgggtggtgcaagctgatccattaagtgtctgtaaaatatcttaagcactgatcttaggttcttaaaatcaaaatatcttaagcacttagatcccaggagtgatttggggaggatcagaatcttgtagactctggctgcatgctaaactggaatttctaatcttttggctgatttgttagtcctgcaaaggcagtctgtctaggccccagacaagaaggggatttgttttgggaaagggctgttaactctttgtttcaaactataagttagttcagcctacgcccaggaaggaacaaggacagcttgaaggttagaagcaagatggaatcggttaggtcagatctctttcactggctcagttacaattttgcaatggcggttcatcctcacttaatggaaggggcaaagaagcttccttgggcttcttttctaaaaacatgaatcccatttaagagggctttaccctcatgacttaatcatctcctaattataattttggggacacattcacaccataataggtccccactgcagactgtaataactccgaactttcttactgaaaccgcctttccaaaattatgattgagacagtaaaagagatctaacttaactgactccatcttgcttctaacctccaagctgttgtttttcattcctgtgtgtaggctaagctaactttgggagaaacttagtttatagtttacggtttaaaacagatggtaacagccttttcccagaacagaccaccttcttgtctggggactagactgcctttgtaggactaacattagccacaagattagaaattatgttttaggagccatgcagctggaggctacaagattctgaccctccctaaactgcttctaagatcagtgtctgagatattttgcagacccttttcttgatggatcagctggtaccatccagattgatgaactggctcatctgatcttgtggcccccacccaggaactgactcagtgcaagaagacagcttcgactccctgtgatttcatctctgaccaatcagcattcctggctcactggcttcccccaacccaccaagttgtctttaaaaactctgctcccttaatgctggaagagactgatttgagtaataataaaattctggtctcctgcacagctggctctgtgtgaattacactttctctattgcgattcccttgtcttgataaattggctctgtctaggcagtggtcaaggtgaactccttgtgtggttacaaatttgggggctcatctgggattgcccttgtggctacctgcctgggtttggtggcccctctctagcaatggatccagaggccagcccaagcggctgcctagttcttttggactgggggccgactctggtactctactggtagggtgctgctgacccaatgtgcatggatttaattgtagtagagaaacagtcctggggagatgtccctcaactgtagccctgtcacagggtgtctgtagccccgttgcagggtgtctgggttggcgagtatcctaggctctgccaatgcctccttccttctcctgactggttctgtagttccatggtagggtgtctatagccccattgcaggatggggtgtctgtctcggtttggctcctggcagggggtggttggctctccctaactagtaggaagagccttggttcaggagacctccacattcaggaagattttgaggtgatttctcagacaaagaataggatagtttggaagggatactcttagagttcttggttaggtatctgattcggaaggccttctgtccttgtctttgtgtgtgtttgtatatgtggaggggatctcagaaggaattgctgatggacgtccagcaggcctacctcaaagaaccctccttatttgtctggttacgttcaatgagccctgaagaaagctcaacaggcctgtcttgggtgactatctgctctttgccttgcccagagaccccattgtgaatcattcggaggtcatccttccccacctggagtagatcaaagacaacaaggaccaacaggaagaatgttgagcgttgccaggttgatactgggtgctgaaaaaggtgactaatgtctgttttgttatgtgtattttcctgggatggaaaatgttaattcggtttgctcctcaggcagtgcctcccatgtctcttctgcaggacagaaacttttatctaaatagatgaaataattctattatatattgagtacctttatgttgaataatcctataatatgaatgattttggaatgccacccatcttagcctgggtcatctaaaaaacagagcttgggtcaaggattaaggtggctgtggaggctaaagcaactccatcttggatgccaacctgccatgttgacttctgattaacccctgttcaaagaatgcctctaagacttctaatttatctactgctaccataaaccctgctcctaggtcaaaacaatcttattttttgttttggggagcgtaaatcctccccttaggcagattcacataatacttttgcctttccctgcagggccaacttcagttgtcctacacattctttccctatggtatataagcccttggtctgggggataatggcagggctccaccatctcctcttgcagctactgagacaatggcttctgtgcctaagttattattaaatgtttctttcagagaaactacatttgtcagcctctgtctttggcctctcagcttcctcagcctttagggataggtttacatagggctgctccccgggaacagtgccaatactttatctgggagatgccagcccaggatggtgagagtgaagaatgagggaagtaaggccagggcagatggaatgcaaagtggctgatgtgctactgtgctggccacagcttcatggctagcctgggtgagacacagcaggtcgctcagcaggcatgtcgctctgcatggggacttgtccagagggatgcagggaactgcaccttggagcagtccaaggagagaaaaaggagggagaacttaccttcccagttccttcccatctcctgtttctcataggtcaggtttcacctggcaggtgcggggagctaactcatccatacttttgtgtttcatcaccgaactcctcagtagccagtttcataccttttttgatgtggaatgttatccagttctaaaaacggaggagtgacctggcactggtcttatgccaatcaagagaaatgaagcagattgctgggggaatctgaacaggcacccagggtttgcatctccagtttttggggctccaaaattttggagttccacaaattactctgaggccagtagaggttggtgtaatgagttcatcatgggttgacacacagtttctccatctatgaaatgagggggctggctaaggatgagcttcctccacatcgccaccgtccctgccccccacagttctgtttcctggggaagaaggccagcaaaggcccagcacagtcacctacttttccctaccatgtcgccacaaaccactctctcaacacagcccgccaaggcccaagagttccatccacatttcccagtaccacatcctgtgtaccagaaaaagcacacagaagtgagtcagaccttctctctactatctgattgctaatgataataatagccaccctgtttccatcctgtggtattgagcgccagctctgtgtccaacatctacacatgaacataaacacaggcaacttgtttaatactcaactcaatcctgaagatatgcatcatgttcccattttacacatggagaaagtgaggctcagatacgccctgggatttgcccaaaatcactaaggagtacacagggccaggtttagactcaaacagcctatggtttgagtttctctcttatttttttctttttttttgagacagggtctcgctctgttgcccaggctggagtacagtggcatggccacggctcactgcaactttgacctctcaggttcaagtgatcccccagccttagcctccccagtagctaggactacaggcatgtgccaccatggccggctaattaaaaaaaaaaaatgtttgtagagaggggggctctcactatgttgcttaggctggtcttcaactcctgggctcaaacaatctttccagctttagcctcccaaagtgctgggattacaggcatgcgccatggcgcccagcctatggtttgaatttctgtggggaaacctatagaagaacatgctggagaaggcccactattccttcaccatgtggcttttatcaacatgccatggaggtggtttgtgtccactgcacctgcacacacttcaggacaaggttccccggctgcttcctgcctgtatgtctgtatgtttctgtgagtgctgacctgccccagtgaggctcctgcccttctttcacaatgcaacacagtcctgagagccatgggctgggcctgggctcccagcagcgggattaccatctggacagagctgggggtatgcagagtggggctgcttgcatcaacaggctgtgggggcgtctcgtcctctgcccacatttgcagccctcttccctggtgagacaccccttccagcagctggcccagagcatctggccactcctgagaaatggaaactataccttcctggactggggccagcgtggtttgagaagcgcccctttcaaattccctttgtcaggaagttgatgcctgggccatcactcattcatgtcaagggaatgattattcttgatacatggaaatatttcttaagccaaaaagctgttgttctagatttactaaaactaggtcaataatttggcttcaatccccaggacaaatatcagtatggagaaaacttttacagttgtgggtattctctagaccaacgaatgcaaccaattatacattgcacagatgggcagtgaattgagtgtttcaaaatgttatctttcacctgtttagaaacaaaaggtcaatttttggaaagtatttctcaaaaagagaaaagcggcaccatgcagatataaaaatggaagcaatggtgcagatggtggatgataaatttctgtaacaaaggctgtatttttttgtttgacaagtttttgccaagttgcgtgcatgcttccccaaagtaggggagatttctgaggagggaggtgagtcacctggcctttacttccctcaaggcacccaggtttctctaatgtggggactaaaagactaaagttcctaaggaatgatcctgctgggccactctttttttttttttttttgagatggagtctcactctgtcacccaggctggagtgccgtggtgcaatctcggctcactgcaacctccgcctcccgggttcaagcaattctcctgccttagcctcctgagtagctggaattataggtgcatgccatcacgcctggctaatttttgtatttttagtagagacagggtttcaccatgttaatcaggctggtctcgatctcctgacctcagctgattcacccgcctcggcctcccaaagtgctgggattacaagcatgtgccaccatgcccagccaacctgcccacccattcttatctcacttggataacacatatagtaaggcccccttcagtgcagcccacagacagagccctgcacttggaagggcccaaccaagcttggttgaatgcactaggaccaagcagtactttgaaattcttcgtaatttaactttgaatttgtcttttttttttttttttttttgagacagagtcttgctctgtcacccaggctggagtgcagtggcgcaatcttggctcactgcaacctctgcctcctgggttcaaatgattatcctgcctcagcctctgagtagctggagctgggattacaggcacgtgccaccatgcccggctaatttttgtattttcagtagaaacggggtttcaccatcttggccaggctggtcttgaactcctgacctcaggtgatccacctgtctcggcctcccagagtgctgggattacaagtgtaagccatcatgcccagccaaatttgtcttttgtaagtgaagtccaatggggtcatgtagcacgtgctgagggcttggaatcttggcctgaagcatggtcatgcctcctgccacctccatgcttccctggaatgagttcttggctatccactccctcaacctctggtgccccagtgccacccagcccccttgtcacccctgccctgcaacactgccaccctttgctcccttgagggcctgggtgggggtgggtgcgccagggccaagtacatgcaccccacagtgtcagagcggacaggtggtggccgtcctgtcccaggctggcagcaatatgccatgttcagtgggtggcttagggagggtgagcctctctccactcctatcccagtccctagtgcctcctggctacgaggttgggacatagttgggactgtgggcctttaggaagggaagatgcctgcctctacttcccaataagtctgtctggtggctgctggaacggggagcctggtagttactaggttccacatgtgccacctccccgatctgtgaaggtccgctcttgccctgtgcgtgtcccgagctggagggagtaagaacattaagtgtaaattaccaaaaaacgcaacaccatgacaggttgtgagaggcatcatggaaaaaagggaagacattcccccatgcattttgaacagggaacctgcaatttcattttgtattgggccttgcaaattatatagcaaatcccacaggcagtgctgtgttgtggcctgccagctctcactaggtcacagttcactttctgtgatgtcatgttggtagctttgaaatggccacggtgggccgggcgcggtagctcacgtctataattccagcactttgggaggctgaggctggtggatcatctgatgtcaggagttcgagaccagcctggccaatgtggcgaacccgtctctactaaaatacgaaaattagctgggtgtggtggtggacgcttgtagtcccagctactcagcaggctgaggcaggagaatagcttgaacccaggaggttgaggttggagtaagccaagatcttgccattgcactccggcctaggcaacaagagcgaaacttgtctcagaaaaaaagaaaaaaagaaatggccatggtgagtattaacagcacggaaatagggcaaacactgcaaaacagaacttttattttattttattttattttagatgtagtctcactctattgcccaggctggagtgcggtggtgtgatctcagctcactgcaacctctgcctctcagattcaagtgattctcctgtctcagccttttgagtagctaggactacaggtgcgtgccaccttgaacacccagctaatttttgtatttttagtagagatggggtttcaccatattgatcagactagtcttgaactcctgacctcaggtgatccacctgcctcggcctcccagaatgctgggattataggcatgagccactgcgcctggcctagaactttaaaaaaatgtatgtagagctggtttttaacatttaccagcatagcactgtatagagtacccaataaaagtcggaaacttcttatccttgttaatttaattggttaaatagggcaggcccaaacttctaggaagacagtgcagaggcatggaaggaaggctaaggaagaaaacagcttagtaagtgccaggcactggtccaaaccatttcaccaccttttcaggaatgaggaaataagctcagaaaagtagtgggactcaaccaaaaccacacatcaggccagctactgagctaacattcggacccaatgtcctagctcttctcacagcaaaaggagaggtgttctttttaaaactagagatagggtctcactatgttgcccaggttgttctcaaactcctgggcttaagcaatcctcctatcttgggctcccaaagtgctgggattacaggcatgagccaccatgcccagagaggttctttagagtcacatgtctctctctctctcttcctttcctttctttctttttttttctttttttttctttctttctttttttttttttttgaaacggagtctcactctgttgcccaggctggagtgcaatggcacaatctcggctcactggcaacctccacctcccaggttcaagcaattctcctgccttgccctcccaagtagctgggactatgactataggcacatgccaccacgcctggctaatttttgtatttttagtagagatggggtttcaccacgttggccaggctggtctcgaactcctgacctcaggtgatccacctgccttagcctcccaaagtgcacagggcctcgcacagggttctgaactccaggaataaactggggctcaggagtaggcaggaggggggctggcgaaggacctagaagttcccaccctgggctcttgatctcttgcagtaacttcacagcctgaggcagaagcctagatgaatgagaagcaggacagaatgttccagcagccaccaactagagcagagacacaaatatttactaagcctaggggcctccccaacatgccggcagagttggagggaacaagtgtatgaggcctctctctgtaagggcagggaatacatggcagggagaagccccatggagaggtctcccctgactccagcctatccgtcacattggtatatgagtccctcacaccctcaagtatgtaaagccagtcacaaagcaccttctcagccatgggcagcgtggggagctgatctccatcttataaatgaggaaactgaggcccacagagggaagataacatacccaaagccagagggctgggaaatgctagagtctgcagtggaaggctggactggaaatgctgcccccaataccagtagtctccaatcctgcatctgcccaccacaccccctccccaggaacttctcttgaccctggctggcctcctccctgactgacccccagaccctcttctttggtgagatcttttgcacccttacttcctgcagctcccgggctgttctcttcccaggttaacctcccctttcttcttttttttgagacaaggtctcactctgtcacccagacaggagtgcagtggcacgatcatggctcattacagccttgacctccagggcccaagcaatcctcccatgtcagcctctcaggtagctgggaccacaggcatgtgccacatttttaatttttggtagagatggtggtctcactatattgcccaaactggtctgaaacaatccccttccccagcctcccaaagtgctgggattacaggtgagtgctatcccacccagcccatcccctttcttcctatttcccacctcagagaagccttctcacctcacacctctctctccaaatcgtgcccctcctccctcatctagctgaggcctggcctcttatccaggaagccctcctggactgctcccagttacagggctcttgggctctcaagattgcatgaagtatgttcatattgtactgtctatttaaaaaaaaaaaagcgcatgagagactagcacacgggtttaggtcctagttgcagctgtcgccaacttcctagggtgacctcaggctcccctgctctctctgagcctcagctccctcatctgtaggcagcctgcctgcctcaccagggaatggagagtctagatgagaaaaccctggcagtgggcacaggtcacagctgttggggtttttgctggcatcagcattgcaccctctagatctgttcccatccattaccatctggccacacactgccttgttcttgctctcccctaggggtgggaggcctgtgtctggctggagagcccagttcgagagggtgctgtgtgtgcagggagccctgctgttccccactggccccagtgagccaggccctggcttggggctggaaagagcccaggactgggaatcgctgccctaagtgaggagccccaacccctaagcagttctgcccttcagcccttcagggtgttaactttgcctagccaagagcaaactctctttctctgtgccaggagtagtagagcccctgggaaatgctgtttttgtcccctgaggcagacttttggggagtccaaaaaagggctccccacggtgccggctatcacagaacaggagacaggagcaggagacaggccgggaagatgcggcgactgggggaccggataggagggcccttgtcctgaggctgcgtaggcatagcaagctccgggattttacttcgttggaatgttcttttgagctactttgggggccgtgactgagagagctcgtgggggactcaggccctttcagagtcacccgtgtggctcggccactgcgccaggtcttggaacatctaaggcagaaacaggaccaacacccgcaagcctccaacagcccctggggctccgtccagccgttggggtggaggggttggggggaggtgcaggggcgggcactgtggggggtggggcggggccggtggccgcgactccaccccgcgcccctagtcgagtaaacaagccacgggcggcgcctgggggccgctcctgcaagccggggcgctgggttacatcacggttccctggagactcccgccccagcggccgggtccctgaggcccgcgcccgcccgccgcctgtgtccgagaagcagagagctggcaagggcccgccagggcgggaaggctcccacgttttctccggaggcccctgggactttgttgcaattgggttcagcccgggcatgggctgaacgtggacgcgcgggaaccgcgcctcggtttccccatctgtgaaacctggaggctgtattaggattctgtgcctcctattaggattcagctgggggaaggagagcggcagccagggccagggccagggccagtcccaggcaggctgtgactggagccgggctttctacgttagggttttggtgggtacccgctcagccacgtgccagaatgcaccctccctctgaggggacatggagaccactcgctgggccaaggcacagcaaggacgaccttgtatcctagcattctcctgtccccacttgctgctggacacggaccctctaggtaaaattcaacaatagttcctgccagccaccctcacggcgggtttgtgccagtgctttgggaaagatgttgggttgcccacttaggcgggagggagatttctgctcaacatcaacaactcaatctaccacggagcctgagccactggtctggaggaagctgcgggggaggcaggggtcgtgggcacccagcttggggacactcaagcagagtacgggctaggcacggggaagaaggtggcagagggcatgcttgccagcgtctccaggagctgtcctgccctggggttccatgatttaatgattctgcacctgcaccatctgataaggtagccgcatatgactgttgagcacttgaaatgtgtgggaacccactaggagccccagagttggcataaacattattttaagctgaagacatttgagattcaacagacgcagaaaaaagcctcctaggagcttcctttatctgacaaaaagcagtaacttctgggaagtaaggctaccataaactctgtcataggggtagtttcatggccccaagaagacagagcgaccactcatacctatatagacaaatatttcacaaactttatcacctgtcggttctcttaaaaccccatttgtctttgctaaagaaacctatttgtttttcccacagaagccctttctttcccctcccttttccctactaagttaggtatataagccttcaactctatttaaccagccagctacgtcctttgttggtacggtatgcagacataataaacttcttctcctgttaatctgtcttttgtcagtttaattcgaaagctgcaatcacagaacaagagagtgtagaggaaaagttttttcctctcctgcaggggctagtacacattgatatgggcagtaagtgtaacatatacacaggatttaggagacttagcatgaaacaaaagaatgtgaaatatcttaataattttgtatatgattaaatattgaaatggtaacacagggttccattagataaattgggttctcttaaatatattgctaaaattgatttcatctgtttctccttactgtctgctagaaaatttcagataacatatggctcctattttatttccattgaatagcattgctaaatgtcaggtgaccttgtgtctttgggttggcttttcccaagcaacaccaccacatctctattaactgaatgctcttgtgtcgagtcctgagcagcgtgggcagtggagagtggaagaggagggggcgcagtgccagccctcggggagctgccaagcccctcttggcttccaacttggtctggccacatcctcctgcagtcctgcttcccctcctccacaggacagtcaggccagcagaaagctgggcagagggttctggggctggccagggctctgagaactcaaggagggagttctgtgtgggccaaggattcagaagacagtgtggccagcagccaggaactatgactgcaccgagtgctgttcccatgcccaggaccacagatgcatcccgggcctcactgcccagcacctcccggcttagtggccacagagtcctcttcctgctctgccaagcaccatctggctgtggtggaacaggctcccctgctctcccatcctctctgccatctcccattccctaggccttgctggattaaaacattttcctgataatcattcagggatataggctaaggtctgagaaagtaagctaccctaaggcccctgaaaaaataaaacaaaataacaaactgtagttggtatttctgatgaacagcccacacctggcaatttagagggatggtcccggttggtgtgacccaggtttaacccctgcagctgatatgaatgtgacagctttacagccctgtaaagctaaccagacctgtacatagttaaacaaccttatctaacattcctccttcttctcctatataaacttgctcataacagccaacactcacaccatgcttattgtgtgctaggcactgctttggggatcttacatgcttttttgtgtgtgtgtgtgtgtttttttttttttttttttttttgagacggagtctcgctctctcccccaggctggagtgcagtggcccgatctcggctcactgcaagctccacctcccaggttcacgccattctcctgtctcagcctcccaagtagctgggactacaggcgcccaccaccacgcctggctaattttttgtatttttagtagagagggggtttcaccgtgttagccaggatggtctccatctcctgacctcgtgatctgcccatctcggcctcccaaagtgctgggattacaggcatgagccacagtgcctggccgggatcttacatgtattaattcatttaaggctgggtgcggtggctcacgtctgtaatcccagctactcaggaggctgaggacggaagaattgcttgagcccaggagtttgagactagcctgggcaacataatgagaccctgtctctacaaaacataaaacatttacctgggtgtggttgagtgcatctgtaatcccagctacttgggaggctgaggtgggaggatcttttgaagctgggagtttaagaccagcctgggtaacacagcaagacactccccctacaaaaattaaaattaaaattaatacatgtaatttggattaaattggatttcaggcacaacaaacccgtgaagtgagtgctattattatctgctgttcacaagtgagaagctgaggcacggagaggttaagtaaacttgctcaaggtcacacagctacaaagaggcaaaaccaggattgcaacccaggccatctggctcagtatccgtgctccaaatcactgcatgacatagcttttcccgcaatgctggaggactcgattgtgttttgttttcctaaacttgttcccttttgttttcctaaacttgttcccaacttatgataaacctgtgacaggtgttcatgatccaaaaagtgtctgagattggctttaacaaattaaacatgagatgggaaagtgaccaaatgcatgaggaagaagaaaaaaattccagaagaataaatctttctaccatcctttgtccatgtgtctgtgtgggtggacaagggaatactgtgtaagaatgggtgcagcttgttcaaagataaactgtagttgaaagttgcagcctgcattgatagttgcccctagtttagcaagctgcctgagtgggctccgaaatggagacctatctgatttgcagaggcagggcaggagggctaaattgccacaaataagaataaaagaacaggcgtttcaaacaggaatgggggtgggtagaaacccaagaaggcgtcagcaagctgtgacctgagtggggtgtagcagcacaggaaacagctctgatgggttttcaaacaaggacggctactgtttaatcgtccccgttgcttgtgctgagctgcgatgtcattcttctcaatctcctgacctttggtcaaagcctaacatcaaccctgctttatgaccatccgtgctgagacagtcagtgctaaggggtgagggggcatgaagcctggggaggaccgggcctggaggccatgggcactgggcaagttgctgagtggggagttggcctggagaaacataagcccctttgccatcctcagagtcactaggggcgccagattcctgccaggcacaggatgtccagccagagtagcatctagctcctgaaatccagcacatgctctcctcccaagtcaggtgtcctggcccggggctctgtctgcagagagtggtgcctttgggctggcagtggtcctgcatggatcctctgctgaaagctaaggaccttgggtcccaggcacagggcaggccctgggctactgctctagacttcctgagtcagagaaagccccgctggacctcccaaggcctcatcctggcacctgagtcagcctcctccctctttctgagccaccctcggctgacctcccccagccagcctgcctctaaaagtggggcttcatagggacattgtaatgggggagcagactccaggtctagttcatttatttatccatcctttcctgttgtttatattgacctgtatgccagatacataggttttctttttctttttttcattgcactcaggctggagtgcaatgccatgatcttggctcactgcaacctccgcctcctgggttccagagattctcccgcctcagcctcctgagtagttgggattacaggcacctgccaccacacccagctaatttttgtatttttagtagagagggggtttcaccatgttggtcaggctggtctcaatctcctgacctcaggtgatccactcaccttggcctcccaaagtgctgagattataggtacgaaccactgcacccgactgatacataggttttctaatttagtcctacaatacaccaaaacataggttgtgtttttgtttttttgagacagggtcttgccgtgttgcttagactggagtgcagtagcatgatcacagctcactgcagccttgacctcccaggctcaagtgatcctccaacctcagcctcctgaatagctgggaccataggtgtatgccaccgcacccaggtaatttttaaaatttttgtacagatagggtctcactatattgcccgggctggtctcaaactcctgggctcaagaagtcctcctgtctcccaaagtgctggaattataggcatgaaccactgcacccgaatggtatttttattcttttcttttttttttttttttttgagacagagtcttgctctgtcgcccaggttggagtgcagtggcatgatctcggctcactgcaacctctacctcctgggttcacaccattcttttgcctcagcctccggagtagctgggactacaggcgcccgcaaccatgcccggctaatttttttctatttttttctagtagagacggggtttcaccatgttagccagaatggtcttgatctcctgacctcgtgatccacccacctcagcctcccaaagtgctgggattacaggcgtgagccaccgtgcccagccggcatttttattcttaaattacagatgaggaaactgaggggccaggggtagctgggacacaagtcctgtctgaattgtgctggtcttccagcttggtggggtgggatggaggcagcctgggctggggacctgaaagcagaagaggggatgaagggaactgggtaggcttgtggaccacaggcccacatgggagccacaccctggcaagagaggggattgtgaaagagaaggcaggtggggttcaggacaaagatgggaaaatgggggcagggagcaagagaccctccaggccttgcagatgcaggagttgagcaggtagaggatagatggggtggaagggaggtgggtgcccaacagggatgaccctgcaggtgaggtcccgggcagtaagcgatgaaactactttgagtgggggcagcccacccaatacctcctcctctgggctaaagaggagggaggggaactagctgggcgatctgtgcattcagccatccctaggggctgtccaggggcacttgtccccagagaggaaggccagctctgtctttggaggatgagagtgagtaagcagacaagcaccgtgctagttgcgtttcattcaagatcttcccaccacacccagtaagaaaggcatgacactaggagtttgaaaccagcctgggcaacagagcgagaccttgtctctacaaaaaatttttaaaaattagccaggtgtggtggcacatgcctatagtttcttttttttttttttttttttttttttctgagacggagtctcgctctgtcgcccaggctggaatgcagtggcgcgatcttggctcactgcaaggtccgcctccagggttcacgccattcttccacttcagcctcccaagtagctgggaccacaggcacccgccaccacggctggctaattttttgtatttttagtagagacggggtttcaccatgttagccaggatggtctcgatctcctgagctcgtgatctgcccacctcggcctcccaaagtgctgggattacaggcatgagccaccgcgcctggccaatgcctgtagtttcagttacttgggaggctgaagtgggaggatcacttgagcccaggagttcaaggctgcagtgagccatggtggcaccaccacctccagcctgggtgacagaatgagaccctgtctctaaagaaaaaaaaaaggcatgacagccccattttagagatgagaaaactttggccagccatgtccaatggcctgcctgaggtcacagagttaggctggagtgcagccaggatgcaaacttgcctttgctagtctggtgaaagagctaggtataaatagaaaccccaaagcagtgggtgccaggcacaggactggaggctatgaggggagcaggggtgactgaatacccccaccccaatactacccccaaggcatctgcttattctggacccagaaggagaggctgggggcatttctaggtatcctgtggataccacagaggttatgcacactctggcatagtaagccaggcagagtggtctgagggaagggagtggggatgggggagggggtagaagagaaggtagggaaggaagtgggaggagggactgagggggagatggagaacgggcgggggaaggagggaagggagggagggagaggtggaggggaagggaggaagagggggagggggagggagggaagtaaggaaggaaggaaagagggagggagggaaagaaggaagtggggagggagggagggagggagggaaggttggttgccggccatggttgcacgtgtgtgcctggctggttctgtgtccctctgtgtgtgtgcatgcatgtgttcgcatgtgcatgtgtacatgagtgcaacagttttttctccttggtcctctaagctcctgtgagtcctgccgggccaggaagtctccatttggggcatggcattgggatcccagtcaatagccctagacttgtccactggcattgggggtgggcaggagggttggacaggcaatggggaggggtaggagcagtgaagccttcaggcttggggtggctgggaggggcagtgaatgccccaggcaggcctatactctggggggctttcttggttgttccaggccagacagtccccaacacgcatgtgtattccaggctgcacggaccagctgggatccttccccaccccttaggcttactttctccagaagcactgggcattgctgtgcccattctgcactgggttcttcatattcacagtcagttgatctgcctgattatcccttgatgtggttaatgcttatcctcatttttttttttaaagaatatcactgtatttattttcctacaggtaatttttctatggcttcagcattttctcttcaaatcaaaagaaaaatttcccaaagtttagaactggatcacttggccctttctcttatctccttccagttcaaaatgcttgcatctcttaatggccagcatcctcttggatctgcagttaggctcaacacattccagccttagcacaaccttctttgtggtcttagccttcttccagaaaattggctatgtctgcccaccatggctactctgcttccgatcatagcacctctttccctgggcatacaaggaatccttgctcttcttatactgtgtcactttgtgaggctgatgcttgccacacttcttaccgaaggctcttcgggttttaggtacattgaccatctttgcagcacggctgttctgtctatatgatgaaaacaagaaacagcgtctgagacccttacctcgcacagctctcccctaacaggaaagggccttctttttttttttttttaattttttttttgagacagagtctccctctgttacccaggctggagtgcagtggcacaatctcagctcactgcaacctccacctcctggcttcaaatgattctcttgccttagtctccagagtagctgggactacaggcacgcaccatcatgccctgctaagttttatatttttagtagagacgggcactccatgttggccaggctggtctcgaactcctacctcaggtaatccacccaccttggcctcccaaagtgctaggattacaggtgtgagccaccacgcccggccatcctcattttttttttttttttttttttgagacagtgtcttgctctgttgccctagctggagtacagtggtgtgatcatggctcactgcagccttgacttcctgggctcaatgatcctcccatctcagtctcctgagctgggaccacaggcacatgccactaccatgcccagttaatttttttttttttttttttgccagggggagatgggggtcttgctatgttgcctaggctggccttgaactcctaggctcaggcaatcctcccacctcggcctcccaaagtgctaggattacaggtgaaagccaccttgcctggccttatccttttttttttttttttttttttttgagacggagtctcgctctgtcgcccaggctggagtgcagtagtgcaatcttggctctccgcaagctccgcctcctgagttcacgccattctcctgcctcagcctaccaagtagctgggactacaggcgtgagccaacacacccggctaattttttgtatttttagtagagacgggatttcactgtgttagccaggatggtctccatctcctgacctcgcctgatccgcccgcctcggcctcccaaaatgctaggattacaggggtgagccaccgtgcccggccctcattttttatatctgtgtaaactgagccccagagagatgaagtgacttgcctatggcagcacagctaagaagtagcagaagcaggatttgaacccaggaagacagggcaccaatctcagcccccagccccttcagcatagagtgagggtcccctgccttctactccaccctaccctcccagcctcaggagcacattcacaagtacaggttgggcccctcttctgttctgtgaggcctgtatcaatttgtcatggggtggagagcccagctccctggtggaatcacatcaggtcatagtgacagagtcctggctccccagggactgactcccagccacagcactgggagctgggatagcactctaccccactgaacctgcagcacagggccagccagtcatggagcccctcaaatccattggtgcactgggggccagagggcttgcaggagtggatgagaggtggctcagccttcagtaggccctggctgagaaataaagaggctgttcatgagcgcagatgtggttctggtcggctgggccccagggatcctgagcaggcctttcttgtctgaacccaaatctacttcttgggtttgtcagcattccctaccaccaccctcagccccacagcctggccgagcagtgggcgcagtctctcaacttgccctgaatgccttcgcaggcctcttgccttcaggagttgcatgctgcaccttctggaaacaaacagggaccatgataccaggcggggctaggctgccactcctgccctcccactggctgcagtcagatgtcagcacatggcactgggggtgtgggtcacaggaaggccctgtgggcctctggaaggttctgctcagaagaaacatcatgggcaaggaggtctgtgcaggggctgcaggggctgcagtcacccctccgattgcctgttacagatggggagctgtggaggtttctgtgtcccttccttttaactaaacaaccccagctggacacggtggttcacacctgtaatcccagtactttgggaggccgaggcaggtggatcacctgagatcaggagttcgaggcaagcctgaccaatatggtgaaaccctgtctctactaaaaatacaaaaaaattagccgggcagctacttgggaggctgagacaggagaattgcttgaacctgggagacagaggttgcagtgagccgagatctcaccgctgcactccaagctgggagacagagtgagactttctctcaaaaaaaaaaaaaaaaattgaacaacccctttccaggccttttgtccccattaggagtgtcctgttgtggtccctggctactgccccagacttaggttaggaatggggacagaactgggcctgggagctgggattagaatgggctgggattgggatgaagatggtctagtctgggctgggcagagcttgggatgggggtgggaggcctgaaagcagagggctttactggaatgactgtttatcccctgcccactctgcattgagcctgtcaacctgaatgatgagattcaggcaatatgattaaatactgagtttattggagtgcaaagtttgaggaaggcacagtctccaaaaaaatggggtccaaggtgctctgaagtggagagatttgaggatcatttatataggcaaggatgtaaacaggattacatcatttttcatacatagttacagcaattgattggttaaaggcagtgtttctttttcgggaaaagtatatttgacattccacataaggatgtaatagttaaggggtctttcatctcagtcaaggggtcttctatcttagggccatctggtctaagccaggaacaaggaaggaaattaatttataacaaaagttcagtaattaagaggtcaagttctgtgactcagtctccaaaggcaaccttcctcagagcctagtaactgttatttttgttcttgttgttttgtttttgtttttgagacagggtcttgctctgtctcccaggctggggtgcagtggcgcaatcacggctcactgaaaccccgacctcctgggctgggcttaagcaatcctcccacctcagcctcctgagtagctggaactacaggtgtgcatcatcacgcctggcttttttttctttctttctttttttggtatagagaaggtctcattatgttacccaggctggtctcaaactcctgggcctgagcaatcctctaggtttggtctcccaaagtgctaggattacaggtgtgagccactgcacctggcccctaataacttttagaagccctaaacagatgatccagttcctttcacaagcctgtggaaaaatggcagactgaggaggtggttttggctctctggccttcacagaacttcttcctagagaagggaaagcagacttcagccccacgttgttgggaacaggcccccaaatctggccataaacaggccccaaaactggccataaacaaaatatctgcagcactgtgacatgctcgtgacggccacgatgcccatgttgaaggttattgttttaccggaatgagggcaaggaatacctggcccacccagagcggaaaaccgcttaaggcattactgaaccacaaacaatagcatgagcgatctgtgccttaaggacatgctcctgctgcagataactagctagacccatccctttattacggcccatccctttgtttcccatataggatacttttagttaatctataatctatagaaacaatgcttatcactcgcttgctgtcaataaatatgtgggtaaatctctgttcatggctctcagctctgaaggctgtgagtcccctgatttcccactctgcactctatatttttgtgtgtgagtctttaattcctctagcgctgctgggttagggtctccacgaccaagctggtctcagcaccacatcttctcagagtcctgcctgcttcctaggaattggcctgaggaaggaggaacacgggttcactgaggctcactgcctgccgggactgatccagtggcattagaacactgggcacctgaccctaccacaaacctgggggcacaattcatcatcccacagtcaaagaccctggagctcagagaggttaagaagcttgcttcaagtcccacagccaagagtgcaagttgggatctgggcctggataaggtggctggtgctggttttgtcaccagagtatccctaagaaggcaatactaatccaagcaaggagacactaacagggggtgtcagcaccaggagagtgatgcagcagtttcccagcagtgggacttttctggaaggagctggaggcccattctggggtcaaatgctgctgcagccaagcctcctccacagctgcagggcatttgcctggctcctgctgctggggttctaatctcatgactggcctcggctcagggtcagcccaaggacacctctcagtctgggggctgaggtcaaggctgacttctggcctgtctgggtaacctgcacctctcacctgcactgttcacactggttccctgggcctgacctgtgttcccttcaccaagcccgagttatacagtgtggactcccaccccccatcaagacccctctccctggccagtgctgctctatgtcagggagggagacaacagggggcttccctggaatgctcaccttctgccctgtgccactgctgctggcttcccaccacgttgctccgttgctcaccacactacccacctcttgccatcatctccggaagctgggggctatgaccattcttgttccaatgttaaagatggggaatctgagctcagcaagaggaagccttgacctccccttactcctgagccactccactgtgacacggtgcccacacgtccactggcagcacctcacctctcctttcctttcttggctggaggctcgctctgaccccaccacacaggctgtcccctactccccgctctcagctctggcagcctttctagccagagcccatagttcggccacttgcagcctgaccatgggctgggctggggggcattctactctcttcaagagctgagggactgtcaggtgaaagatggatgccagggactgaggggtcatcagggggtgacgcccgagagagccaggaggccccggatggaggcctgaagggataagccaagcttctttctaaatccctggctgtgccaaagccacccatggagactttcccttactgacctgacctcagctggatttggcatcctcctggcttccccagccagccagggcacactgactagacagagatggctgaggaaggtgtgtgtggagctgacacacgggccccggaagtgctggagaaggctcgttctgggtgtggaccctcttctccctgccccttacccaattccctgggggattcttttgttcccctgccctatgctggggtgcagggaggccacctggggccttgccagcctggacttgcctgagctctgggccctgaggtcatggagacctcctgaaaccctccccaggggagctgttcgcaggcagacaggcccaatgaggtgctaattactgaactaattggaacctgagccatagatgacctggttgacaggaggtggggactgctggagcagagggggctgtggaatagggtctggagggaggttgagggagcccagagctggtgcagggtgggctgtgtttgttcaggaattgttgatttattagcaagatcagctctttgaaatgcgttctggtctcctccatatctctcctggtcctgggtttctctctgggaaaagattggtgttctgaagccactgcttgttgggaggggttcatcaagaatttgggggcagaatgttctgctctggggagtgactcgagccggagggaggcccacggcctgtcctgaggattccaggcctgctgcagccagcagacgtggcactgggtggtcttggagatgggctgtgagaacagagtgacaccactgagccgggtcaccttggagggttctgggactcaccccacacctggctcttttggaccttggcctgctcctgcccctctgtgaatagctggtaaggggccagtgactctagaggcctcacaaattggagatgacactgtctgctccctaaggggcaggggagctaaggagtctaccttgctgcatccagaaaggaaaagcctagcaccctctcccctctccgagactcccttcttcacagcccacccttctggcacaagtcattctcagcaccctggacccagggaagactttggccacattgggccagaccccaactctcagcagggtagcatgtggctgtcactcacccatctctagccccattggctccccagggctcctggcacactctgcactttctctggtcttcagacctttggctgcctccagctctgccccctgggctgctttctgcctagtcaagtcctctccactccacaggcaggctccgggttcatctgcatagcagctgagcagtgacctcctgcctgatcttctgcagcatcccctgcccccgcccctccacactccacacacggcccaggacccagactgttggttatgaaagctgggaggctaaccccctgcctgctctgaaggcttgtcctcctctctcccagaatgctctgagaactgaatgaaatgatggataagagaggaccgtggcagtaactgtgacaattgctccaattgtatgagtgcctatttctgagccaggcatggtgctgtgtactttctgcacaggtctcatagcaaccctccagggctggaagttttcctatccccacttctcaatgaggaaactgaggctcagagaggccaagcaactgattcaaagtcacacagttcctaagtgacagtttggggactccaaagtcaccatctctcacaatgggaagggggttgttgttattttttggccagcctgcttccttccccctttcccctccctccctgcctgccatcatctgcctggtgagtttgcatcactcctagggcccaggggtccaattaggggactcccccagggaagctgactgaggcaatccatgccccaagggggcctccctgagctgaagttttaattagccatcactgctctccctgaaactctgacctgcccatagctctaccatcccaggctggccttgtggcaggaggcagaaggcaggactggcgttcaacccagctgcgcagcagaagctgccctggcagagcagagagatgtggccaggcttccctcccacacagctctctgtatccacctcagcatcacctcatttagtccagtaaatggattacaaaataaatggactaagcgacttcatccattaaatagattaaatacattaaatgagctaatatttgtgaagcatttaaacagcgcccggtacatagtaaagactaggagtgtttgttaaattaaaaaaacaagtcagcaaggatgaggggaacaaggtaccacccagggcccagaactattcttggacataaagatggcacattcctgggtcacttggcaatggtgggtggcccatgtgtgggcggtcagcatctgtaatcctgccccctgcaatgtgggaagcttggggtgtggagggagggaatggatgggtatgtgccaggcactgcactaagcattcatgccctacaagccatcttaggagatgggttaccatcccatttttcagaggaggtggtcaaggttcacagaagcaatcaacatgtccacagctggcaaggtggctcatgcctgtaatcctagcactttgaggggccaagtcaggaggtttgcttgaggccaggaatttgagactggcctggtcaacatggcaaaaccgcatctctacaaaaaaaatagaaaaattaggtgggcgtggtgatgcacacctgtagttccagctacttgggaggctgaggtgggaggatcacttgagcccaggaggtggaggttgcagtgagctgagatcgcaccattgcactccagcctgagccacagagccagactccatctcaaaaaaacaaaaaaacaaaacaaaaaaaaccatgtccaagaaagcacaaccatgagaggcagggcaggatttattgtttattatcattattattttttgttttctttctgtttatttgtttttgtttagggcaggatttagatccaaaacctaagccctgcacaccagaaaatccgactccttgtgcccctcccacacctactcagggcaagaaggccacagggccacacccccagatgcaaaagggagaagggtgcctttctctgctcccactcagcttcccctcaacctccaggaaacctgagggctctgagtatggctgtttgtgttgaggacccaaaaccccttttctggggccaggctgtgagtctaaggtgagatgataacagggagtttctgaagcactgcacccctactctggggagcaggaggcctcctgaccgtgaccccagtctcccaccctgcttggctgctcacctcccgcctcagcagcagcgccgctgtgccagccctgagccagagccaagccctccttggacgcggttgcctggtaaccagccctaagtgacggcaaccccagcgggccgctaatgagggggcagcagccaaccacctggccagacccagccgcctcagccagccttagaaaggcttccacgatagtccacctggcctgcccacggtaggaggggagggtgccccagcactgggggaggggacatggtggggcgaggaggagctgggttggcggccccccaaaacctttgaactggggatctgggggaaggtgactcccgatgaaggccaagtcttgaccaaagcgcggggcgggcactgggctggagtcagggctgcgggtagggcccgcccaggccccaaccaccaccctggaaacagctgtgatggctctgcccagggcgccgaggccgggggaagggatctccagggagaggccctggatggggagaggaggtgatgagggcggctggcaggagtccaggctctgggtaggggagcagctcctgcagcacggggggaaatgcatcagcccctcccctctttgcaggggtccccctcctcttctcctcacacccctaccccaggctgatggcctccaaggagggggctgcaggcagcatgaggcaggcaggtggagctcggccaggtgtttttccatcctaggtctgacaggggaggaggggatagagaggcagtggcagaaccaggaggaggcctggtgtatggactggacaggccttcaggagacctgggttctggagctgcctgcctgagaccccaggcaggtagctggccctctctgcgtctcatttgccccatgttgaaataggggctagaaacaggctactgctggtgtcctgggtcctaagaggctgagacggggagtccaggggctttaggggagctctgggcagcagaggttccttcaggctctcatctctgggcctgggtaggtttttctgcctttcttccctttcagatgtgcatagccctccttcaccattaaaccttcactccataactacagcctgactcagccctgtggtgggcactagagtcacagcccaagggcagacccaggccccaccctggaagaggtccctccccagtataagagagaagccaggcttatagccaggcaatttcagcacaggaagctgaggctaaaatggaggtgagttcaaaatgctctgggacctcagaagagatgaccaaacccagcctggagctcagggaaggcttcctggaggagggatcccaagccgatttttttttttgacgggggctgtgtcaggtcttggtttgttgcccagcctgaagtgcagtgacctgatcacagcttagtgcagcctgaacctcctgggctcaagtcatcctcccacctcagcctcccgagtagctgggaccacaggtgtgtgccaccatgcctggaaattttttttatttgtcctgctctgttgcccaggccagtcttgaactcctgggctcaagtgatcctccagcctctgccttccaaagtgtgggaggatttcaggcatgagctaccgtgcccagcctctgagctgagtctgaaaggccaacaggaattagcaaggaaagccagacaagcagccaaggcagatggagagcatattccaaagtgtggaggtgtgacctgaaaggaaccttggctggctggggagacaatcgggacaatcaggagacatgccaaagccagactggggaactggaacctgaggccaccgaggaaccacaggagactccaagctaggagtgaccggttacacacaggcattagaaagctctctgtggaggcaggcagggaatatttcctgctgcctccagcaccaagcctccaatggctgggctttggcacagccagagtgagacatcacagtccccccctccctgagtccaaggcccagcagtcctgttcctgaggcctctctcccactgtggcagacccacctccacacaagcacccatctcactggaggcaatggtctgtttgaagcctgggagacagcactgggacccatctactgctgtaccctcaatgccagcataaaacctggagatcctcaatatgtgacagaaggaaggatgggaaggagagaaggaaaatcagcccaccctagctgttaattaaagaatgttcccctcctctgcaggagtccctaaatctttttttttttttttttttttttttgagatacagtcttactctgttgcccaggctagagtgcagaggcacgatctcagctcactgcaacctctgcctcccgggttcaagttcctctgcctcctgagtagctgggattacaggcttgtgcaccatgccggctaatttttgttttttagtagacatggggtttccccatgttggccaggctgatctcaaactcctgaccttaagtgatctgtctgcctcagcctccccaagtgctgggattaaaggcgtgagccactgcacctggccagggtccctaaattattgtgcatggtttgttgttgttgttgttgttgttttcctagccaacaggccagcagatgcagtcttccagaggggcccagtgaaagcctgccccacttctcagtcttagggcctcccctctgagcaagtctgattttctctggaggtagtggggggggggctccttcggagtttgagaggctcccactccctgctcactgtggcaaagcagcaggctgcccccacccccagcctcccctgcagaaggatgccctgatttcccagtacacctttggaaagtggctcacctcaccccaatcagaccccatggccctgtcctcctgcccaggtcctatccaacccagatccctacgacgctctgagtccatgctgatggccaccgacgcagcccagcttcaggctctgcttgctttagtggcagcgggttcctgaacaacaattgtgtctgagccctccctcagaaggcactggagtcacacagtcctccagggacaatcctagctctccatttcttggctatgtggacaagtggcctccccctcctcctctagagctactgttactggttgagggtagttgcccaggttcttggtgttttgaacaaagaattggacaaaaggcacaagcaaggcagcaaaacctccagcaagaggctcaggagcactggttacagaattttctggggtttatataccctctagaggtttcccattggttcaccctagtagcccgcaaccagtctgattggttgaagagtaggcccacgaccagtctgatgggttgtgggaggggaccaatcagaggcactttcactttccagctgccactcagcaactgccatacagcaaaaggagggattgcaactaccatgcagcaactgccaccttgaaagagaaggggttgaagagtagtctctaatatccagcaccagttggccttaggttccctgcctccagaccttattctcctgcaacatcaccactggttgaaaccttactacaaatcaagctgtgaagtcactggagccctgtagcaagtcatgtccctgtaacgatgagtgagctgacagctaaggggcttgcctaaaccacacaggtcagtggatcaaaccccagtgtgcttgtttttcaaactcctgcttcacatggttgtaagaattaaatgagatatcaattatctcatagatagatgtaggagctccatgcccaaccactgacactgagatatccctcttctgggaggggagagggagcaatgaggaaatagagggcagacagggcagcaaaagcagtctgaggggcctctcaggaggaggcagtgtctatagctgggtctgcaaggatggaagggggcattgctgtgtgtcttagggaaaggtgccatacttctctgtttctctgcctgtagagtagctgccagctccacctcacacgcctctggggtaagggagctcctccaaggaaggagatttgtaaatagcaggtgtggcctcattagagggagcaccattgttattaataaccataaaataatgagccaaggctcaggatctgaccttttaccttgcattcccagggagccaggagaagtaactggtgtctggggtggggtggaagaggagtgtgtgtgttgcatgtgaaacctgggcagacctggtagtggtaggggtggggtggggtgaggagaaacctcctttttacactactttctttttctgtgttaactctactcgggaaggccatataaggacagactgttcccttctctgcttttattcacactattccttctgattagaatatcacatctctgcaagaccacagtcctgataaaaacatgtggagctcccaaggcagttatcttgtattgattgccttcattctctataggctccacagacgaccattggtatagggaggaaaatggcaaggtcagagccttcaggagctcatagtctggggacactctatgagcttcctagagtttacaagcaatttcccacactgatgttggccgacaccacagttgctaaggcaggtctctcactgctctctttttgcaatgaggaaatttgaggctcagaaagttacaaagtagctcccaagtcccccagtgttgcctcctttctttggcagtccagggtgtttaagtgatgccgaaaaggaacagacatactgttgagtggggctgctgtctgtgtgaggtgtccctgaattaacacaaggctcagcagtgctgcaaatcttaactagcccctattgtctcagatggctgctcatcctggcctggttgggtcccattccaactcagggaaattggagagaccactgggcacatctgagcacacaacctgagcgtcctagaccccaagggctaagaacacagccctccttccaccccactagcagggcagggacagggtcgccggcgcggtgctggaggaggaggggcgagcagagttggtaaggggcaagagcagtgaatagcctgtgacccacggggctgcaggctggggttaagggtatgatgtttggtgtgacccctagctgtccgcgcgcagatgtattttcctgacgctaaggtgtggctgcaggaagggccccaggctgggagccaggagatctgggattttgtcccagcctgctgagtgacctggggaaagccccaaccctctctgagtgtctctccctatatggttcccgactctatttctaaggtccttccagctctaaatgaagtgacactctccccccacctcccgcccccgctccccaggtgacctcacttcctcttcctacctgcagcgcccagcccctcctcctcagctccagctgctccagctgcttggtgattcttggaacctgcagcctcaggcctgctctgctctgactcaggcagaacttacctttgggatctgaggggatagttttgcttcctgaactgactctgacctttggcatgtccacctgccctccccttccccactgcacacacctgttcccagtcctcgggcagcccaggagctttgacggaccagattccttcagataaagtagcagcactgaggggctctcatccacagtcagatggtccagggagaggcaccccttcccccctccagcctctctttgcaacacaccattcctggctgggcgtgctccactccacccgcctcacaggctgcgcgccggtctgcctcatggagggagcctcacccaggctactttgcaaatcccccagcaccctcattcccggcccttccagggatggggagattgccgcttcctcagacagttgccgtgccctagcaggagtctggaaattgccctcattgactacaacgaaatgaggggacagatcaaggagcccttctccagccccctaatacactagtgctggacaggggaatgccggcacctactgtgtgccagatatttgcaaacacccttttccaagcttacaccgccaccgctatgaggaagacagaattccacttttgcaaataaggaaactgaagctcagcgaggtcaagcggcaggcgcaaggtcacatcgcagcaagtggcagtgaatgaacgatctaagggagcgactgagggcgcgtgacgggcccgccgggcactggttcgtggagcgtggcggttacgggcggtgcacagcgcccgcagcccgctcctagcgagctggccccacgcgggccctccgcacccgctgcccacaggagcgcaggctcccagaggcggggccgggctcttccccaaccctgcgagtcgccccgcccccgccccgcccccagcccgccccgcccgggaccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtaggagctcgcccgctcggcgggcgcggaaacttgggccgagtttgcgggcggcgcgtggagaaggggcgggtggcgctgccccagggcgcccctaccggccggcccggggactgagggagccgcgcctgggccgaggggctgcggcttctggctgccgccggccccccgcgaacgggctgcggggcaggggtggcgctgctgctccgactttccccggacttcgaggctcccgggacctggtagcgctctgggtctccggcggagaacaggcgcctaatctggcgagaaggaactcaggccgagccctccggcctcccgcaggaccctgtcacgtggattgctgggggatggcgttgaggaggaggtatggggacaagggggcactggagggctgggcctgggggcgccgggcgctgaggcaccgcggggccctggacgcgccctgctgggatgggacggccctgcggttttctcgccacctcttgactcacccctctggcctcagcccaggctggcaggatcgccctgaggcggaggctgcccggaccctgtcgccgggccgcccctgttccgggacctcccgccggtccgcgggcgtcggtgtggggctgggtgcgcgggcctgcctgcgtgcacacgtatgcccggggcccgagcgaggggagagcgcagttctggaatggcgtgtgtgcagatgtgggccatgcacgtacgtgcaggcacgggtttgcatgcgtggcggcggcctgtgtgtcagcctgctggatgcacgtgcgtctcggcgccgccgggaggggcttggggacacccggaagcccgccaggtcgggtgcggcggcagcctctaagcgaaatcggctgtgggccctaggcacccgagttatgttcagggcgggtaggggaaaggggatagagaccgatcccgttcgctttcccctccactggagactttgggctgccccaggttgggttgtagcgtctggagagcccagagcctcaggtagggaaggtgggagatgggagaacactcggcgaggcccgatccagccctccgggagaatccagatgctggccacaattgggcaggaatcgcgctcttcttcctggtctttgccatcggccatcccgaggcccctagaaggtgaaagtgggaacagagagctgtttcctttcccactgcgtaaggcaggggcggtgctgcggtggtgggctcttctccgggaccctggcctgggtgctggctgagtgacgttggagcttggcagagaggatcaacagagctgcctctcaaggatgatctgagcctgctccctgggcacctgccctttccgagagcttgcttgcctcagtatgggtcagggaaggaggcacctacattttggcaactgtcttgagtggaggagtcgtctcccttgagagagtgtatcctgggctttccacctcctactggcaggagatcaggtcattcccacacccctaagagttctctgttggctccctgaagccgccacccctcccacaaagactcctgagggtcccaggtggtttcctgtctattgactgggtcccagataggggcctcaagaagtctccagagcaaagggtattccatgggctgagacccaggagagagggactcctggggtgggggtggggacccagcagaccccaagaagcatgtgggggaggtgagaccaaagtcagtacttaacccagagtgtcccaagggtggaggtggggaggatccacacttcaaaaccctacagttccttctcacagcattgctgtggagtgagatgggggctttcacccctcgatagcaggtttctatcataggacactgctgttgggactgtcacctgtgtcctaatggcccctctgtgtcttctctaggctggcctgaggtgtggggttctgtccaggagatgaaccagcttgctttctgggtctgccttggtggaagtgggcattggcccccacactagccttgtgttttctaaccccaaaatgtgccggtctaactcagcctgtggctgtcattggctccaaccagaagaggcaaggagagggctggtccttgcttgccagtcactgaaacctgtgacactttgccctaatcatagcaagattgagctaggtggtcctttctaagctactgagagtttccaggaatagggtgctggctgggggaggtagaggtaggtcagtgtggccccagaagacaggcttcagatgagcccctaacgggttactgggtgcctgctgccctgaggggcctcagtccccatccttccttggtcttgtcttagagctttgtcttttttcagcacatagtttttccatcaatacaatgggagtagtggctaagtagcactctggcccctggggcctccctccctggacttttttcttttcttttcttttctttttttttgttttgttttttgttttttgtgtttttttgaggtggagtctcactctgctgcccaggctggaagtgcagtagcacaatcttggctcactgcaacctctgcctcctgagttcacgcaattctcctgcctcagccttcagcgtagctgggattacaggcatgcacaaccatgcctggctaatttttttgtatttttagtagagacagcgtttcaccatgttggtcaggttggtcttgaactcctgacctcaaatgatccgcacacctcggcttcccaaagtgctgggattacaggtgtgagccacagcacctagccacctccctggactttcacacacgcccctgacgctgtcttggccccaccctgccatgtgcctaggaatcgccatctgcagcttgggggctgggggtggatccaggctcctcatgctctgggaccttcctgctggtgctgcagcaccatctgctgggctgccctgactcctgcggagggggaggagtggggcgagaggggtgtggcttgtacagactgatgtccccagttacctctcctaggggactgctctccagagccaagtccagtatctcagcattggctttgggcctagggacctgggctggaggcccgactctgccatttttgacaagatcagcaggtcagaggagtgtcacaagaaatctgtgaatttgtagacaatactcagattccatgttttggctgcagtgggcatcactgtggcatcttggaataggaccctgtggtgggaggcaggaggcctgcttctcgttgtgtctatttcattggtgactttgggatgaatgggtctcctcatctgtatatgagggggtggcggcagggtatgtcaagtgaccctgagacccagtgcccctacaaattctgaaatcccaagaaggaggggatcttgggagttgtatggaggaaaatcgaacagaaggggctcctggagtggggatgggtgggggttctgtgtagaataattcattaaacaaagggttctgcagcttaaaatatacgagttggggtcaggagcagtaggtggttcatgcctgtgatttcagcattttgggaggccaagatgggaggatcacatgagtccaggagttcaagaccagcctgggtaacatagtaagaccctgtttctacataaaatactaaaatgagccgggtgtggtagcaggcacctgtggtcccagcaacctgggagttgggagaatcacttgagcccaggaggttgagactgcggtgagccaagttcatgtcattgcactccagcccgggcaacagagtgagaccctgcctcaaaaaatacatacacgagttggaaacctctgtcacgtggctcatgcactcacagtcttaactgagcatcatttaagcgccaggttcttaggtgtagccgtgagctgatgagagcagcagccctctgttgctttgcctgtagcctgttttcctgacagcccctgcctttctctctctatcccaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcaggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgcgggctgtgccacagcctggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggagggcgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgtgtgtgctgtgtgagtgcgtcacagctggggctgagtgattccaaggactcctgcccgggtagggggctttaggatgagctctaggtacccccaccccttgaccctccagacaatcagtgagcaccttcatagcctcttttgtaggcttctgaacatgccagctgctctgtccccatggaaactcctcggcctcccctggtgctgcaccttcttggattccctcctcctctgcctgtgccttctccatctttggtgcagtgtttccggcactctggttaggccctgttttctagctgagataatttccctgatctccagcctagcatcccctttgtgagctctagccctaaataacccactgcatgctgggcctcagcccctgggtctctctcccacactgaactcatcccaaatcacactcccgagccttcccctcagctcacttcccacaaccagttcttttccatgtcagtgaagggcaccccctttcacaaagctcctcatgctctagacctggtgagggccacagctgcctttttgaacgtgtagttttgcagtcctccccggcccttacatacacagaagtgtgcgcataagtcgcattgttttgtggtttgcttttcctctactaaatgatgtgcctgctgttctccagcttgttttcttttaatgtcctggaggaccacacaactgccgaagtgttgtgtggcgtgtatgatcacacttcttcagctagggatctggtgatgggaccaagtggattctgttattgcccctcctgcgtcagtacacctggcattgcagcctgaggccccctctagtttttctctccctgctgcccccaattccaccctctcccatttccactgcccagcctcttccctgtagaaactgttcctagttccatccccgtagtggcagccttgccccgggcccttacctggttgggatggggaagggcctgtggcagtgaggtgcagatgagcttaggggctggctgaccagaatccctgatccctgagtacttacaaaattggagcagatgccttaatgggatgcaaaggaaatccagactcaggcgatctgttactgagtgagggtcccacatcactcagggctgggctgcccagctcagtcctctccccatacagttgggctgtctggggcccagagagggtcaggtctgtttctcctgggctgcctgatcagcagtggagtctgggcactccacacagtccgaggtgctctgactggagcttgcaacaatcggggggcctgggaagcaagtgattgagaccaggcttctggcttctggctgaattttgttgcccctgtcctcactccctcccaccttgggggccgtttttctctgtgtgcccctagacagttatccctgccttcctttgttgtgggtgggttcctgtgctcccccagcatggctcttaggacagtccctacctgggctcggcctcgggcttgggcttggtctctggggctggtatggcagaaacatgatggctgtcttatatatggcagggtcctctgttcccatgcctcagttttccatctgagcaatgggtattggaccaggccaatggttcctgacctgctgagcccctttgctctcatccttgtacccaaacagcctctcctgagtggtgccctcatcagatagagttctggtgtcacctggggagaagcacatcttttttgcttggatggtctggccagtgggcatgtgtggggaagagttgtgatgccagcctgacttggggcagagcagaagcactgtttggatggctttggaagccaggaggtgggacctgagggtatggggtctgcaggctgactatgtgttcgttttccaggtgactttgacactgaggctggagctgtgtcctcctcagagcccactgtggccagaggtgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctgctccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaagtggggcctgtccgtgtgtttggggatggtcggtttcatgttccgtcactgtgtgcttagccctttgctcgcaggctgctctccctgctcccagtccagaaggtgcttctgcaccctcgtgcagatggctgtggctctgtggacccctctcacacacatacttgcttgctctgggaaagccctctctcctgagaccccgtgggtcctcgtggttgttggtctgtgggctactgcctggtgagaaatgctggtcattagacccagcacgtgcctctctcccagggccagacatgtctttcatggtctgggtagaactgttacagcctccccattgctggtgaccatgcatcccactgaccttagcttggagggtggggggtagtgtgctgggcccaccctctggagaccctgcccctgctgggctctgttcccccagaggcttgttctcagggcagctaaggtggcttcctgggcctgtcttcccactccccctgggccaggggccagtccactggggcttgttggacctgtgtggcatcctggtggtggtcactgagcccagctgcactgtccctcctgtgccagcctggccttaacactaggctgggatttggagtggcagctgccattgtccccttccattgttcatataggcccaagaagagctactgggctgtgaagggataggtaaccacaacacattgtggctgctgcagtgacaaccagggtggagggtccttgggtcccagaagaggtgatacctgaattggaccttgaagacaaatacaaaatcacatgcaaagtggggtctgggtagagagagccgcacgtgcagagtcttggtgagtctggaacaggaaaatccccaggcgaggctggagctcccagaaccagaaggggcaggagcagggcttggaagcctggctagaaatccagcaacccagggactcagtcccacaacctgaagaatggggatgtgagccacgtggaatcatttgacactactacagggaggaaagaattgcagtggaggtggagtttctgaactctgggccccccgggccctgggcagccatgggcacctcgtcagccccatcagtcacatccatctcatcgtcagcaccttaatggagtgagcgctttattccttttccttcggtcctcccttcccgccgtcctctcctctccctccctcccttcacacctgtgcccctgctgtatgcctgacacacatcttaccaatggtgaccaggcagagtgagggctcagaacaggtagggcttcgcacctgggttcctctgtggccccagaggactcagaatggtgcagaggccaggctggggtggtggagagccaggcctggctggggtggtggagagccaggcctggctggagtgaggtgctgctctgcgacgacagctctatgcagggaggccctctcttcccctgcaccagtctgagggaagagacttaacccggacttgggagttctagtctaaggaaggagatatgacagtgtcccagggacccccagtctgaggtggtgggggcaggaaccagactctgcccaggactcctagtctgagggaagcagcgccctacctagggctgccacccctagggcaaggaaggagtgagggcagtggagtgtgctggccccgcccccacccccaaggagacccgagcaggtccacctaagaatggggctcaggtgagacccagcctcaccatgccccacctggcaccctagcccaatacaaaaggcaaagggcctgggcggccggctttgctgacaggagtggagctagcaaggtagtgagtgggaaggatgacagccctgtcttgggggactcggagagtaggagctgggaaggggagaggggctccccggacagagtcgtctcatagggaacagcacctccagccaggctcagcactacaccaccccaacctggccttggcagggaccctggtgctgagccctgcttgtcctgaggcctcattctgccctgtcgctgctggcaacgcccatgtctggggtgttgtgaagaccccaaagccccttcgtgactccagacgcctctttccctctgtcattcctggcctcattgatgttcctcttcccgtgagtttgttctcactaagggggttgagtcgagccagctgagtcttccctcaaacctcctttggggatcctcggagcaggacccgactctgacctgactggctgtgactcttctcatcctgcagttcctgtgccggagaagggagggccgaaccccgagcccagcctgctgccccagctggtggtgggaggcgggccatggggacgcttcagcccgtggacatggccttgctgctggctatatgctgtgctctctccatgggcagctccccaagaccccacctccagacaccccctcagtggggagcacccagtgcagctcttctggagccctgtctgcccaggagatgggaatgggggaatgctgccaagcccctcctgtctctcctgctgcacatggaccccttttccagggtggcgggaagctgggggcctccttgaggacgctgctgcctccatggggactccaactctggatgttctagctatggcccactcagaggtgcctgtgtcgatgagccctccacccctcctgccacagcccctagcctcagcctgcctggccactgttcctcccacaccctgcctttgtccaagaggggcccagcttccaggtccctgtgatttcttaggacaattggaacccagggtcctaggaaggggtgctgagccccttggaaggacctcaaggggcctcttctatgatttctgggtttgtcaggggatcccttgcttcttcaagagcctctgataaggcatctgcagacccttttcctcctcagatttggatgatgggaccagggcaggcccctcctgtatcccctagctcctctccatataattcagaacttggggtcccaagcttggctgcacctcctcaaaccctgtaaacctcttagacccaatcccactacaccctcagaggggctggggcttcagcttgggccctactacacagaaagctagtgcttctctgcctcctgctgaggccttgatgactcctcagtgaggcctgggctcccagctgccttaagtaggcaagagaccctggagacagccgctactcaaggaggcctgggttctccaacagacctggggagcccgcctgcctttccacaaggcttggtacctcccttgggctagatctggggtatccctgtccatcctttgctgccacccttctgcttgccacttcctggccccgcggacataccaggaccctagcttccagaggccaggtcttccccagccccaccctgccatctgctgccaccctggcatctctaagcccagcaggccacaagagtccctagctactaaaagactggtccccaccagatctgcccagtgcttccccagaggccagtgagcatgcccagcccccagcccttggtagcccagccccttctgggtgttgccagcttggagctttcttctagacctgtggatgctatcctatctggagttagcttagacctctcccctggcctcctgggcacttctggccctaatcccctggcagcctgttttccagcattcctgggactggtggggaggcctctgccagctcagcgggtgcccctctgcacaccagacttgctttccttgcaaccccagcaggaagcctcattctttgtggcatccagcccacccctctgatgtgggccctaaacctccagctggcccagccctgcagagtaggtgcccaaaggtatcttcagcggttcctgtcatgctggtctccccccagggtccccttctggagcctggcaccatagatctcggtggggtggggagtacagctcagtctcccttccccctcacaccactcatagggggccctgtccaccaaggcccctgactgctgggggacccacacccacagcccccttctttctgactgctggcccttccccagcctggatactcgagccctgggcagaggggtaacgatcccaggactgtcttcgcaggcagagaggccacttggtaccaggccctgactccttgggctgagctcagcagcaggcgtgtcaccaaggccccctgggcagaaggggctcagccctgagggcccatcactcgccacgcctgcatgttcctgctaggcatccaccctgaggacccagcttccccctgcccccagctgctggcagccccgtcttgactcatccagggttctggaggccacgccaggaagtagcctgcagctggaagaagcacctggtgtttctgcgtcgcccaggctggagtgcagtggcgcgatctcagctcactgcaagctccgcctcccaggttcacgcagttctcccgcctcagcctcctgagtagctgggactacaggctcccaccaccacacctggctaattttgtttttgtatttttagtagagatggtgcttcaccgtgttaaccaggatggtctcgatctcctgacctcgtgatctgcctgcctcggcctcccaaagtgctgggattacaggcgtgagccgccgtgcccggcctctgcatctttttttatggagctgacttgggtgggaggggctacagactcaagggagactgcaggccaccccttccccactccctggctgggtgggtttccagctcaggagtctgattggaaggatgggaccgtcctgtcacagaggcaggtctgagtagtccaggcccagttttaccctccagcagggcccctttcattcatttgtccagctggctttgcccaaagcacaagtgatgtctatgtggactgtgtcccctgtccccaaggggagtctggctccagtcctggcctggaactcggagaccttagaattagaggccacatctggcagggtggaccagccagggcaggtaccatgttggcagccccagacctgacaccacggctcccgtgtgccctctccacttccgtcctgcacatcacctatactacgtgctgtccctgatgaatccaagctgtcagcttccatcagcttggctgggaagtcaagctgaccaaaggggaatggtgcagcctgagttgggggctgagtaggaatgggcctggtgtggggtgggggaggtgggggtgaggcgggtgtctggcacctctctgcttatcttcccttctcccttgcccataaaggaggcatcttctccatgtccctctgccaccctggggacataaaatactgccccaggtctgtcttcccttggacatagcccacctaccttcctgtgggactcagggctttgttttgtcctgtggcccacatgagaagcagttatccctgctctgctcagctgagagaggacaaactgaggcagagcaggggaacaactctgtcatagtctggctgttaatggcagagtcaagaccactgagtgtctagtggaccaccaggtccactggacaccaaacgtggaggctgtattagcccgttttgtgttgctctagaggaatacctgagactgggttatttatttatttatttatttatttatttatttatttatttttgagatgaagtctagctctgtcacccaggctggagtgcagtggtacgatctcaggctgctgcaacctctgcctcctgggttcaggctattctcctgcctcagcctgctgagtagctgggattacaggcatggaccaccatgcctggctaattttttgtatttttagtagaggcagggttttgagatagagtttcgctcttgtagcccaggctacagtgcagtggtgcaatatcggctcactgcaacctccgcctccagggttcaagcaattctcatgcctcagccacccaagtagctgggattataggcgtgcaccaccatgcctggctaattttgtatttttagtagagacagggttttaccaggttggccagcctagtcttgaactcctgatctcaagtaatttactcgccttggcctctcaaagtgctgggattacaggcgtgagcaccgctcctggccctgagactgggtaatttataaaagaagtttatttgcctcatagttctgcaggctgtacaagcatctgctaggcttctggtgaagcgtcaggaagcttttactcctggcgggaggcaaagagggagcagacgtgtcgcatggtgagagagggagcaagagagaggaggcatcaggctctcctgtgaactaatagaaaactcactcattgaatcacttgaacccaggaggtggaggttgcagtgagccaagatcgcgctactgcactccagcctgggctgtgagtgagactctgtctcaaaaaaaaaggaaggaaagaaagagaaaaaaaaattagaaattagaaaactcactcattaccatggggagggcactaagccattcatgagggatcccccaccatgacccaaacacctcacactataggccccacctccagcactggggatcacatttcaacacgagatgtggatgggacaagtatccacactatgtcagaggcctccctgtcatcagagtcttctgtcctcggttcaggtgcatgctggcttccatgcctggcttcctaggaagtcatcttggccccatggggttgggccgggccactaggctgagggttggagccctatctctcctagtcccagcctgggtctccatcactgactagcccgctctgcttgctgcattctctccacacctgttccctgtagcccaggggtcagtctgggtgcaggcctgggtagaggtccaggagcagattctgccccccagctcatacctcctgtgcaccatggcagccaaaatgcaccagcatgaccaggagtgctggcttgtccctgtaatcccagtgtttttgggaggctgaggtggaaagatcacttgagaccagcctaggcaacatagccagaccctgtctctacaaaaaataaaattaggcatggtggcgtgtgcctgtagtcccagtatagcaggacaagccgcagacaaaacttcgtagacaccgagttgtagaagaagggctttattcagctgggagcatcggcaagctactgccttaaaatccgagctgagtgcacaatttttgtcccttttaaggcctcacaacactaaagatttcacatgaaagggtcgtgattgatttgagcaagcaaggggtacgtgacaggggctgtatgcaccggtggtcagagtgaaacagaacagagcagggagtttcacaatgttcttccatacaatgcctgaaatctatgggtaacatcgggttctaagtcatgagttgatttttaactactaggtttaggccaggcaggcccaggcctggctttgggcctggcgctgggctgcctgtctttgatttcacttccttgtttttttcttaaaacaggtactgagtataaaacaatatgagagagcctctctcttccctcaccagctactcaggaggctgaggtgggaagattgcatgaacccaggaggtcagggctgcagtgagctatgattgtgccaccacattccagcctgggcaacagagcaagaccctgtctctaaaacaagaaacaaagtgcaccagtgtgtggattccagcttctcctggtgtgtggacatgacctcactcggccccatcagtgagtgggaggctgcctgctgtcttccagaacgttctcatcactacacctgtgttcctcctgcattctctggcaggctttgtgaggggacctgtcacctacctctctggctgccctaaggcccagctcaaaccttccctgcccctgagaaccttttcctgaagagtcttttccccactggcaggccttcttatttcagagcttttggtagggtgagtaaaaggatcgactctctgctaccagcctgggaggaattgtccctagggttgggtctctggatggcatatgagggtctagaccaggacccagatgactgtaacctgaagggcaggacctcagctgccccagcttgacacagccccttgtccagcctgaccttctgggacaggcccgacccctgcatcctttggtcttggtccctactgggaactctggttaccctggcttacctactttgactccaaaggcaatgctgacatcccccgtgagacacagtgacagactgagactaacgtagggttacctggctcagagtcaccatggccaggcagaggtcaggtcctggcctggttcaagatcttccccaatgcccttctagctctggtgccctgcagggtctaccttggagcacctggagcccgagaagctgcccctcacctttgagatcccagggaccccctccctgatcatgatgaaggcggaaccaaacccgctgaggtgcctgaaggaggaagggtcagcctctgcctcccacggcctctctgatggggaggatgttatcgcagcagcgtgagctgggagcggaatcgggaggataggggttttctctatgggtagctctgggctccagggtggagcccttttaacctggcccctcccctgtgactctccttggccccaagcaaagaaagcagcttgcccgaggtcacctgacaggtaggaacagagtgggacctgggttctttctcacccagctgcagctcccccggcttgccccacagccccttccaccaggtgacacagaacctggcaggctgtgccccatagaagagttcactttccttctggtgagggatgggaaccaccttggggcgggagggatgaggggtctgggggctctcccagccctgcctcacatttgaaggatggcatctgggtggcagcatggtttaggctacacagggcggccccgaggtttatagcctggcctcgggcggatgctgccatgccaccttctcttttgcacatcctgacctggcaccctacctagttaaaggtcctcaggtctcctgggcattgcccccactccctgcccagacacagctgtccttgtcctggactaatcttcagagattcttgtccagcccacagctttgctggacatcgcaggctgggccaggtcccctgcccagcactaacatctctttgtgagtctcaaccagactgagctgtagcgtcagggtcagggtaggctctgacttaattgatggtgtcaataaacccccaggacaggggggtttattgatggtgtcacatctgcttacattcttggcctctatggtctctttggggcatgatacccctctgtcccatgcttaggtgcccacatgtggccacaagtgcctttcctaccactatccctacttgaggccggtgtccaggaacctgtggctccaggcagaaggctgagcgcagagccaggcctgggcagacattccgcaggggctgcaggagctgacagccctgaccacccagcccgtggccatccattccccttcaccgtggctggcccctcatccaccatccttccaggggccaggcctgggcccaaactgacttttgcctgccccagtccccctcgtgttcttggctgagtgtgatggtcttgcccgtttccttgattatcctcaatcagaggtttatagagccacttggggacatcacatctatctaccaggtcctcaccagagacatgactgccttgggccgggcctgggatagtcaggggtcagactcacctgttgggacctggcttcagcggcttcaatgtgggcaatggcctgatgggcggctgccccttctcctctgcttgggggaggtaggagaggaaggtcaggcaggagatctgcttccggcccacctgacgctggttggaagcagggcgcccacctgtgcctgtctcacctcgctgcaggtgcatcggaggctgaaccgctctcctgatctcctgcaggtgcagattccacatttccagtgggtgtcggggtgggctccagagctctcctggccctagggaaccctgggctccatgaggccttggcctagccagattgtttcccacactgtcacctccccataccgtcacctcctcaaacatggggctgcatgctctgtgccctgggtgggacattggaaggagttccaccttccaggtttggatcacagtaaagcctctgccatggggatgtgctggctgagacagatggggttgaaccagccctgtcactttggccttgggcaagtcacctgtgccttgcttccctttccccagcagccagacggggataatagcacccatttcacccgtactcaggtgctcacttgttagcgggaactgagtcccagaggaggtgcaggcagagccatcgagaaagcactgcagctggacctgggtctgagtcgcagttcctggctgtgagatgcgtctctccctctgtttattcatctgaaggacagggctgtgctgttctggggtcactgtgacaattcagctggcctgtgtgagttggtggtggcttcctgagatggtttgaggtgggctggaggtgtgtcttgaatgccccctcgcctccatggggaagacccacttagggaagactcgtggctgtatggaggaacccacgttccctgccccccagctgtcctctgtcctttcccagccccctctgctgtcctgcagtttctggcagtggccatccagcttgttggtcatctggctggtccactcttccaggtggaccctctctcctcatgtggtgcaggtcccattgcaccaccaccagacaggccatgctagccccagggccccctttccctgttacccagcccccacccccagctatgtgccccctccctaaagcccactgtgtccaccagctgtgtttgaactgtctgtgtgcaagacctcatgcaaagcctgaaacagcctggcttgtagagggccaggagaccaaagcttgaagagagagtgacggtctcccagagcccacttagcctcagccccagggctgtgtccatgctggtcctggctccattgagccaattctctcccatgacgcctgtaagggctccagtggtgatggaggtagctggagagaacaaggctgccataaccctccctccctgagaaggcccaatggggaacgttttaggcatcagggcattctgggggcatcttccagggacccctcctacaccctgccctgccctggctctctagtgagaaattgcagttgcttggacagtggggctgacccaggacaaatgcatatattgggctggtctttggggtgctggggtgggggcatgggcgcttcagggataggaaggagaggcctgtgtattccagaagtacagaggaacctggtgccggccacagtcaatcccgatgtgatgatctttctacccgccctctttgatgtcttggtgctggctgctgtctttggccacataagctcatggtctgggttcctggggtcccctcgctgggcctccacactgcctgcaggtagaggagccttcaggccaggactatccttggctcccctttccaggtcatgggttcaaagaccattcctgggttccaccaccgccaagcctcaatggtgtcctgatgggcacgggagctgctggggcgttctgggttaagacccttgcctatcccagtgttcccccctgcagtggggctgcaggggttggcctcagtctctgccctgggagcctgcctcaccttggcctggcggccccacacctgccctggaagacccccccacactcagtggctctgattcactgtagagcagccagggcccccgttgctcacaccctctggcctgaggctgactggctctgtggctgggtttgggggtcagggaggggggtgggccttgccctcagcagcccccattcccactccgaccccttttcagtcttcctcctcttgtgggctctaccctggggcgcccccagctcctcacaccatatgaccgtctaagtatctagaaatcagttttttaaataccaactttggattgcttcctgacttttccatacccccaaagggccagtgtttgtcttaggactgacagtccctccagctctactgggccagaccaggcgggcgtaagggtgcccctgccccagccctctttggggcgggcttctgtccccttcctgctgcctctgcagctgagttcctgccccagggagagaaacttaacccagctctgtggggatgaaggtgccctgcaaagcgccacgggagggctgccaggctgccgtgttctgctgtctgaggcccgccatgctgggccacgcccagagccggcctgagtgcccccacctcagtgggctttgtgatgtgtatgtacaggatcacaccttgccctttcctccggtctgacccttccctatctccccgcctcaaccccatgtcctgtgtgtgagcacccagctcactctcgttcctccctctccaaagtgtggtccctggcagcacgagtggcaagagggtcagcagagactgcggacacctgagctgtgcctaagtcctctgtgtggtctagctgtgtgtgctgggggaggctcttggccaccatttccccctctgtaaatgagaccgatacctgtggcatggagggcgggaggctggtgtgagtgccaagcacttggagcagggccctgagtgagcatggacgtgggagcaggggtgtttctcaactttgtgcaccttggggatgggagtggggctccccgcgtgggttgacaaggcattgctttcccccaccccacctctgtcccagccctgcaagtccaatccttgggggttttggagggaagaagccctggctgtgtgtcctcgagctggtccttggccctctctggctctgagttctggggaaagtcagtggtgctggaactccggattcattcctcagggttgaggcaccgtctgtggaagccatggggcaaggtgaaggcagggagaggagaggtttggagtttgggtttcagcagagggagcagcagcatgaggggtcacctgtgtgtagaggaaagggagtgaaggccaggagtggggaatgagtctgagtgcacccaggacggtgctgcgcctcctcccacatccacttggccccgggggagggagaagaaaggccataagacaaaggggaagctgagttgggtccacacatgtccttccaggacctggaggtgccactgtctggccctcatgcagtgggaagtgggggaaggaagattccctccccacacctcctgttctctgtcccaggtctcctggcctcctgtgctcctaagttcagtctctgtcggcccccaacatcatttctagtgttggtgggagggagctgggaacaggcgaggggtaggtggggcctgcttgggggagtctgcctgactgcctgggccactgcccacagtactggggagcttttctggcacaccaactgcaccccccaggcactgccaatgacagcccccggggagtgtttgcagaaggccttggcaggaggcgcggtggaccccacccagaacaaacaattggggtggggtcagggagaaccgccctccacttacctgtctggagagggtcctctgtaccacactgtgtgcttctacacacccaggctgaacaccccatgggaggccctccactttagcaccttgacaagaagggtggggacactgggatcaggcccagccccctggccccaaaccgtgcaaccccagctggaggatgaggagatgctgggcttgggtgggggaatcaggggtgtaaaggggcctgctcacccctcagcttggcttaaaggctcaagaggtcaaaggcttaggctgcccctcaggaaggcgcccgggcccagccagacactcaccaggacaagggccagtgtgacgagcaggaggcccaggatgaggagagccacggcatagcaagggatggaggcgtccagcggactggagacttcagggctgggggtgcctggagcagagcaagaaggccatggccaggcggggccctgcctcccagacttctgagaaggcagaatctgggctcagaaggtgctgcgggaccagggagctggggctaggagcaccttggagggctccatgaggaggggaggcaggcttcagatcagggcatgtggaggcagcgagcccaagggaggaggcagatggacagagggagggggcctgcagagggaaggaggtactgaccgaggtctgggatgaccatctccaccaagaggccctctgccttccccagggtgtgcagaccctggcgcaaacggtcccacatgagagcctgggctggcgccgccctgaagaaggtggcacccattctggcagtcagtggctccggcctggtgggaggatcatcacagacttcagggggctgggcagccttgggggactaggggaggtcatctcttccagcctcctgccctcaaccccagaacccaggtctgagccctgggtcacccagggccaccctgaacccacgggaattcctccaccaccacttggtcaaagttctgcagaggtctgaggatgaagttcagctggggggtcaggagaggatgaagagggtcacagctctaccaaagtcttgtccagtcatcccccatcttcccgaggcctcttcctcgaccccccacttcatcccgccacttcacccatctcgtcagctgcccttgaagtgcccagaactcagggctggttttgtcctccaaagccttggtgtagggctggaccaggatctgcagccaaacttcatacagcaccagctctgccttctcccctagagtgatgggggtggaggtggcatcagcctgcatcccctctcctggaagccctggagtgggacacacacccaagctcttatgctccatccaggggtcagctgccactggtctaaaaaccaaatttcttgctgcctgtttttgtgtggcccatgaattaagaatggcttttacatgtttaaatggttgaaaacatggaaagtagaatcgtatcttgtgacacatgagaagtacgtgagatgcaaacttccatgtccataaagaaaggtttccgggaacgtggccacgctcatttgttgacatgttgcctagggctgctttcttgctaagaggagggtttgagtaggtggtgacagagacccagtggcctgcagagccttaaagagttcccatcgggccctttacagaaaatgcttgctaacccctgtactaatccatctaatggaatacactgcccactccgtgagttgatcctagtaggaaatgttgctgataatttaacagctgctgcttttatgttttattttgtccctgatccggtgggagacacgtaagaaaattcactccctgggtggaggtcatggtggggcttgtggccatcaatggtgaagcctctttaagaggacacatggggagctctaccatctgttgagagggttgtgaggggccctctgtgttgaggaatgaagagggaacgctgcctgtgtgctgggagctggctttctggggagcagaagagatggtggttcgggcctgcggaggcagaggcccaaaccaatctggtctctggggctgccggcagggagagtagttgtgtaggagtgagtgcaggggcaaagcccgaaggagggcacccctgaacgcacccccgaccgcacccccaggaggctgtggtggtgggggtggggcagcactgtaggaggaccagcaccttctgtggctgaggggtcctcggagagcagctctgggctgtgcgtagctggaggggactgatttgacccagcgctctcctaacttgggtgtggaacagctctccctgtttgaatggcaacaagcttgcagaagtcatcctgcaggaggccccaagaggagatatgggcttcttgcagcccctgcactggggcagagctgagggcttttgcccctgacttggtgggacagatcttgtcatgcatgtgaggactcagtgaggtcctgggcaatcagggaggtgacgggaccctctcatccttctgatcttgactgcttctcgcctctgtccagctccttgctaaagctctatgccccattcctctctgtggccccaacacatgagcaagtgttgtctgaaggaaattctgcccattctctagaaggggaacaccaaggtttagagagggaaagagcctgctggcccagagacacacagggattgcagccccgactcaccattggccacgatgctggatttctggaggatgggatctgttatgttttgggccaagtgattagccaggccttggaggtgggtagtgatgggagtctggaacttgtattcgatataaacacccacccactggtccgcattgctagagaagcacaaggggagagtgcagaggtcacaagctctttgccagcacgtttctagagcaggtagagtcccccaaaatgcacaccctctggcgtgggggccccctaccttctaggcagagctagcttacacagccaagctacagctacctggggcaaagtcctttcccagctagccccaaacctacacccccacatcctggttctgggtcacagagctgcctccctctgtcccagggcagcccccaagagagcagcagggcaggctgagtggatgggagggggactcgacccacctgaagaggagcaggggcctctcctggggactcgccttgtagaatcctgacaccaccggtgtgacctgtgggaaaccctggaggtcagggcgggcctgggagctgtatctcctgagacccagtgtgggatggggaccaggtgaggtgggaggcaggacctgggagggagcgcacccttaaacacggcgtcctgggtaggagtgtctgcttacagagcctggctgtgttcccattcggacagtcacctcctccttcagagaaccctctcccccagggtgccctctatgactgccttccgccatagtgccatggctgggtgctgcctccatgctgggaggcctgcttcaagggaggtatagtgagtgtcctcactatgccacctcacctgttggaggatctgcctttccagcaggacaaaggaaacagaacccggtacgaggagctgcggcaggaaggacctcatggctgtgaagcggatgctgatggtctcccgggccagggtgatcaagtcggcccctgtagagccatgggtgagagttccggaggcgccaagaccctccttgcccaccgcaccaccaggtgcttcggggtcagggcagaagttggatccctccaggaagtccacccagtgctccccctggggaggtgaaaaggcactgcggtaggggcggctggggatgggactcaccatcagaggtgaggctgttctcagccaatgagaggttccccagcatgtgccctgaggtcttcactttgcgatacaaagcccagaggagttcacagggagaggggcctggggcacggcccccaaatacaagggaggcgttcaccgctacagagccaggcctgtgggggcagagccacgtcctcagccagggccagtgggggcatgaggggtcctgtgcacccggtgggggccaggctggtgcacgagttggcatcccaagggagggaagtccacaggggaagtcatgggtcacgcagagaagagcctccctgtgtaactcaaggcaagtcacctcacccgtctgggccttggctgcctcctcagtaaaagggagataatgatccctttcccagaggattgctgtgaggcctgaatgactcagccaccagcatccaaagcaggcactcagtgaaactgagttcccttggacaccccaacaagccggctgtcatgggaataccatgaatcccacccagggagctcccagggcagggttactcagccaggctgcagctggctgtgagctctcagggtgataatctgggtcacactgagaaaaacatctttggctgcatcacaaggagcaggggctctggagagagggagatgacaggcctgaagaatctctgaaagccagtgggagatggaccaattgcccatggcctgaggaggtaccctggcctcagtaaggcactgaaggagctttcggggagagaccaggaaacaaataagaatccagaataacttttgtccttcccctgagcacttgcgtgctgtgcatcttgggggtggggagagaaaacttctcttcaggcccagggcagggaagtcatagaaggcttccatttattaaaagggaaaactgtctgagcagctcaggagcatggcctggagagagagtgagcttcctgtcactgggagcatttgagcctttaaattacttacaggattcaaagcccacagtgagctcacaactcaagtggggctgcagtgatttggaccttctcagcctttctcatgacatggcagggctgctctccgctggcaaatatggtctcggtctccctcaacatcctcttcccccagacgcttagagtggagggccctgcccaagggatttgcatccctttgcatgtcatttacaagcctgctgcccttgctgcctctgccttccccactgcactcagacaatgcctgatgttcctgcccacatcctgcagctggaatcagggctcagggcaggccaaagggcatatgaggtcacacagcatagccagtggcagaatcagacgtgggcctcctccctgcctgtccagggctcttcctgcctctgtccccaggtgctcctgaacagggggtgggacgggcagagctaggcatctgggacagtgcctttgtggctgagaagggtcagagcagctggtgggtgatgggtgggccctgagagccacgtgcactcacctgaagaccaggacaccgatgccctggaagccggggaaggcctcgtggtagaggggctggagctgaggatgggcagaggcatggaaggccggcacgtgccaccccccaccttccctcctgccctaacccaccccctctctgaccctaccacctaccctcgtccaccctccatcatcttggcatggtccctgcaatggtccctcacggaccacctgggattcccaggccccgcccaagctgttcctcacacagtggccagagataacctgccagtcatcctctgctgaaagcctcaaggtctgtctgggcgtcgtggctcatgcctgtaatcccaacactttgggaggctgaggcgggaggatcgcttgagcccaggagttcaagaccagcctgggcagcatgacgaaatcccttctctaccaaaaataccaaaattagcccggcatggtagtgtgtgcctgtagtcccagctactcgggaagctgaggtgggaggatggtttgagcccaggaggcagaggctgcagcaaacacccagccttcctaggttttttcctctctgccgttttcttgaaaatcgctctccaatgcagtcattctcagctctgcattggacagctgccatgttggcctgccatccagacctctctcacctggacgactgccctgctcctaacaggcctccccttctccctctcccacccctgttccaaatgcttctctttacagcccctctccccggtgtccctgtgcctctgctgcctccaaccacctcttcacctcagggtcatcacaggtgctgttctctgcctagaaagcccctctgtgtttcatctggccaccttcggtgtcccagttaaaattcccagttctcagaaaggtgtggtctgggcagccccctctccccagcagccccctctcgctgctatcctgtctgcacttcccctttccatagcttatcacaactacgatgacatctggattcatttgatcactccttgtagggctgtcctctcctccagactgcaggctccctgagggcaggggccatgcttgctttgcttactgtggtgttcccagcacttagcaccatacctggtaccgtaggtgctcagttagtggtaggaagaaatgagttagttgactaaatgaagggatgaactaataaattaatggacagagactcagagttccccctggatgccagtcaagaaatggcacttgctggctagggcacccatggttccagaaccaaggcggaggcggatttggttttggctgcaggaactctgcctcgctttgccttactggccacctgcacgctggaggaggggccctcacctggtggtggatgatcttacgcagcagctggtgcttccaggaggcagggttcaagagtgcagccgagaaggcttcattggtgattgtgaaggtcacggagcgcgtcatgtgactgggtcctggggtagaggagactgagtcctggaatgagaaggtctggctgcgataaggcagggcggaagactggatggggtcagcacccccagggacccttggggagctggggctgggtggggcagagggaaggcgggaggaacatctgagagggagggtggctgtggtggctgggctggcagggacccctggcccaggctggactgtcccctgaagtgtggctggctctgcaaccatcaagggtggtagggtgggtgggaggctggaggatcagtgggagaatctgtgcttgtgtgtgggaatagacacagaagggtctgcagaggttctggctctagtacttacaggggaaactggggccaggattggggatagtgatgcagttggtgactgaaatggccattgtggtggggaaagtgacagtgacagcgacaaagatggaacaatgtgtagtggggacgaggacggggccaacacaggtgagaggcatggggagaaggacagtgatggctgtgaaggtggtgctgctgagggcgatggcaacgtcaaaggaacactgggccccgggccccggctggaagccacagcctctctgggtgaccctgaatcccctatgaggactggggagggacctacaggggtaagaggctctgtgacagccaacgtgttaacgatcgacgcaagcacaaatgggctggggggttctgaggacacagccttccccgtggtccctggagccaatgtcagcgatgaggaggcttctgggccaaagctgctagcccctgacgcaggcagcatccaggcatggggactgaaggtgtgcctgcttgggagccagggcatccgcggtggggatcccaatatgggtgcagaggtggtgggggcagaggatgttccagatggctgctgggtaggtctgggggtgccagaggtcctcagggttgcaggggcaagagcatgaattgtcacagacaactcaggggcctcactggacttttgcccagacccgagataccttgggccaagagaagctgatggtggtaatggggcagcaatctctggagatccagggaccaacatctcctctgcaggtccagccacagatccagacacaagtccggccacagaggacactggctgggattcaggggttctgtgggctgtgggccaggccagtgctgatggggctggtccaggtggggccctgcctgggaccccagcagttcctgaagggacagcctggtccgaggaggaatccaaagacaaggcgagaggagcttcctggtccccagatacctcgggagagagggcttctgcccttgtgctaggagcctcccctttcctctccgctgagagagagactccatcaacgatggctggcaggatgttcagtgacaggagtgtcttcttgctgttgccttgcaaagcggacgtgccaggggctgagggaggccagccggggtctttgtgagtagaaggaaggttcagggcggaagctgagaccatccagagagctgcaaacaggagatgcctgttctgcctgccacccgggggactggggggtgggactgcccacagcctgtcagatgccacaccttccctgccacctccctcgtttgggaaggggcctgcggagatccaaaccctggcccagctccggccccaaaccactgagctaccccaggaaaacatgctgatcctaacccaccagagctgagggaagcaggaggggacactgacactcctcaaggacccctccctgtgcctcccaccccaacaccacccatcgcagggtccctccccaagggcctcaagagctccccagggcgatgctgtctccaggctgggggccctggactgttctgtttgaatgacctgtgaggtccacgccagcctgagggtgccaggaagtgctgcccaatcctcatcataagacaaggctgttgccttatcacatcctcagaacacagcaggctgacagctggaccttaaagtattttgtggggagggcgggggccatctctgaaagccctgggggctaattccacacctacctacaagtgtacactgagatccatgcggggtctgccctgtgccaggctccccaaagctggtcaccctgagtgccctctgggagccccaagcctgggggactgaggagtggaccctggccatgtcttggtatcccccaggctgttcatggccagacccacatgaggacaatgaaggccaagccagatgtggaaattgattgagaaagaggacccctggtccaggcccagcccaccctaatcccttaccagccaggagaatcccagcagccagaagccactgcacgcccatgctgaaggctctcaaggcttctaaggcttcagaagcaggtggcaaacacgaagacactctcgaatttcccttcaagaaaggactgatgttgcccagcctttcccacatttccacccctgtggctgggggtgcaagcctggctgccctaactcgccgggtgcccttcagcaaagcccttgacctctggggctgcagagtcttgaatgggggcagcctgtgcctgccccacagcctgggaggttatgggcctgaaaacacattgaggaggagttcagagtcctatccagtcttcaaatggaggtggtgaccatgccggtgatgggggtatgagtgtgggtttgggtgtgatgtggaatgactgtggtgagtgtagttgtgaggacagtggctgcagggatgctggaggtgctgattgtggctgtggtgggagctctatgtccaggtggtatggagctcgctggggaggggttggtccatgtcccatcccctggccagctcctgtcccagtttggtcctgctcctattccatcgggctgcgtgggggtttggagaggggaagatcagaagagaatagtcctcctcctgcagtgcttttcccgtgtggaatcctgatcagagccctggactgggcagggtgagtgtggaggtgggcgcacctggatagaaccatccttctcgggtcccctgcgcattcctctcatgcccctgccccctccccagcctctgacacaggagagggccatggcagccctaagaggcttagagagctgccaaaggacaggcagggtgggaggctggcgcctcgtgggatggctcaggtctcagatctagcctcccaccccacctgctggggtcctggggagtttccaaagcctctcccaccaggctcctggtgtctgtgtgaccctgccatgatttgtcccaggtcaccagagcctcctctggtgggaagataatggctggaaaccttcaataggaaatcagacctggagagggccttggccagactcctgtcctccccacccagctccttctacctggataccccttcccccatctcctgggtcctcatctcctgtcccctccagatcaggctggctggagccaaagctggggggcagggctgtctcccctccccgttggagctattttccaagggttggggaaagcaatcctccacaacccacccctccaccgcaaggcctgtaacccaggctgtacacacctcccaaagcagcccctcttcctcccagttcaccacaactcatctgtttggaaaccttgcatcctccgctgtttcctggctcctctgggagaagctgttaaggggccagcctggccaggtcggggtggggacggatggcttcccaacgacagggagggaggcttgggcctttggcaacttctacctcgagtcctggtttcattggccccattctcccccaagcccttccacaggccacccatctaggggcccgtgaccccatctccaggccagccaacccactctagcacccccattctgcctcccttccctgtgcccccaggatgcccaggtctcacctggtggacctggtgctgctgagaagcctctgtctgtggaggcgctggtgtcccacagaggcagggtgaaagcagcatcagcaccctctgcccaacccctgctgggcctggaagggccacccctttccctggcacactcagggccaggaagatctgctctctgatggctctgcccacaccctaggacactgggtcctcatctcctgtaccctccagatcaggccggctggagccaaagctggggggcagggctctggcattgctgggcctctgccgagagtctgtcagtgctgaggcctgcttggcaacagtggggaaagcagcagctccctgggacatgatgagtgataagggacagaaacacacctgaaggccattccatgccatcgggcagagggctcaggatccaggagtggggaggtgatgcaggaagccaggcacacgctcccttttcccaccaacaccctgtcctgaccaaggacaattttggagaaaactcaaccaagaactggagatccaggctctctgtgggccagggtcagggttcagtctatgtctaagatcagggctcagagaatggccaggatcagggctgagtctgtgacaagtgtcagggctcagtgtggggtcaggggtaggcgagtctggaatttgaatgcttgccaggctagacctaggctctctctcacactgttcttcccctgccctaccctctcatcagagggcatctgaagacctgaaataacccatcctgatacctgaaataaattggatgggaactctggcctcacatcaataaatgtttcaacaataatactttgaaaacagccacagtgtccaggacaggatgggggttgggccccgagggttgggtgatattccttctgtcatgagccagcttcagccccctgggccagggcctccctggccctctagtccacgacagcattccccttctcctctgagctccagagccttgctaggcctgcagtccaggtgcagttacaccctgctgttccatggtagagtcctgcccctctccacacccctccatgcgcctccctgcacagctgagcacagaggggacccttctcccactgaccgttcagggccgtggcttcccagctgctccattccacttggctccctggggcaggaggagggggctgcacgaggctcatcctgtatccctcctccagggccagaggaggggctgtgtggaaccccaaagggtcctggagagtagtggggggcagcgggcaaggtggggccccaaggggaggagcagaacagaagcaggtcactcgggggctgagccaggaagacatttgcctagacaaacgggccatggggccagcagatgatgcactttgcctgtgtaccttccagggcaggcttccctagctgcagggatggggggccaggctggcctgctctttcctgcctcccagcccaagctccggtggaggcggggcggcattccatcttactctcctgtgtggcccttggcaagtgcctgccagatccagaccttaatctcctatctgttaccttactcatcagagagaagtgctctgaaggtctgggggcccaggccccttgatcaggacagaacttggggctcacaggaagaacagggaagaaagggttggggaacctgggaccctgcacatcgtctgcaaattctgaattctccatgtggcattcaaggcctcggtgcttcagctgcagcctgccttgctgacctcagtcctggggctgggtggaccaggaagtgctcacagtcccatctctcccccatccctctggtcacatgccagagccctccagttccctccctaacccagggacccagtcaaggctctctgagggcctgggaagggtcttgggtttacagccctgctcactgcctcatcacccagatatcgagaatggatgtcacacacatcttccaagcaggttgacaggatcggaattggtctgtgagccactgttgggggcagggatgagtggatgtccccgctgaacgaggcagactacctgcctccctgcccagccttagtcccactggctgcctgtcccttctccctgggaataatggtgtcccaggcaggaaactcggccccaaaaccaagactttccctttatctccaaaggcacttcttcctggtcagggccctgacacccaatgtcactcactcctcctgagctctcaggccaggctggtatctgtcctgctagagcctctgcctggatcctctatgcatggtgttgaaagatcatttttttaagaaaggaaaatcttgattctcatatagataaaaattgaacatatgtaaaagattgtatttaactcattattaacgagggaacctggagatgttacaaccagttcaaaggagaagtcaaagaagcatatatttatatggagtcaaggaatgttgaaataaatttacaaacagatatataaagctggcttttttacttgggggagggagtcaatttaacctccactggaccatttacttgcatgattatagagatgaatgattttgcattgcgatctgtcatctgcaaggtacagagttgtaaaacagctagaaggcaatgaagggctagaatcattagtcagaagggtgggctctaattgaaacaatgcagttttccattggagacatccaataatgtttttttcttattccaaattttcttacagtggtctgtctctctgagctgtggggcagaagaagagggacttaggaagtattggagatgtcagggcaggcttcctcgaggaagagaagacaagggaggagaggagagggactagcagagatcactagttgtccccaagtaatcctcttattaaaataattaattgggagcatgactgaggtggctatagtactctgagttcttttttttattattaaaaaaaattgaaacagggtctcgctctgttgcccaggctggtcttgaactcctggcctcaagtgatcctcctgcctcagctttccaaaatgctaggattacaggtatgagccaccatgcctggccataccctaggttcttttgtaagcaaactgaaaccccactcatcatgaacagccatatcctagaaaacaaaattttacaaaatcagaaactgccaactaacctctatctagggacttcaccaatcagaaaccaccaactaacctctaactagggacttcaccaatcagaaactaccaactaacctctcactagggacttcaccaatcagaaaacaccaactgtcctatagggattttaccaatcagaaaccaccaactaacctctaactagggacttcaccaatcagaaatcacccactaatcactaactagggacttcaccaatcagaaaccaccaactgacttctaaggacattaaggccactgctccactttaaccaatcaaatgttttctttgccttgcttttgtgtgcaccttatacaagctttcccctcgagctccaaaccactcgctgtctggcactgcctgattcttgaatcactgtctgctccaactcctaaaattctaagtgcttaggtctctctctctccctctctctctctctctctctctctctctctctctctctccccccctccctccctccctccctccctctctctctccctccctccctccctccccccccctccctctctctctctctctctctctctctctctctctctctctctttctttctttcttttgagacggaatttcgctcttgtcccccaggctggaacgcaatggcacgatcttggctcactgcaacctccacctcccaggttcaagggattctcctgtctcagcctcccaagtagctgagattacatgcatgtcccaccacgcccagctaatttttatattttcagtagaggcggggtttcgccatgttggccaggctggtctcaactcctgacctcaaagcgatctgcctgcctcagcctcccaaagtgctgggattataggcatgagccactgtgcctggccaggtttatcttttaacacatccttaattagtaacagtgttcctgctttttaactgggcacatggtgctccagaataaagactatattccccagcctcccttgtaggtcggtgtgcctgtgtgacgcagttctagccaataggataaagtgtcatgaggctgtaagtgcactagacatccttgttaagtcaccttaccaattgtgaactgccaccttcagacttgtgttggtgtgagagagaaataaacttctctctcatttgagccactattatttggggctttctgttcttccctgtcctcgcctgagttatacatccacgcagggcagaagtcttgcctgacacgcacccctgccccaccttggcagcactcaactcagccaacgtaagtaggactcactcagtggaggcggagggcagtcagtggacaggcattcccttccagtcagcctacccttccaagccttcttggcctttcataattttctttaccgttctgcatgtctggagtgaacacctttcactctagatgagggtacccctcattcttcccaggctcattcctacctccatgcttttgcttctgactcaaggagcaggcagtatgaatagacttaaccaaggaaaaaaatgggaaaagctgtgcaatttttacctttaataaaaactggctacaaaaaaaaccccaaaatctgtttgaaggcatcaaagagttaacacaatagtgaagaatttctagactaagacacaggaagagacagcaatccagagaggtaactcagtactcggagctacttttcacatgcggttgttccccacctctaaaaaggcagctgagaagctgggcagtacatgttgaacagcgtctaggtgcaatggggacaaaagtttgagtccagggactgccaaagcctggggcagggtattgtgtgtagctctcataaacccacagaccataaggtggggacaatgaaaggctgtaccttgagagttagggtattctgaaagtaaactgaacctcgcagagactgcagtccagctttgagtcgcaattcccccagttttttatgtttattttattattattatttttgagacagtctcactctattgcccaggctggagtgtagtgacacaatctcagctcactgcaacctccacctcccaagttcaagtgattctcctgcctcagcctcccaagtagctgggattacagtcacctgccaccatgcccatctaatttttttgtatttttagtagagatggggtttcaccatattggccaggctggtctcgaactcctgacctcaggtgatccacccgccttggcctcccaaagtgctgagattacaggtgtgagccaccgcacccggcctcaatccccaaaattgaatttaaaatttttggattgctagtgtattcaggtatgtggaatgggaaaacagaattgtctctggaggaagacaacattatcgtaagcctcaaagcattacaaactgatttttaaaaaatgtttggcacacaactaaggtagctagactcagtaggacacaacacaacatgaaccaagaactatcagaaagaagcaacgatagaaacatgctcggagattccagatattggaatcagacacaggctacaaaataactatacttaatatgttcaaggaagtaaaatataagatgcaagagtttagaaaactacaaaaaaaatagcaccacaggtatttaaaaagtaaattctaaattgaaaagtacaatagcattaacttggggctcagtggctcatgcctataatcccaatactttgggaggccgaggcagggttactgcttgaggcccaggaatttgagaccagctggtggtctgtgcctataggtctggctactcaggagggtgaggcgggagaatcacctaagcccagaagtttgaggttacattgagctatgatcgcaccactacactccatcctgggtggtagaagaaggctctctcttagaaaaagaaagaaagacaaaatacaataactaaaattaataattccattcatggtttccagagccaattagacacagttgagagagaattaatgaactggaagatattgaaagtaatggctggccaggcgcggtggctcatgcctgtaatcccagcactttgggagacagaggtgggcagatcacctgaggtcaggagttcaagaccagcctggccaacatggtgaaaccccatctctactaaaaatacaaaaattagccaggagtggtggcacaagcctgtaatcacagctactcaggaagctgaggcaggagaattgctcgaacccaggaggtggaggttgcagtgagctgagattgtgccaccgcactccagcctgggcgacagagtgaaactccatctcaaaaaaataaaataaaataaaataaaataaaatggcaaaaactgcaattactttttcaccaacctagtaattcagaagaaaatattcagaatgaaacatgaagggacaaaaaaaataaaacacacagaagagaaagtaagtgatacagaggatacactagggatcctctagagatatattttcataatttaaaaatattttgtcatttaaaaaaaaaaatagtgctaagataacaggcgtgagccatcacacctggcccaaatatctttattttgcctttttatctgacagatattttcgctaagaatggaacttgaggctggcagttattttcttttggtacggtgaaggtgtcattccatggtcttctggttcctgaggtttctgttgagaagttgactgtcagcctaattattgctcctttgaaggcaacctgaattttttctcagatacttctggggttgcggggggacaaaaaagggatcatacactcccagagtgctggattacagggtctcactttgtcacccaggctggagtgtagtggtgcgatctcagctcactgcagcctggatctcctgggctcaagcaatgcttccaccttagcccttcaagtagctgggactacaggtgcacaccaccacatatttgactaggccaaatatacctttaatcagcatcccagaaaaaaaggaaagaggggccaggcgcagtggctcacagaatcccagcactttgggaggccaaagcaggcagatcgcctgagcccaggagttcaatactagcctgggcaacatggtgtaaccccgactctacaaaaaatacgaaaattagccaggtgtggtggtgcacgcccgtggtcccagctactagagaggctgatctgggagcatctcttgggcctgggagctctaggctgcagtgagcacttcagcctgggcaacagagcaagaccctgtctcaaaataaataaataaagggatagaaagagataatgaggcagaagcaatattttaaaaaaataatgacagagaatactttttaaattatgaaaaacaatagttcacagatttaagaagcctcatgaaccccaagcaggacaaataaaaataatagtacacctagacacgttatggtaaaattgcagaaagccaaaggcaaaaactttctttaatcttaaaagtatccgagccagtcatgttggctcatgcctgtaatgccagcactttgagaggctgaggtgggtggtttgcttgagctcaggagttaaaggctggcctaggcaacatggtgaaaccctgtctctacaaaaaatagaaaaaattagtcaagtgtggtggtgtatgcctggagtcccagctacttgaagtgctgaggtcgaaggattgcttgagaccaggaggtctgggctgcagtgagctgagattgcaccactgcacttcagcctgggtgacaaagtgagaccctgtaatccagcactttggtagtgcatgacccctttttttggtcccctaccaaaaaagagtatctgagaaaaaattcagattgccttcaaaggagcaacaattaggctgtcagtcaacagaaacctcaggaaccagaagaccatggaatgacaccttcactgtaccaaaagaaaataactgccagcctcaagttccattcttagtgaaaatatctgtcagataagaagacaaaataaagatatttgggctaggtgtggtggctcatgcctgtaatcccagcactttgggaggctgaggtgggtgaatcacctgatgtcaggagtttgagaccagcctgaccaatatggtgaaaccctatctctactaaaaatacaaaaattagccagccatggtggcatgtggctgtagtcccagctactcgggaggctgaggcaggagaatcacttgaacctgggaggtggaggttgcagtgagctgagatcatgccactgtactccagcctgggtgacagagcgagactccatctcaaaaataataataaaaataaaataaaaattttttaaaaattttaaaaagtagccctagagagtagacttttaggacaggatcctggaactcactaatcaggtggcaacaggatccattgttggtggtaagtggggtagtgatgtgctggtgggctatagcaataccatcactaggaaactcacctactgtggattgggatatggtacaggtggaagggcaggcattgctgatgcagtagcgctagaacaaagttctccaaatctggttcctggatcatcagcagcagcacggctgcatgcttgagacctggcgctggagaccggcctgggcaacataggtagaccctgtccacaaaatatttaaaattagctaggtgtggtggcacatgcctgtggttccagctactcaggaggctgaggtgggaggattgcttgagcccaggaggttgaggctgcagcaagccatgatcacaccactccactccagccggggtaacagagcaagacctcatgtcaaaaaaaaaaaaaacaaacaaacaaaaaaaaaagaagacaaagaaagggctgggcacagtggctcacacttgtaacccaacacttcaggaggccagggtgggtggacctcttgagttcaggagtttgagaccagactgggcaacatggcaaaaccccatctttaccaaaaatacaaaaaattagccaggcatggtgttgcgcacctgtggtcccagctattcaagaggctgaggtgggaaggattgcttgagcctgggaggtggaggttgcagtcagttgagaacatgccactgcactccagcctgggtgacagagtgagatcccatctcaaaataaagaaaagaaaagaaatgaaacaaaacgaaatgaaacaaaatgaaaagaaaagggatcctgatatctgatatggagaaacttaagtggatacatctgagaactttgaacctccagtttccactaaatgctctggtctaaaggaagtagccccctttccttgctaagagaagggcagctgccccttgcctggagactaggcaaagagcctccaacaaggccttacagcaggatgaggtgtgtcgtcattgctgccccacattgacaccaggctatggtcatttctcatcatggcccaaggtcacaggcacaatctgctctgggagaatgatttttttttttttttttttgccaaaaatgcaggagctgccaagtgcctactggcagaatctaggagaggaggtgaagaagtggacataagggtgttggaccagggggagactaaaggctgtatacatgagaatatactaacctgggggcactctcaagatttaatggcttggcaaagacacctggggctccaacacagtgctggagtggctccttgaaatgtggacggaacagttgctgcagtgaattaggaggagattatagaattgcatttgcaaagcgtcaaagaagccagaaagtacagggaggtaggaatgttggaatggttcattatatgccaggagattcggaatccaccacttgactatgtgcccttggagggctcacaggaactcccctctctaggcaagcaaggaaggcactagtgagaagggcacctgaatctttgagggactcagtggcactatccttggtaggccaggatcgacaagaggagatgctgccatgagaccaggcttcgtggtgtcagtgggaacggtggaaggcgagaacagcggatgccaggtggtggcccttcaccatcatccacaaggtggatgtaattaacttaattggtaggaaggctagagtgacagccaggatgccttgacctccagggagctgttgtgttagctacaaactgatggcattcatgcatactgctgcactccagcctgggcaacacagtgagacgctgtctcaaaaacaaaacaaaacaaaaaaagtgttgctataatggcaccaattgtatatgaagttcctgaaattctgacctccactaatattattgtgtgattaaaaaaaattccatacttgaaagcaacacaccaatagaggcaagcaaaccatgttttgcaccaaacaactatcaatggtgatggcacgtggatctccctttcagaaccctgggcttctcagtaccctaaaggctttctgcagacaaggtaactatcagaatcacatggagaagaccagagcctggaaggaaacctgagaattttttatttcaaccttcttcattttacacagagacaaaactgaaattcagaagagttctggtttctcaaggcacaccactagtcaataaacacacagagccagaagctagatctagctcagtgttcttttaaagctttaaaaattgctctctgctagtaaagcttacaacctgacaataacataatatatacacacacaaatacagttatttccaaaatagatttcggggttgggggggcagaccctgcattttcacaaattataatttaagaattgcaaaatctgtctccagtattcgtaacaggatgtcattaaccagtccccatagtgggttggacgtctaggttgtttccaactatttgcttttataattatccattataatggtgaaaaattggaaacaacctaaatgtccaacaatacaggcattaattctctaaaaagtgaatatcaaatagccataaaaaagacattaaagacccagaagtgttgctaattgagcaaaaatacattaaagaccatttcagttcagatgcagtggctcacacctgtaatcccagcactttgggaggctaaggcgggcagatcacttgaggccaggagtttgagaccagcctggccaacatggcgaaaccacactgtaaggtacatggatgtgctttggtcaaggaataggctgaggcggatatccaggcctgcgtgactcaggagtttggcgtgcaaatgcacacctccacttgtcatataacctgtttgtgtaagttcatgcttggctttatgccactattgtatgtaaaaggtataactgacctgttgacgttgtgcataagagacatggctcttgggggcttggctggtctcagctcaacatggcttgacatggcaggcgcactggtgcccagagaaagagagagcacgccaaagctgtccatcttgccgatggatgggagggagccaggatgcagctgggcttgctcatgcccagagagagaaagagttaagctgctgaccctgaaggtaagggagagccggctgcacagctgtgtgtgggggcagctggctcaagccgccaagacagggtgaacggtaagctgctaatcagagggctagtgtaagaaagctgttaatgagagctgctgctgaatgaaactatctttcacctgcctacggccccttgagtgttctttcagctcacccaccccctttcctcagacttcagcatgggctggacctggaccccgggatctgacacacatctctaccaaaaatacaaaaattagctggtgtggtggcacatgcctgtaattccagctactagggtggctgaggcacgatgatcgcttgaacccaggaggcagaggttgcagagtcaagatcgcaccactgcactccagcctgtgcaacaaagcattaccctgtctcaaaaactgaaaaagttaaagactgtttgtacagtataaactctttcaaaatatatactcaagcatagaaaagtctagaaatgtcatcaatggtgatttcaggaaagaattctaaggtgactttttttggttatctgcattttttttcttttatttttttgacgtagggtcacctctgtcacccaggctggagtgcagtgacgtgatcagagctaactgcagtctcgacctcccaggcttaagcgatcctcccacctcagtctcctgagtagctgggactacaggtgcacgctaccatgcagggctaatttctgtattcttgtatttcttgcagagatggggttttgccatgttgcccaagctggtctcacgtgatccacccacctcagcctcccagtgtgctgggattacaagtgtgagccatgtgtgctgggtctgtcttcttttctataatgatcatgaccatggatttcatgtaccaacatttttctaacagtaatatttacaaagcatactatgaaaaatgttcagagaaaaagaatacaaaattgtaaaaatcatatataacgagtttttttttttaaaggcaagaaagaaagtagattgtccaggaagatagttacttccactttgtatttttccggtgaactcattaaaaggtccaggagtagaatcatgggtcaaagtaccccggctttaacttctggttcagagaatcctaacaactgacattgtcaccagcaaggtcttcgactacctgagcaactctcacctcaaagcaattcttatctgacattagctgctcagctttccgctgatacgttgactccaggaggctccttgagttctgtgtgttcagctggcctctggtggccccattattattttctgccaggtaaagatcagtcacctgcacacagatctcatcactcacgatatgctgcagctggaatcaaacaaacgcaagcttttagtgaacacagaaaacatttctccattatacagtcaacgttcctttgactgatccagtcaatcaactcaaaaaaggttttggttttttttggctggcaattttagaaaattaatcacactgtgtcattttcttggagaaaaatcaagccaagattttcaaccatatcagtggtccactgtaaaactttcatacctatttaaaatacaaaccatagagaactcaggttaatgtactgtttatctaaaattctgaggatctttaaataattttccatgggtcatacttctattacattttcaaatcatttagaatttgatttcacacatattctctctcatttgatcctcacaacagccctgggaagcaggttggagacagacttggggccggttaggagacaaatttacacaatgcataagaaagctcactgtgaaccggggtgaggaagggaggcttggagaatcatgaatgcagtatctatgtctatattcccagcccaactacaaagcctgaaattcattaggtatttaagaaatagctgctgaattattgcctcagggtgctcagccgaagaagcaggattgggactaacagtcaagctccctgactcctagccgaatacttttccaaacccaccacctatttttctatatctgataaaatgtatagtgcttaagttgtacataatgttaactcactttcaatacaggccaatcatgattgactatcagtagcttttgtgacaatcttagtaaattagaaagttaaacctttcagagttcccattctcatgtcgtatgctatttctattttgaaataaaaatccttccaattgaaactttatccatcaaaatgacagagaagtgaaaaatagatacaagaataaaacaaaacattaatttcaacatcaatttgtctattttgctttaaaattatcataaccacaaagccttcctatttttaggaagatactttctttttaagtgttaggaaccatgataactatttgttcttaagtcctaaatgaccagtatggatattagtagataactggacacagtgaaaggtcagaacgtgactgagtgtggcagaaagggcagtatctccagcaactgcagatggataaatgacaatgagtccagataatggattatgatacaaccattcaaataatgcttatgagtacttgctaacatgaggacaatcttaagatatagtgtttgagagagaaaaaaggaaaggtggaaaaaaatagatggaaagcatgacttcaatcatgcatagagatgctgccactttatccttttttttttttttttttttttgcgacaatgtcccactctgttgcccaggctggggtgcagtgacatcatgatctcggctcactgcagcctctacttcctgggctcaagcaatatgcccacttcagcctcctaagtacctgggactacaggcatgtgccaccatgcccagctaattttttgtattattagtagagatggggttttaccatgttgcccagtctcaaactcctgagctcaagtgatctgcctgcctcagcctcctaaagtgctgggattgcaggtatgagccgccgcctctactttatactttcttgttgaagtggactgtattgctgattcccacccacactctctttttggatatccggcccctcctcgagtctctggaaagggcagcactacaaatccagggacaactagggaactcccagccccactgccaggcagatcagattctctatcctgctcagtggaaatgacacatagagtgttcgatagattttttgcagagacgcatctgtatggaaaggtccagtaacactgggaccagggatactgccagggcaagccaaagcctcagaggctggaggagcctggagcacatgccatatgttcatctgcagagcaaagcacaagcatggagcagaagtccagagtgaaggcatgcaggagagaaaaatcacctcccagcccagtccttccatggtgtggtcgtattttgagttctgtacttggatgtctgtgaggttgcctattgtattcttaatacaaatcccacttaagccagcctacaataggtaagataaatgtaatgacttgacttggctggagtgcagtggcgtgatcacggctcactgtagcctcaacttcctgggctcaggtgatccacttcagcctcccgagtagatgggactacaggcatgaacaaccatgcccagctaattttttgtatttttctcataaaaatattgttcagaagaaatcttacatataatacattgaaaatcactgattgctttttcttcgtcttcttttctgtgaatatgtaggtgtttgagtctcttgtatttcttcttttacacaggatacgggctgtttgaaaactatttcattatcttcatcatcatcattcatttcagccacttcagattttcatctctttaaaaatgttgatgtacaaaccggtgtggggccctaggtatccacagtcttctcaggagtgtcaggagtacctaaaacctttttcttcttcttacataaaacctggccttttgtagacatctgacgatttgtttttgaaatactttccattttctgtaaaatcaaagaaggaaaatcataatcaattcctttttaagctaatttcttctcgagtaatccttctttctttttaaatcactcctccatccgtagctcttgtgtaagtgcaggttctgattatacatttcactgatggatatgattgctgcttaaatggaatattccagtcttgaaagagttctttctgtactttttcaggtggcataaaatgactctccaagagtctttcaccaaacatgtagttgttcattgtttcagcaactatcttagcaacatcctcagactcaaactccacaaatgcatagcctttgctatttccagtccttttctttctggatagtctgaaccttgtaacagtgccacactgggagaaataggaaaggatctgggtttcattcagtaggttaggtaggtggcgcacataggctactccaggagaaagttgttctttttttttcttttttttttttttttttgagacagagtttcactcttgttgcccaggctggagtgcaatggcaagatctcaactcacctcaacgtctgcctcctgggttcaagcgattctcctgcctcagcctcctgagtagctgagattacaggcatgtgccaccacacccggctaatttttgtatttttaggagagacggggtttctccatgttggtcaggctggtctcgaactctcaacctcaggtgatctgcttgcctcagcctcccaaagtgttgggattacaggcatgagccaccgtgaccggccagttgttattgtttttttcgttgggttatgcgcttgcaaacctgtgccacctcctgaaactcagcatctacctgtgggttcagtgacaggataggcccagccaggctggaaaaggccgccatgccaaaagcggctgacaccaactccatgcagcactcccggaaatgcccaattttttgtatttttaatataagcagggtttcgccgtgttgcccacactggtctagaactcctggactcaagtgatctgccagccctggtctcccaaagtgctaggattataggcatgagccaccacacccaggcttgactttgaaacgtatgttgtacatccagacagcagtgaactcagggggaacaccaaagatgaggagaatgagagaagggatacctccaattaaaggagttaagaagagatgcttgaacttacatttcaaaaaatcactgcaggttgggcacagtggctcacacctgtagacacagcactttgggaggctgaagtgggtgaacggcttgagcctagaagtttgagaccaccctgggcaacatggcaaaaccccatctgtacaaaaaatacagtaattagccaggcacggtggtgcctgtggtcccagctactcgggaggctgaggtgggaggtcaaggctgcatgagctgagatccaccactccactgcagcctgggcgacagaatgacaccctgtctttaaaaaaaaaaaaaagtcactgttttggggttttctgggtgaaacctctgtttccatttaaaaaaaaagggtcaagacagtatgtattactgattcaaaatcataacctgatgcttagagtaaatcattgtatctattatttcaaaaaccaacctcaggattattaaaagttaattttattgggtttttctttaagcttggctgattcactcaggtctgtcacatccaagcccatgttttactactttgtaaccctatttggaaggaaaacttcagctcacattatgatccatcctgagatgaagagtttcacacatatacaccacatataccccccaccacagtatgatgacacagcaacccaaccttgggcaaatggtaccactgccagcaaatgcatttttttctttatttaaaattttttttctgtatttcttctaacagcagcaaatgcatttaacattttattgagattctcaacagctgccatttggtttgtttagcaaattgtttacaaagtaacttttttccattgttgatatttgaatgaaaattatgttcttcagttttaaagccccatccctctcccaaagaaaggttaataactaactaccaagtaatgattatttaggaaaagaagaaaagcaaaaccagcttgtaaacacttctggaacgtgggtaaggggccaaagtcaagaccttctgggcccagtgcaggtgctaggcttgcctcgggacaccatcagcacttccccatccacaacatcctcaacagctgggagccatgcgcagaccccagggggcttcctgttccacaagctcccctctctttttcctctccacccttgctgttgggccttccttccaaatctgcctaacaaaggcagcaggatctttaatactgttcagctttgtcaatggagacaggatactctagaaagttgagagattccctggtccagtctgggggaggaaaaaatatgcagtgtagcatagatggttgtacttgtccactcagacacatgctcatacttattagatggatgtatcagatgcttcaaaagtcctgatgtgtaatagcacaaaagctgcttgtaaaaaggaagttgcaaaatgataaaaatttctgcagcagttcaggctcctgatgacaaagctggttctgataagtagttcttttgacatgcacagcagctttcactgtaagtcctgtgttccagcggtttcatttagaccataggaagttgaaagcaaagtttaaatgttctctgctgacaaaatgtggtatatatccatcaatggacttctactcagtaatgaaaggaacaaactaccaaaacctgttatatgtcatggaccaacctcaaaaaccttagctaagtaaaaagccagacatgtgaccacatattgtataattctattgatttgaaatgtccaaaaaaggcaagttgatagagacagaaatggtctgatttacctcaagaagtagggattcaagctcttagggtacatgtgatacatacattagaagaaataaggaaaagaaaagaaatttatatgtaaataaatgaaaataatacttctccctgattataaagaaaattgcattctttttgtaataatttggaagacaaaatatgaagaaaagtctttaattttgccactgaaagcattctggtttgttgctttttatatttttttatgcatatgaacattttaaaaagtagaatcgtaatatatagtcttttgtcactatgttttgggcatatttatatggcagtaaatatatccttggcatcatctttttaaaagctcgatgtatattaagttaatcattgccaccccagaagtaaattttcttatatatatattttaatggacgcaagcaagcattttggggctgaagtcatagaagtagaatttctggagaaaaataacataaaatagttttaagatttttaatagaaattttcaaattatcctgcagaaaaattggttcagtttatactcccaacaggggcagagctccagtatcccgtttccatttgtcctctttgctgatatttaaggagaaaatctcattgttttcattgtatttctttggtttctagtgcttttgaaactttttttttttttttgagatggagtcttgctctatggcccaggctggtgtgcaacagtgcaatctcggataactgcaacctctgcctcctgggttcaagcgattctcctgcctcagcttcccgagtagctgggattacaggtgcccaccgccatgcctggctaatttttgtattttttagtagagatgggatttcaccatgttggtcaggcccgtctcaaactcttgacctcaggtgatccacccacctcggcctcctaaagtgctgggattacaggcgtgagccacggccctggccttgaatcatttttatgtgcttattggccatttttattcttgtgggaagtgcctgtttctccattgcctattttctggccaagctcccaagtcacatttcacttaatttttatcctgctgattgaaagcattttaacataaacaggagcaggacagactgtaattatctagatcttgctctgtcacccaggctggagtgcagtggcatgatcatagctaccacagcgtcgtactcctgagctgaagcagttttcatacatcagccttccaagtagctaggactacaggtgtgtgccaccacccccagctaatttttaagattttttgtagagatgcgaattcactatgctgcccaggctggtcttgaactcctgacttaaagtgatcctcccaccttggcttgccaaagtgttgggattacaggtgtgaactactgctcctggccgagggctcattttgtttgctagtggtgatattggtatctgtttatatttgaggctttggtgctagtgctgaagtattacactcaccatccgaggtttgcaggacttttgttttaatattgaatagatggaactgtttacttctgcatctttgcaggcatacaaaatgtgcctaccaggactctgctttatatctattgaaagcaagaagtaatacagtaaaactttgcctggctagaggctttggaagaatggagtattctgatttaatgctattgaagtgtgaaggtgaaaagaatgaaaaacttacatttcctgttgaatgcaacttgaaaatacagccagtgattccacttttcttctctagtaagtttggacattctgatctacttggtgttttattatagaactgctagtgtgcccgagacttacattgtgaagacactttttaaaaaacttgagaggtaagagggtgtaaatggtattgtgtgagatcaggctggatgagaactgacacttgtaaacatactttttaggctgaatctctgattgccgtttgttttcttatttaactcataaaaataaaacacattggatggagggtgggagcaggaaggagatttatgtcttttaattgcatgccattgtttcatatcaagacagaacatatggtatccctggctttggacctacagaaggaaacacatttttctgcctgctgtatgccagaggttcttgaacacctggagggatgactgcagcacagattgctgagccctactccagagtttctgattcaccatgtccagggtggggcctgagaatttgcacttataaaaggttctcaggttctgctgctgctgctagtccagagactacatttttgagaaccactcttgtctactaactgtaaattgtagaactctagaacaaagcttagtttggtgtaggaaaagaagctcacaggttatggagcaaatcatgaaagattcaacccttgatcccagcctagtgtggaattcaggtaacaatcaatacacagtgacataacacaattcttggttttcatgattgcaagtcatagccaagtatcaagtgagaaattcagtttcatttgcaaggcttagagaggccaggtgattctagaaaaataggccttgtatttgctttaaaccagtaaagagctttgagtgcttattaaatggaaagctttgtgtttttatttatttttgactattttattttatttttttgagatggagtctcagtctgtcacccaggctggagtgcagtggcgtgaccttggctcactgcaacttccgcctcccgggttcaagtgattctcctgcctcagcctccccagtagctgggattacgggtacccaccaccacacctggctagtttttgtatttcgagtagagacagggtttcaccatgttggccaggctggtcttgaactcctgacctaaggtgatccacccacctaggcctcccaaagtgctgggattacaggtgtgagccaccacacccggcccaaaagctttgtgtttttaaagatattagacatgtttcttgttttttaaaaaatcttaataatgtaggagaataagagaaatgttttttccaaagccgagaaatcattgtgattattttaccttattgggatgttggataatatagtccacttcattcattaatcatcaaacatgctatggattttccatttttataggatttgtatcttcactggggtaatactggtaattcttatactccctctgaagatgaaaaatgtaggccaaaatcatagaccatgcatagaagctggataatgaagacagctctggaggaacatgtagacacacacacactgacacacatatatataaagtataaatacatatttttttaaagtttatttttaacattttaaagcaaaaaccagccctcccctctcccagagtaggcaggccccgcccctctccccaagtgggcagggacagcagtcgcatgggcagctttccttgtgatgtcacaggttcctctgggcacactgctgcctggccacgcctcctttccctttcatctttctcattgaccaatgggattggagcattaaggccacacccctattctgcattctagtgtggccctggttacgcctcctctggctcagtcacacagcagccttgtaggtgactggaggtgttcgctgatgtggccccaaccctacctccctccccaccccatgatgttagaagaatctcgacagaataaattggcagcagccaagaaaaaggtaaaaagccaagaaaaaggtcatggccccccaacctagccagagatcccctctgatgacaagaccactcccagagtccataccactcctgaggcacaccgggctgggcccccctaccccggcgcctctgggctccccccaccaaagtcttgtcagtcagccccgccccttcagcaagcagcccagcctctgccctcgccaatcaccctgcggtgactttgggcggatgactactggggatacctgctccatattcagccctcacgtcctgccaccccaagcccaacctccctgggttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctgggctggcacctccaaggacctgggtcccagccccacgtcccccctcccccatcgtggatcggcaactcagccattgcactgatgaggtttcccccacccccaggaggagtggaatgtagtgatgtcacagtcctcctaggaactgtcattactgctgcaagaccggcctttgatcttataacccagtcccctaagcattctcaccccatttctggttcctctggtcacagcacaaatttccagctagaagggaaatggggaccatgggacctaggagcaagaggtttcaggctgccttactcccttcacatagacatcgacagtgtgaaaagcctacacttcccctgtgagctcaaaacgttgacagtatctctgggtggtaatgggagaatgggtttggtttggttttctcccaggcttctactctccagagagactttaacatttttttccgagttctccacctcatattctaattctccacggttctgggaccagactgcccttcagtcagtggtctctgaagtgagatttgctcatcttctgtggaataggtcttgggaaactgaacttgacagcttgaatcttcctcatatcatctcaacttagggtacattgagtgccacaggataaatgtgggagatctttctgaagcatcagtttcccttgattctcttgagagagaaaaaacattaatgtacttaggggtgaccctcacataggtttctaagagtataccagacttctctctgaaatgagacttgggttgtcctctttctgataaattcccagatttaacaaaaaagctgccttctgccatgaggacacattgatataaaagtttgagagatactggtgcacttcttcacactaacagacatttgaggatgtatgactctaaaccacacagcgtgtagttcatgcctatgtaatgtttacttttctacctctgcgtctggttttggtccccggcagctgctgattcatggcaaaaccccagagcttggagtcagaagactgagtttaagttccattattgcccccccacacttttttttttagccataatatccatccctctcagtcacttaagtgattgtgacaacaccttgtacagttgttggtggcattaaatcagatggtgtataagagtattttgcaaaaactgtaaggagggtgtggctgtaagggctggtagttctcatgtgtattactgctcttctttcccacagctaaaagaatatcagcaaaggaagagccctggtattccagcaggagcaaagacaaaaaagaaaaaaactgacagtagccctgagacaaccacttccggtggtggccactcacctggggatgtgagtcttggctggccaggctcctggggacagggggcccaaggggcagtagagggtaattgttgagattgctgggtactggttaagaattctgggtttgaatcctgcttcttcatctgctagcgatctgatttatggcaagttgcttgagctctttgagcctctcttttcacatctgtgaaataggggtagtattgtttgacttccatttgtgaagtttaaatgagattccttattgttgttgttttcatgttaacccctagtacgtggcctgctgtaaacacccaggatacccaggaaatggtcattgctgtttgattttcctgatccccactcgcaaggggaagctgggctaatgagtacagccacttgccatcaggctgtccctctaggagtcactgaagggggcccagggtgtggtgaggagagcccaaggcactaggagcaagagaaggtctaacttgccaccagcttgctgggtgaccacagaaaaatcacttcttctgctgggcctcagtttcctcctctgtaagatgatactggataagatcagtgtctttcaaacttgttttttagctgaagtccccttagttcaagtgaactcttactcaggagtctgtttttttttaatggaggtggaggtctggagctctaccagattcatcgcccatgtcctgggcctgaggagaggggtccagtgagcgtattaagatctgcattggtcagctgactccactctgtgactgcgtcactcgggggacttttccatctattttttcctgcccctggcaaggcagcaggtggccatttggaagaatggcacaggccatggttttaatctcctctgctcttcttcagcgtttccttttcctgaacccacatcttcctcctaccctgactttcttgcttctctctaagccacttctgtctttcaccccctgcccttgtttttcccttgtcacctcctgtagattcaggacattctgaaggtgcgggtgtccaaccttaaccactccaatggggtagtgctcccccattggacaagtggaaggtgaggcagtgccaagacccctctctggcttgctgtctacagctgtgcatggccctgaggcttctctggcttgggggatgcttggcctctgccttgttttatgttgctgccattaaccttcagcctgtttctgtctgcttcttcacctgcttgattgattgggttttttccttccccgcgtcttttattatcttggaaatggtgatgcctaaaagtttaaaagtaatctgggaataacgtacagagcaggcatgtgggatttgggctctttttttttttttttttttttttgagacagagtctcactctgtcactcagactggagtggagtggtgcgatctcggctcactacaacctctgcctcccgggttcaagtgattctcttgccttagcctcctgagtagctgggattacaggcacctgccactacgcctggctaatctttgtatttttagtagagatgcagtttcaccatgtcggccaggctgatcttgatctcctgacctcaagtgatccacttgtctcagcctcctgaactgctgggattacatgtgtgagccactgtgcccggctccttgctgtttttatactttctccatatacataactatttcccatgtaagtttttttttaatttctcatttttattactcctgcatcatctgttaccctgaaggatctggaagtaagaggccctgggctgaggtgcagtgactttgcaggccagccctccaacctcctctcacagtgggggctgggtgaccctctgccagctgagacagcccacacacaccccagccctaatgattgttctctctacctctccccacaatcctcttccaactcctcctctctgcatgtgcctcagagccagtaccaagaactagcagtagccctggagtcaagctcagtgacaatcaatcagctcaatgaaaacatagaatcattggtaagtccagtggggtcccctgattccatgctgccaatcctgggctttagtttccccttggggccctgaagaaaggggctgggggcccctggtgccaagggcaaatggggagctggagcacccaggcctcacctggagggaccccagagcaaggagcacgcagcatggctcttctgtcactgccctctttgccgactctctcttctccagacacccctgctccagtccttgccacacacgccctgaggttgtcacctctcagggaagcgctagcctgactggttgtcaggggccctgtatttctgccctgactcagtccctaatttgctttgagtctggacaagccacctgtcctccttgggcttgtgtttctggaggaggtagagcatcaaagttctctgttagctctgagagtctgagatttaaaggcccctagaatggaaacctgagggccaagggctcctgtctgtccttttccatcctatatctgctgtgaagaaccgtagctggcccgtatgtgttcagtaaatgtttgttgaatgaaggcacctttctaaatcacaagctggcagaagggtgggccttcctgagactccctctctagaggtttatgttactgtcctttcaagagaatccagattcaggctttgagttctgtggctgtgggcaaaaaccaacaaagacccaagtcctctgtccttgggagcttgaggagggttgaccagtttgtgttgccattggttctgagaatgttgcctttaaaatccattcctggaccctgcctaccgcttccaggtctggggaatagagttgagggggccactctcagtcacctgaatttgactctccccacagaaacagcagaagaaacaagtggaacatcagctggaagaagtaacgtgatttctttgctcacaacatgactgctgggtttgggggacactcagatgcagaggcgccagtctcatcttgcccactcccagcctggggaagaaggctcacccatcagattccaccccatccccatagggtccctgataacctggtcccatgggtgggcctgtcctggggcattggtggcattctgggggcatgtctcttgctgtgccatctctgcctccctgtgataagagctctgtcttcctcttcctacaggcaaagaaaacaaacaatgaaatacacaaagcacaaatggagcagttagaggtgagtggagggtggggagctttctcctgtcctctggagaatgtttctttccttctctttcagcatttccttggcttttctcccaaacgttcaattccagacaatcaacatcctcacattggaaaaggcagacttgaagaccaccctttaccatactaaacgtgctgcccgacacttcgaaggtgggaatctgggcatcccgtcatccttcaacctggcactttgacaggtctttagggggagtcttttgggccccatctcaacctctctcattacagaagagtccaaggatctggctggccgcctgcaatactccttacagcgtattcaagaattggagcgggctctctctgctgtgtctacacagcagcaggaagaggacagggtgagtccaaccagctgccccatcccctggcagcctggcttcccagatagaggagtgagcctaaaggtcccttctgcaggatggagtgtcctgcccagaaggcagcatggtcatttctcactacttttgtgtatggttgttagaggcagcctggggctgagtcagctgctgtgggtgagttggggggcactgtggggagtgagcactggatgcagagctcagaggccaagtgcctgccctgccctttcctggctgtggccttggccaagtcctaggtggggtattgggtagttgttctgtgaaggtacagaagagcacatttagtatgttaccatttctgtagagagaggaaaggggtgtgtgtgtgtgtgtgtgtgtgtgtgtgtgtgtgtgtactatgataatatacaaaaacatgtctgcaagcattcataaaaaactcaggagagagtaacagggtgcctggagacacctcccttctgtaccttctgagttttggactatatgaatgtatcatcctttcaaaaagtgaacaaaagattaatttcccccttcctatctgtgtccccacccccagcaagaaaaatgggcttagagaataggatagacctgggtgttcaaatcccagctctgtctaagtgatcttaggcaagcacttaaccttgaacactcgatgtttttcatctacacaatagaggtaatcctagtaaccgtctcatatggtggttgtgaggattaaatgggattgctagcatggaacctggtgaagcactccataacggttcaaacagtggtagtaataacagtaataacaatagcaatattatctgatctctctgggcctctgttagccagctgtaaattcgatctctttccctctcccttccaactttactgagttcttttaataaccaggccacgggcttggaaatgccttgacctttactaaccgagttgtatattgagcctagccctagcccttttaaggggcactgcccgggctccccagatcaaaacttctcactcttcaccatccagtcctcgagctgcagagaagcggtcctccagcggcggttacagcagaccataaaggagcgggcgctgctgaacgcacacgtgacacaggtgaggctttgcagagggagggatgtggaaggaagatgaccccaggtggccaggagcaggtgaggaccagtgacagcccttcctaacttctgtgcccatttcttgcaggtgacagagtcactaaaacaagtccagctagagcgggacgaatatgctaaacacataaaaggagagagggcccggtggcaggagaggatgtggaaaatgtcggtggaggtgaggtctgacccttcagcccccactttagataggtcactggatctttctgggcatctgtaaaatgggaatagtacagccagaggtggtcatgggtctgggctttgtggagatggggacagagaatgagatggtagcctgtccagccaccagcccctctctccagggccctttcccctgtgctttgggcaggctcgaacattgaaggaagagaagaagcgtgacatacatcggatacaggagctggagaggagcttgtccgaactcaaaaaccagatgggtaagatggggctggtgtgacctcggagcaggactggcatcagaggtctgtgggggtggcttagaatgccccagggaggtgggtgggtggaagggctttgaggcagagggaaagaggtctgtgccaggagacggcaagttttgtcatctccatgagcctcagggtccccatcagcaaagagggaggagtgcccgttgtcagccacccacagtgctctctatgtgaaagtggcttggaaattggctaccattgggtgcgaggaatgattagcagtgaggccaagtttgggaagcctgagaggagctgtgcatcaagaggaggtttttttttttttttgagggggatgtgggtagaggggttggggaatccagaggcccttattgtctgcttcatttctcagctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctggtgggttgccccacctggggagcctgccctcatccctatccctccaggcctttgtttccccacctgtaaaatgggccagtgtagccctcacatgaaatgctacttctaaaggcacctgtgagctacagctcatcgggctctgctctgatggctgtgggggagaagggatgatttttctaacctgcctccacccttcctggtgatatgggaggcagacaccaaggtctggtgtctccagctgcagtggatggccactgattgcttctctctgtccagaacaacgagaaaaagagcgcactgcagttggagcagcaagtaaaggagctgcaggagaagctagacgaggtgaaggagatggtaacctccaccccatccaagaagggctgggaggcgggcaccagcctctggggaggggaggtgccaggccaaaggcagctccagctgggaggcaggtgaccccagcaccctccagtgcagctctatgactgtttcttgcttcctgccctctgacttttagaggtgggtagccctgggctcctcccaggtctggacatcatcatcccagctagagacatggagcccccaatcacaggggaagagacagtggtacaagaggctccttatccaggcacggtggctcgcacctgtaatcccagcactttgggaggctgaggcaggagaatcacttgaggtcaggagtttgagaccagcctggccaacgtggcgaaacctcacccctactaaaattacaacaacaacaacaaaaaattagccaggcatggtggcgcatgcctgtaatcccagctactcaggaggctgaggcacgagaatcgcttgagcccacgtggtggaggctgcagtgagctgagattgcaccactgcactccagcctgggccacagagtgacactgtctcaaaacaaaacaaaaaaggctccttagattcaaactggattctggcctgggttccactggtcaccattcaactactgttcatctctaagtctctgtttctgtgacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatttgaggctggggaaggaggtatggggttctaggcaagggaggaagcctcttaggcctggagcaagggaccagggtcctgggcaggtgacagagccccacggtgccctcgctaccctattaatgggcccagaatctggaagccagccaccatgtgccctcatgcccagggtcttcctgcaggtggagctgaagagccaagagtctcagagtctgcagcagcagcgagactagtacctgggtcacctgcagcagtacatggccacctatcagcagctgacctctgagaaggaggcgctgcacaggcagttactgctgcagacccagttcgtggaccagctgcagcagcaggaagcttggggcaaagcggtggctgagatggccggccaaaagttgcaggagacccaggggagggagttgctgaggacggggccccgagggggatgacctggcaacctccgtgccttctcactctgtttcccgtccccttaggagcacctagaagctgccagccagcggaaccaacagctagagacccagctaagcctcgtggctctccctggagaaggtacaggagaccactcagaggaagaggagagagccccaggaggaaggggggactgttagcagcataggattgaggggttggaagagacctttagaacagctggtcgttatgccaaccgggtgtccgcactaagttcagcatcaatatggtgacctcctgggagcagggggccaccaggttgcctaaggatgaatgaactggaccagatcagaaagggagcaggtcaggactcccgcaccgaccggtagtgggactgtgcctgggcaatatagcaagatcttggttcttaaaaggaaaaataaagaacagcagctcactcccctctggggagaggctggctcagggttacacagtcagggtggggacagaggtaggcccacagtaccttccttgttgggttgtctgaggacccctctggccacctccccacaggagatggaggacaacatctggacagtgaggaggaggaggcgcctcggcccacgccaaacatcccagaggacctggagagccgggaggccacggtgagcctgactttccctgccccgctttgccaccttcctctgtggtccctcccagagcccgttatgctcttggttttcccaccttctgatttctctggcccctcaccccttccgggagccagtggtcagacactttgtcacctgtgaccaacaggtgcactctctgaggccccaagggaaggggttgttctccacctccctgcctcatttgttctgtctatgcccctacaagaatactcacctcttgccttcaagtggcatttttcaactccgctggagccagttcccaggaggagcaggcacggctatgtgggcagcggaaggtgcgaaggctgtgccgcctgcacctggctcatctggtggccttggcctggaaggagccagaggcagaggccccagccccagggaggactggagatgagtttgtgtgtggggagagctaccgggccctgaaggaggccatggtgaagctgaaagggagtgagtcctggcatgggccaagaaaagtgggggcggggcagaacaggtcactcccgaggtgtgaccccattattttggctccagagcagctttatggacctcccgaaggagaaggcggacgggacggagcaggtggagagacgagagcttggattcgtccagccttctggagtgacagacggcatgagtgagcgggaggccagggcacgggcacggggagctgcagggccgtcggagggaccctagtgtctgagctgtgtcctctcacaggagagtccttcaccgtatatgaaagccagggggcagtgccaaacacgcggcaccaggagatggaggatgtcatcaggctggcccagaaggaggaggagatgaaggtagggcgtgcaacatctctgcggggttgggggtgggcatgggcactggtgcaggctccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggtgagtagagctctcaggcggggtgggcaggcaggggcaggggaggctcgcactgtgctcagacccccgcctccctctctccgaagatttttatgaagtgagcctggacaacaacgtggagcctgcaccaggagcggccagggagggttctccccatgacaaccccccggtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacgagtatatgtcccagtacacaaaagggcactggttggcattcttcttaaggtatttagtgaagatcataagaaatcctttaagagtttaaatgtccctggaagaggcatacaggctctagtcaagaatgaatttgagtgaaggaaagctgtgtgacacctggccttcctctatgttcatggagcttctttgaggctagaagattgattttatcatctagacctctctggctaatacctattcttcagccacattagttactctgacataggaatttacttcttttctttgaatggaaaacactttaaaaataataacaaccattattataaaccaatatatgtgagagtacttagttgaaacaaaaaggagttttagtagacagtattatactacacatgaaaatcaaggcgaagtttatgcaacttaaaatgtttacaagctgcagtgcaatctaatgtttgtgaatgtccaagtattatgagaaaaagtgtctatacaatgacagacttatgtttcctcacaaagttcttcacaaagagtgaaatatgtttttatacctctcagtttcagttagaggcatattttgtgccatatttatgttaatgtgcctatacgtgatgagtgaattatttcagtcatacattgcctaaatcataactttaagatgcttgggaaagaatcaacagctaaaagttcatgaagttctaatgtctgtgttccaaaatacgtcacagtattaggatgcagggagagatgtgtgtgcgctccctggggtgggcatttctagttactagaccatctccatttttagcatttggcatcctcatgatacttttatacatatgacattaataggagagcaataatacgattttacagatggaataacagatgtgcctgcattcagtgaaagagtgcaaatattaagtccttgtgacttcaactgactcttccaaattgtatgaatttatcaatgtattagataaactcagttccagaattataaagaaaaactgttagaccaacgaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcataccactgttaattagccaccttatttggtctaacagtttttctttataattctgaaactgggtttacctaatacattgataaattatttcaaaggtatttttatagttcaaatcacttcacttttaccctgataaatataaatgactaggaatgatcttcagctagcctttagcacctgcaaccaatctgacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcatataacaataacttaagtctttcttcaaagtgcatgtggtcctttgcaatacctcattcagccaagtatttgttctcttcctcattcagtttaaggcagctttcaatttgcttagaaggcaacattagaagggtagagtttaatcagaaacatagaattttaaagtgtgggttcaactgaataaatttgaatttctgtaggaagtaaagaattaaaaatctatttaaagattgcaatatataatcatttttaaagtatttgtttaacctgatgggttttccagaaatgaaaacaagtcagttctaaaaccaaagctgatatttagaaaatgtgaaaatataaatcagccctatgcataatatagtttctctaaaactttatcttaaagagtcattttaaaagaatataactattcaaaaatgtaactgctatcttaatgttttgaaataagttaaaacactttaaaatatgaatactgtagtttgaaagaaagaaactgggggaaggaaaagtagagaaagaaatgccaattccaatgcaaggctttatttgccaagttttcttagaatgacttttaccagtttatgaattcttgtaaacagaatgtataatagaaatactgaaacactgttgcctaaagtggcattgttgactgctactgtgatgctactgtaatgtaataaattattaaattgttgcaaagtgctgtttttgccttaaaattttgtgtgtcttgaaaactatagtattacaggtattgagactgtgcaaatgctgggcacgcttggcatgagataatcagtttttatttttacaaaattgtaattaactatgcaagtgtgtttattaaaagaatacaaactaaaaagaagttatgggatttagaaaatgttgtaggatgaaaaagttatgggataaaaaatgtggaaaagtcgtggcaaaaaaagttgtgaaaaaagtatttaaagttttatgaaaagtttaaaaaaagtattatgaaaaagaagttacgggattaaaaaataagtcatgggatataaataaaaataaataaaagcaggcctctgtcagcataagcctggagaagtggggctggagtctgccgccatcgtgtccctaccatcccttcctacccctttatcattagggtagcaagacaagacccctgtctaatggggagagacaaacagaccctttgccaccttgaccagggctgagtccttagatttctggatgatgatgattgttatttaagagccagaggctggtggagtcggtttgtttggaggcggcctgatggcctccctaccctcaccaaagcaacttttccctcagggggctcccatcttcttattcagagaggcagctgaggcagggacaatggggctaactgtagagcaggtgagggcacgggctgctgggaaggccccagtgtacatatagtatctgtgtaacattttgtatattccagggggtagggccaccccctgtatcgtacctagcagaggttggagctggcatatgaggaggaggttctaatcattatttgtggctgggaaacttatttattgatagcatggggcagaggaaggaggcggggatggggttgtggctccctggtgatgcgactcccgtttattttgcttttcattttggaataaatggatttagccatactgctcagcctggtgtgttcctttttccctcactgggtcctggagtttgtgccactgaatgaggagccccagagttgtctgagcatgtccagctgggctgttggtgaccttccaggcctgttacctttatgctgcctagtgacacctggtggatttcattgggactgccatggtgcctatggggcacagtccagccctgacagccaacaggctcagaagcctgatctagcggtggccgggaagacagatactagcacccaagggcactgacttccattcaccccaggagtcttccaggccccctgcccagcactaacatctctttgtgagtctcaaccagactgagctgcagcttcagggtcagggtaggctctgacttaactgatgtgacccaggacaaggggatttattgatggtgtcacatatgcttaagctcttggcctctgtgatttctttggggcatgatacccctctgtcccatgcttaggtgcccacatgtggccacaagtgcctttcctaccaccatccctacttgaggctggtgtccaggcacctgtggctccaggcagaaggctgagcgcagagccaggcctgggcagatgttctgcaggggctgcaggagctgacagtcctgaccacccagcccgtggccatccattccctttcaccgtggctggctcttcatccaccatccttccaggggccaggcctgaacccaaactgacttttacctgccctggtcccccttgtgcctatcaggttcttggctgagcatgatgtttttgcccatttccttgattatcctcaagaggtttatagagccacttggggacatcacatctgtctaccaggtcctcaccagagacatgactgccttgggccgggcctgggatagtcaggggtcacactcacctgttgggacctagcttcagtggcttcaatctgggcaatggcctgatgggcggctgccccttctcctctgcttgggggaggcaggagaggaaggtcagggaggagatctgcttcctgcccacctgacactggttggaagcagggcgcccacctgtgcctgtctcaccttgctgcaggtgcatcggaggccgaacccctctcccgatctcctgcaggtgcagattccaggtttccagtgggtgtcagtgtgggctccagagctctcctggtcctagggaaccctgggctccatgaggccttggcctaaccagattgtttcccacactgtcacctccccaccctgtcacctccccaaacatggggctgcatgctctgtgccctgggtgggacattggaaggagtgccaccttccaggtttggatcacagtaaagcctctgccttggggatgtgctggccgagacagatggggttgaaccagccatgatacgttggccttgggcaagtcatctgtgccttgcttccccagcagccagaagggataatagcacctatttcacccatactcaagtgttcacttgttagcaggaactgagtcccggaggaggtgcaggtggagccattgaggcagcactgcagctggacctgggtctgagtcccagctcctggctgtgatatgcatcactctctccatttatttatctgaaggacagggctgtgctgttctggggtcactgtgacaatgcagctggcctgtgtgagttggtggtggcctcctgagatggtttgaggtgggctggaggtgtgtcttgaatgccccctcacccccatggggaagacccacttagggaagactcaagtgtctgtatggaggaacccacattccctgcccctcagctgtcctctgtcccttcctagccccctctgctgtcctgcaggctctggcggtggccatccagcttggtggccatctggctgatccactcctccaggtggaccctctgtcctcatgtggtgcaggtcccattgtgccacctccagacaggccatgctagccccagggcctccgttccctgttacccagcccccacccccaggtacgtgccccctccctaaagcccactgtgtccaccagctgtgtttcaactctgtctctgagcaaggcctaacgcaaagcctgaaacagcctggcttgtagagggccaggagaccaaagcttgaagagagagtgacggtctcccagagcccacttagcctcagccccagggctgtgtccatgctgttcctggctccagtgagccaattctctcccatgacgcctgtaagggctccagtggtgatggaggtagctggagagaacaaggctgtcttaaccctccctccctgagaaggcccaacggggaacgttttaggcatcagggcattctggggggcatcttccagggacccctcctataccctgccctgccctggctctctagtgagaaattgcagttgcttggacagtggggctgacccaggacaaatgcatatattgggctggtcttcagggtgctggggtaggggcaggggcacttcagggataggaaggaggggcctgtgtgttccagaagtacagaggaacctggtgccggccgcagtcaacccctatgtgatgatctttctacccgccctctttcgtgtcttggtgctggctgctgtctttggccaggtaagctcatggtctgggctcctggggtccactcactgggcctccacactgcctgcaggtaggggagcctttgggccaggactatccttggctccccttccaggtggtgggttcaaagaccattcctgggttccaccaccgccaagcctcaatggtcacaggaactgctggggctttctaggttaagacccttgcctatcctggtgttcctccctgcagtagggggctgcaggggtcagcctcagtctctgccttgggagcctgccttaccttgcctgaactcaagcgatctgcctgccttggactcccaaagtgctgcaattataggcgtgagccactgcacccagcccagccttgactttgaaatatatgttgtacatccagacagcagtgaactctgggggaacaccaaagatgaggagaatgagagaagagatacctccaattaaaggagttaggaagagatgcttgaacttatgttttaaaaagtcaatgcaggttgggcacagtggctcgcacctgtacacacagcaccttgggaggctgaagtgggtgaacggctggagcctagaagtctgagaccaccctgggcaacatggcaaaaccccgtctgtacacaaaatacaataattagccaggcacggtggtgcctgtggtcccagctactcgggaggctgaggtgggaggtcgaggctgcagtgagctgagatccaccactccactgcagcctgggcgacagagtgacaccctgtcttaaaaaaaaaaaaatgtcactgttttggggttttctgggtgaaacctctgtttccataaaaaaagaaaaaggtcgagacagtgtgtattactgattcaaaatcataacctgatgcttagagtaaatcattgtatctattgtttcaaaaaccaacgtcaggattattaaaagttaattttattgggtttttctttaagcttggctgattcactcaggtctgtcacttccaagcccatgttttactactttgtaaccctatttggaaggaaaactgcagctcacattatgatccatcctgagatgaagagtttcacacatatacaccacatataccccccaccacagtatgacgacacagcaacccaaccttgggcaaatggtaccactgccagcaaatttttttctttattttaaatatttttactgtatttcttctaacagcagcaaatgcatttaacactttattgagattctcaacagctgccatttggtttgtatagcaaattgtttacaaagtaacttttttccatttttgatattttaatgaaaattatgttcttcagttttaaagctctgtccctctcccaaagaaaggttaataactaactaccaagtaatgattatttgggaaaagaagaaaagcaaaaccagcttgtaaacacttctggaacgtgggtaaggggccaaagtcaagaccttctgggcccagtgcaggtgctaggcttgcctcgggacaccatcagcacttccccatccacaacatcctcaacagctgggagccatgtgcagaccccagggggcttcctgttccacaagctgccctctctttttcctctccacccttgctgttgggcctcccttccaaatctgcctaacaaaggcagcaggatctttaatactgttcagctttgtcaatggagacaggatactctagaaagttgagagattccctggtccagtctgggggagggaaaaaatatgcagtgtagcatagatggttgtacttgtccactcagacacatgctcatacttattagatggatgtatcagatgcttcaaaagtcctgatgtgtagtagcacaaaagctgcttgtaaaaaggaagttgcaaaatgataaaaatttctgcagcagttcaggctcctgatgacaaagctggttctgataagtagttcttttgacatgcacagcagctttcactgtaagtcctgtgttccagcggtttcatttagaccacgggaagttgaaagcaaagtttaaatgttctctgctgacaaaatgtggtatatatccatcaatggacttctactcagtaatgaaaggaacaaactaccaaaacctgttatatgtcatggaccaacctcaaaaaccttagctaagtaaaaagccagacatgtgaccacatattgtataattctgttgatttgaaatgtccaaaaaaggcaagttgatagagacagaaatggtctgatttacctcaagaagtagggattcaagctcttagggtacatgtgatacatacattagaagaaataaggaaaagaaaagaaatttatatgtaaataaatgaaaataatacttctccctgattataaagaaaattgcattctttttgtaataatttggaagacaaaatatgaagaaaagtctttaattttgccactgaaagcattctggtttgttgctttttatatttttttatgcatatgaacattttaaaaagtagaatcgtaatatatagtcttttgtcactatgttttgggcatatttctatggcagtaaatatatccttggcatcatctttttaaaagctcgatgtgtattaagttaatcattgccaccccagaagtaaattttcttatatatatattttaatggacgcaagcaagcattttggggctgaagtcatagaagtagaatttctggagaaaaataacataaaatagttttaagatttttaatagaaattttcaaattatcctgcagaaaaattggttcagtttatactcccaacaggggcagagctccagtatcccgtttccatttgtcctctttgctgatatttaaggagaaaatctcattgttttcattgtatttctttggtttctagtgcttttgaaacttttttttttttttgagatggagtcttgctctatggcccaggctggtgtgcaacagtgcaatctcggataactgcaacctctgcctcctgggttcaagcgattctcctgcctcagcttcccgagtagctgggattacaggtgcccaccgccatgcctggctaatttttgtattttttagtagagatgggatttcaccatgttggtcaggcccgtctcaaactcttgacctcaggtgatccacccacctcggcctcctaaagtgctgggattacaggcgtgagccacggccctggccttgaatcatttttatgtgcttattggccatttttattcttgtgggaagtgcctgtttctccattgcctattttctggccaagctcccaagtcacatttcacttaatttttatcctgctgattgaaagcattttaacataaacaggagcaggacagactgtaattatctagatcttgctctgtcacccaggctggagtgcagtggcatgatcatagctaccacagcgtcgtactcctgagctgaagcagttttcatacatcagccttccaagtagctaggactacaggtgtgtgccaccacccccagctaatttttaagattttttgtagagatgcgaattcactatgctgcccaggctggtcttgaactcctgacttaaagtgatcctcccaccttggcttgccaaagtgttgggattacaggtgtgaactactgctcctggccgagggctcattttgtttgctagtggtgatattggtatctgtttatatttgaggctttggtgctagtgctgaagtattacactcaccatccgaggtttgcaggacttttgttttaatattgaatagatggaactgtttacttctgcatctttgcaggcatacaaaatgtgcctaccaggactctgctttatatctattgaaagcaagaagtaatacagtaaaactttgcctggctagaggctttggaagaatggagtattctgatttaacgctattgaagtgtgaaggtgaaaagaatgaaaaacttacatttcctgttgaatgcaacttgaaaatacagccagtgattccacttttcttctctagtaagtttggacattctgatctacttggtgttttattatagaactgctagtgtgcccgagacttacattgtgaagacactttttaaaaaacttgagaggtaagagggtgtaaatggtattgtgtgagatcaggctggatgagaactgacacttgtaaacatactttttaggctgaatctctgattgccgtttgttttcttatttaactcataaaaataaaacacattggatggagggtaggagcaggaaggagatttatgtcttttaattgcatgccattgtttcatatcaagacagaacatatggtatccctggctttggacctacagaaggaaacacatttttctgcctgctgtatgccagaggttcttgaacacctggagggatgactgcagcacagattgctgagccctactccagagtttctgattcaccatgtccagggtggggcctgagaatttgcacttataaaaggttctcaggttctgctgctgctgctagtccagagactacatttttgagaaccactcttgtctactaactgtaaattgtagaactctagaacaaagcttagtttggtgtaggaaaagaagctcacaggttatggagcaaatcatgaaagattcaacccttgatcccagcctagtgtggaattcaggtaacaatcaatacacagtgacataacacaattcttggttttcatgattgcaagtcatagccaagtatcaagtgagaaattcagtttcatttgcaaggcttagagaggccaggtgattctagaaaaataggccttgtatttgctttaaaccagtaaagagctttgagtgcttattaaatggaaagctttgtgtttttatttatttttgactattttattttatttttttgagatggagtctcagtctgtcacccaggctggagtgcagtggcgtgaccttggctcactgcaacttccgcctcccgggttcaagtgattctcctgcctcagcctccccagtagctgggattacgggtacccaccaccacacctggctagtttttgtatttcgagtagagacagggtttcaccatgttggccaggctggtcttgaactcctgacctaaggtgatccacccacctaggcctcccaaagtgctgggattacaggtgtgagccaccacacccggcccaaaagctttgtgtttttaaagatattagacatgtttcttgttttttaaaaaatcttaataatgtaggagaataagagaaatgttttttccaaagccgagaaatcattgtgattattttaccttattgggatgttggataatatagtccacttcattcattaatcatcaaacatgctatggattttccatttttataggatttgtgtcttaactggggtaatactggtaattcttatactccctctgaagatgaaaaatgtaggccaaaatcatagaccatgcatagaagctggataatgaagacagctctggaggaacatgtagacacacacacactgacacacatatatataaagtataaatacatatttttttaaagtttatttttaacattttaaagcaaaaaccagccctcccctctcccggagtaggcaggccccgcccctctccccaagtgggcagggacagcagtcgcatgggcagctttccttgtgatgtcacaggttcctctgggcacactgctgcctggccacgcctcctttccctttcatctttctcattgaccaatgggattggagcagtaaggccacacccctattctgcattctagtgtggccctggttacgcctcctctggctcagtcacacagcagccttgtaggtgactggaggtgttcgctgatgtggccccaaccctacctccctccccaccccatgatgttagaagaatctcgacagaataaattggcagcagccaagaaaaaggtaaaaagccaagaaaaaggtcatggccccccaacctagccagagatcccctctgatgacaagaccactcccagagtccataccactcctgaggcacaccgggctgggcccccctaccccggcgcctctggactccccccaccaacgtcttgtcagtcagccccgccccttcagcaagcagcccagcctctgccctcgccaatcaccctgcggtgactttgggcggatgactactggggatacctgctccatattcagccctcacgtcctgccaccccaagcccaacctccctgggttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctggactggcatctccaaggacctgggtcccagccccacgtcccccctcccccatcgtggatcggcaactcagccattgcactgatgaggtttcccccacccccaggaggagtggaatgtagtgatgtcacagtcctcctaggaactgtcattactgctgcaagaccggcctttgatcttataacccagtcccctaagcattctcaccccatttctggttcctctggtcacagcacaaatttccagctagaagggaaatggggaccatgggacctaggagcaagaggtttcaggctgccttactcccttcacatagacatcgacagtgtgaaaagcctacacttcccctgtgagctcaaaacgttgacagtatctctgggtggtaatgggagaatgggtttggtttggttttctcccaggcttctactctccagagagactttaacatttttttccgagttctccacctcatattctaattctccacggttctgggaccagactgcccttcagtcagtggtctctgaagtgagatttgctcatcttctgtggaataggtcttgggaaactgaacttgacagcttgaatcttcctcatatcatctcaacttagggtacattgagtgccacaggataaatgtgggagatctttctgaagcatcagtttcccttgattctcttgagagagaaaaaacattaatgtacttaggggtgaccctcacataggtttctaagagtataccagacttctctctgaaatgagacttgggttgtcctctttctgataaattcccagatttaacaaaaaagctgccttctgccatgaggacacattgatataaaagtttgagagatactggtgcacttcttcacactaacaggcatttgaggatgtatgactctaaaccacacagcgtgtagttcatgcctatgtaatgtttacttttctacctctgcgtctggttttggtccccggcagctgctgattcatggcaaaaccccagagcttggagtcagaagactgagtttaagttccattattgcccccccacacttttttttttagccataatatccatccctctcagtcacttaagtgattgtgacaacaccttgtacagttgttggtggcattaaatcagatggtgtataagagtattttgcaaaaactgtaaggagggtgtggctgtaagggctggtagttctcatgagtattactgctcttctttcccacagctaaaagaatatcagcaaaggaagagccctggtattccagcaggagcaaagacaaaaaagaaaaaaactgacagtagccctgagacaaccacttccggtggtggccactcacctggggatgtgagtcttggctggccaggctcctggggacagggggcccaaggggcagtagagggtaattgttgagattgctgggtactggttaagaattctgggtttgaatcctgcttcttcatctgctagcgatctgatttatggcaagttgcttgagctctttgggcctctcttttcacatctgtaaaataggggtagtattgtttgacttccatttgtgaagtttaaatgagattccttattgttgttgttttcatgttaacccctagtacgtggcctgctgtaaacacccaggatacccaggaaatggtcattgctgtttgattttcctgatccccactcgcaaggggaagctgggctaatgagtacagccacttgccatcaggctgtccctctaggagtcactgaagggggcccagggtgtggtgaggagagcccaaggcactaggagcaagagaaggtctaacttgccaccagcttgctgggtgaccacagaaaaatcacttcttctgctgggcctcagtttcctcctctgtaagatgatactggataagatcagtgtctttcaaacttgttttttagctgaagtccccttagttcaagtgaactcttactcaggagtctgtttttttttaatggaggtggaggtctggagctctaccagattcatcgtccatgtcctgggcctgaggagaggggtccagtgagcgtattaagatctgcattggtcagctgactccactctgtgactgcgtcactcgggggacttttccatctattttttcctgcccctggcaaggcagcaggtggccatttggaagaatggcacaggccatggttttaatctcctctgctcttcttcagcgtttccttttcctgaacccacatcttcctcctaccctgactttcttgcttctctctaagccacttctgtctttcaccccctgcccttgtttttcccttgtcacctcctgtagattcaggacattctgaaggtgcgggtgtccaaccttaaccactccaatggggtagtgctcccccattggacaagtggaaggtgaggcagtgccaagacccctctctggcttgctgtctacagctgtgcatggccctgaggcttctctggcttgggggatgcttggcctctgccttgttttatgttgctgccattaaccttcagcctgtttctgtctgcttcttcacctgcttgattgattgggttttttccttccccgcgtcttttattatcttggaaatggtgacgcctaaaagtttaaaagtaatctgggaataacgtacagagcaggcatgtgggatttgggctctttttttttttttttttttttttttttgagacagagtctcactctgtcactcagactggagtggagtggtgcgatctcggctcactacaacctctgcctcccgggttcaagtgattctcttgccttagcctcctgagtagctgggattacaggcacctgccactacgcctggctaatctttgtatttttagtagagatgcagtttcaccatgtcggccaggctgatcttgatctcctgacctcaagtgatccacttgtctcagcctcctgaactgctgggattacatgtgtgagccactgtgcccggctccttgctgtttttatactttctccatatacataactatttcccatgtaagtttttttttaatttctcatttttattactcctgcatcatctgttaccctgaaggatctggaagtaagaggccctgggctgaggtgcagtgactttgcaggccagccctccaacctcctctcacagtgggggctgggtgaccctctgccagctgagacagcccacacacaccccagccctaatgattgttctctctacctctccccacaatcctcttccaactcctcctctctgcatgtgcctcagagccagtaccaagaactagcagtagccctggagtcaagctcagtgacaatcaatcagctcaatgaaaacatagaatcattggtaagtccagtggggtcccctgattccatgctgccaatcctgggctttagtttccccttggggccctgaagaaaggggctgggggcccctggtgccaagggcaaatggggagctggagcacccaggcctcacctggagggaccccagagcaaggagcacgcagcatggctcttctgtcactgccctctttgccgactctctcttctccagacacccctgctccagtccttgccacacacgccctgaggttgtcacctctcagggaagcgctagcctgactggttgtcaggggccctgtatttctgccctgactcagtccctaatttgctttgagtctggacaagccacctgtcctccttgggcttgtgtttctggaggaggtagagcatcaaagttctctgttagctctgagagtctgagatttaaaggcccctagaatggaaacctgagggccaagggctcctgtctgtccttttccatcctatatctgctgtgaagaaccgtagctggcccgtatgtgttcagtaaatgtttgttgaatgaaggcacctttctaaatcacaagctggcagaagggtgggccttcctgagactccctctctagaggtttatgttactgtcctttcaagagaatccagattcaggctttgagttctgtggctgtgggcaaaaaccaacaaagacccaagtcctctgtccttgggagcttgaggagggttgaccagtttgtgttgccattggttctgagaatgttgcctttaaaatccattcctggaccctgcctaccgcttccaggtctggggaatagagttgagggggccactctcagtcacctgaatttgactctccccacagaaacagcagaagaaacaagtggaacatcagctggaagaagtaacgtgatttctttgctcacaacatgactgctgggtttgggggacactcagatgcagaggcgccagtctcatcttgcccactcccagcctggggaagaaggctcacccatcagattccaccccatccccacagggtccctgataacctggtcccatgggtgggcctgtcctggggcattggtggcattctgggggcatgtctcttgctgtgccatctctgcctccctgtgataagagctctgtcttcctcttcctacaggcaaagaaaacaaacaatgaaatacacaaagcacaaatggagcagttagaggtgagtggagggtggggagctttctcctgtcctctggagaatgtttctttccttctctttcagcatttccttggcttttctcccaaacgttcaattccagacaatcaacatcctcacattggaaaaggcagacttgaagaccaccctttaccatactaaacgtgctgcccgacacttcgaaggtgggaatctgggcatcccgtcatccttcaacctggcactttgacaggtctttagggggagtcttttgggccccatctcaacctctctcattacagaagagtccaaggatctggctggccgcctgcaatactccttacagcatattcaagaattggagcgggctctctgtgctgtgtctacacagcagcaggaagaggacagggtgagtccaaccagctgccccatcccctggcagcctggcttcccagatagaggagtgagcctaaaggtcccttctgcaggatggagtgtcctgcccagaaggcagcatggtcatttctcactacttttgtgtatggttgttagaggcagcctggggctaagtcagctgctgtgggtgagttggggggcactgtggggagtgagcactggatgcagagctcagaggccaagtgcctgccctgccctttcctggctgtggccttggccaagtcctaggtggggtattgggtagttgttctgtgaaggtacagaagagcacctttagtatgttaccatttctgtagagagaggaaaggggtgtgtgtgtgtgtgtgtgtgtgtgtgtgtgtactatgataatatacaaaaacatgtctgcaagcattcataaaaaactcaggagagagtaacagggtgcctggagacacctcccttctgtaccttctgagttttggactgtatgaatgtatcatcctttcaaaaagtgaacaaaagattaatttcccccttcctatctgtgtccccacccccagcaagaaaaatgggcttagagaataggatagacctgggtgttcaaatcccagctctgtctaagtgatcttaggcaagcacttaaccttgaacactcgatgtttttcatctacacaatagaggtaatcctagtaaccgtctcatatggtggttgtgaggattaaatgggattgctagcatggaacctggtgaagcactccataacggttcaaacagtggtagtaataacagtaataacaatagcaatattatctgatctctctgggcctctgttagccagctgtaaattctatctctttccctctcccttccaactttactgagttcttttaataaccaggccacgggcttggaaatgccttgacctttactgaccgagttgtatattgagcctagccctagcccttttaaggggcactgcccgagctccccagatcaaaacttctcactcttcaccatccagtcctcgagctgcagagaagcggtcctccagcggcggttacagcagaccataaaggagcgggcgctgctgaacgcacacgtgacacaggtgaggctttgcagagggagggatgtggaaggaagatgaccccaggtggccaggagcaggtgaggaccagtgacagcccttcctaacttctgtgcccatttcttgcaggtgacagagtcactaaaacaagtccagctagagcgagacgaatatgctaaacacataaaaggagagagggcccggtggcaggagaggatgtggaaaatgtcggtggaggtgaggtctgacccttcagcccccactttagataggtcactggatctttctgggcatctgtaaaatgggaatagtacagccagaggtggtcatgggtctgggctttgtggagatggggacagagaatgagatggtagcctgtccagccaccagcccctctctccagggccctttcccctgtgctttgggcaggctcgaacattgaaggaagagaagaagcgtgacatacatcggatacaggagctggagaggagcttgtccgaactcaaaaaccagatgggtaagatggggctggtgtgacctcggagcaggactggcatcagaggtctgtgggggtggcttagaatgccccagggaggtgggtgggtggaagggctttgaggcagagggaaagaggtctgtgccaggagacggcaagttttgtcatctccatgagcctcagggtccccatcagcaaagagggaggagtgcccgttgtcagccacccacagtgctctctatgtgaaagtggcttggaaattggctaccattgggtgcgaggaatgattagcagtgaggccaagtttgggaagcctgagaggagctgtgcatcaagaggaggttttttttttttttttgagggggatgtgggtagaggggttggggaatccagaggcccttattgtctgcttcatttctcagctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctggtgggttgccccacctggggagcctgccctcatccctatccctccaggcctttgtttccccacctgtaaaatgggccagtgtagccctcacatgaaatgctacttctaaaggcacctgtgagctacagctcatcgggctctgctctgatggctgtgggggagaagggatgatttttctaacctgcctccacccttcctggtgatatgggaggcagacaccaaggtctggtgtctccagctgcagtggatggccactgattgcttctctctgtccagaacaacgagaaaaagagcgcactgcagttggagcagcaagtaaaggagctgcaggagaagctagacgaggtgaaggagatggtaacctccaccccatccaagaagggctgggaggcgggcaccagcctctggggaggggaggtgccaggccaaaggcagctccagctgggaggcaggtgaccccagcaccctccagtgcagctctatgactgtttcttgcttcctgccctctgacttttagaggtgggtagccctgggctcctcccaggtctggacatcatcatcccagctagagacatggagcccccaatcacaggggaagagacagtggtacaagaggctccttatccaggcacggtggctcgcacctgtaatcccagcactttgggaggctgaggcaggagaatcacttgaggtcaggagtttgagaccagcctggccaacgtggcgaaacctcacccctactaaaattacaacaacaacaacaaaaaattagccaggcatggtggcgcatgcctgtaatcccagctactcaggaggctgaggcacgagaatcgcttgagcccacgtggtggaggctgcagtgagctgagattgcaccactgcactccagcctgggccacagagtgacactgtctcaaaacaaaacaaaaaaggctccttagattcaaactggattctggcctgggttccactggtcaccattcaactactgttcatctctaagtctctgtttctgtgacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatttgaggctggggaaggaggtatggggttctaggcaagggaggaagcctcttaggcctggagcaagggaccagggtcctgggcaggtgacagagccccacggtgccctcgctaccctattaatgggcccagaatctggaagccagccaccatgtgccctcatgcccagggtcttcctgcaggtggagctgaagagccaagagtctcagagtctgcagcagcagcgagactagtacctgggtcacctgcagcagtacatggccacctatcagcagctgacctctgagaaggaggcgctgcacaggcagttactgctgcagacccagttcgtggaccagctgcagcagcaggaagcttggggcaaagcggtggctgagatggccggccaaaagttgcaggagacccaggggagggagttgctgaggacggggccccgagggggatgacctggcaacctccgtgccttctcactctgtttcccgtccccttaggagcacctagaagctgccagccagcggaaccaacagctagagacccagctaagcctcgtggctctccctggagaaggtacaggagaccactcagaggaagaggagagagccccaggaggaaggggggactgttagcagcataggattgaggggttggaagagacctttagaacagctggtcgttatgccaaccgggtgtccgcactaagttcagcatcaatatggtgacctcctgggagcagggggccaccaggttgcctaaggatgaatgaactggaccagatcagaaagggagcaggtcaggactcccgcaccgaccggtagtgggactgtgcctgggcaatatagcaagatcttggttcttaaaaggaaaaataaagaacagcagctcactcccctctggggagaggctggctcagggttacacagtcagggtggggacagaggtaggcccacagtaccttccttgttgggttgtctgaggacccctctggccacctccccacaggagatggaggacaacatctggacagtgaggaggaggaggcgcctcggcccacgccaaacatcccagaggacctggagagccgggaggccacggtgagcctgactttccctgccccactttgccaccttcctctgtggtccctcccagagcccgttatgctcttggttttcccaccttctgatttctctggcccctcaccccttccgggagccagtggtcagacactttgtcacctgtgaccaacaggtgcactctctgaggccccaagggaaggggttgttctccacctccctgcctcatttgttctgtctatgcccctacaagaatactcacctcttgccttcaagtggcatttttcaactccgctggagccagttcccaggaggagcaggcacggctatgtgggcagcggaaggtgtgaaggctgtgctgcctgcacctggctcatctggtggccttggcctggaaggagccagaggcagaggccccagccccagggaggactggagatgagtttgtgtgtggggagagctaccgggccctgaaggaggccatggtgaagctgaaagggagtgagtcctggcatgggccaagaaaagtgggggcggggcagaacaggtcactcccgaggtgtgaccccattattttggctccagagcagctttatggacctcccgaaggagaaggcggacgggacggagcaggtggagagacgagagcttggattcgtccagccttctggagtgacagacggcatgagtgagcgggaggccagggcacgggcatggggagctgcagggccgtcggagggaccctagtgtctgagctgtgtcctctcacaggagagtccttcaccgtatatgaaagccagggggcagtgccaaacacgcggcaccaggagatggaggatgtcatcaggctggcccagaaggaggaggagatgaaggtagggcgtgcaacatctctgcggggttgggggtgggcatgggcactggtgcaggctccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggtgagtagagctctcaggcggggtgggcaggcaggggcaggggaggctcgcactgtgctcagacccccgcctccctctctccgaagttttttatgaagtgagcctggacaacaacgtggagcctgcaccaggagtggccagggagggttctccccataacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacttttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgcactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattcttcttaaggtatttagtgaagatcataagaaatcctttaagagtttaaatgtccctggaagaggcatacaggctctagtcaagaatgaattcgagtgaaggaaagctgtgtgacacctggccttcctctatgttcatggagcttctttgaggctagaagattgattttatcatctagacctctctggctaatacctattcttcaaccacactagttactctgacataggaatttacttcttttctttgaatggaaaacactttaaaaataataacaatcattattataaaccaatatatgtgagagtacttagttgaaacaaaaaggagttttagtagacagtattatactacacatgaaaatcaaggtgaagtttatgcaacttaaaatgtttacaagctgccgtgcaatctactgtttgtgagtgtccaagtattatgagaaaaagtgtctatacaatgacagacttatgtttcctcacaaagttcttcacaaagagtgaaatatgtttttatacctctcggtttcagttagaggcatattttgtgccatatttatgttaatgtgcctatacatgatgagtgaattatttcagtcatacattgcctaaatcataactttaagatgcttgggaaagaatcaacagctaaaagttcatgaagttctaatgtctgtgttccaaaatacgtcacattattaggatgcagggagagatgtgtgtgcgctccctggggtgggcatttctagttactagaccatctccatttttagcatttggcatcttcatgatacttttatacatatgacattaataggagagcaataatacgattttacagatggaataacagatgtgcctgcattcactgaaagagtgcaaatattaagtccttgtgacttcaactgactcttccaaattgtatgaatttatcaatgtattagataaacccagtttcagaattataaagaaaaactgttagaccaactaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcatatcactgttaattagccaccttatttggtctaacagtgggtttacctaatacattgataaattatttcaaaggtatttttatagttcaaatcacttcacttttaccctgataaatataaatgactaggaatgatcttcagatagcctttagcacctgcaaccaatctgacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcgtatgacaacaacttaagtctttcttcaaagtgcatgtggtcctttgcaatacctcattcagccaagtatttgttctcttcctcattcagtataaggcagctttcaatttgcttagaaggcaacattagaagggtagagtttaatcagaaacatagaattttaaagtgtgggttcaactgaataaatctgaatttctgtaggaagtaaagaattaaaaaccgatttaaagattgcaatatataatcatttttaaagtatttgattaaatctgataggttttccagaaatgaaaaaaagtcagttctaaaaccaaagctgatatttagaaaatgtgaaaatgtaaatcagccctatccataatagtttctctaaaactttatcttaaagagtcattttaaaagaatataactattcaaaaatgtaactgctatcttaagttttaaaataagttaagacattttgaaatatgaatactgtagtttaaaagaaagaaactgggggaaggaaaagtagagaaagaaatgccaattccaatgcaaagctttatttgccaagttttcttagaatgacttttaccaatttatgaattcttgtaaacagaatgtataatggaaatactgaaacactgttgcctaaagtggcattattcactgctactgtgatgctactgtaatgtaataaattattaaattgttgcaaagtgctgtttttgccttaaaattttgtgtgtcttgaaaactgtggtgttaaaggtattgagactgtgcaaatgctgggcacgcttggcatgagataatcggtttttatttttataaaattgtaatgtaaccatgaagtgtgtttatttgaagaacacaaacccaaagttatgggataaaaaaggttgtgggatgaaaaagttacaggataaaaaatgttatggaaaagttgtggcaaaaaaaagttgtggaaaaaacgtaaaagttttatgaaaagcttaaaaaaagggccgggctcgctggctcatgcctgtaatcccagcactttgggaggccgaggcgggtggatcacgaggtcaggagatcgagaccatcctggctaacatgctgaaaccccctctctactaaaaatacaaaaaaaaaaaattagctgggcgtggtggcgggcgcctgtagtcccagctactcgggaggctgaggcaagagaatggcgtgaacctgggaggtggagcttgcagtgagccaagatcgcaccactgcactccagccagggtgactgagcaagactccatctcaaaaaaaaaaaaaagcttaaagtattatgaaaaagaaattatgggattaaaaaataagtcatgggataaaaataaataaaagcaggcccctgtcagcataagcctggagaagtggggctggagtctctgtccctaccatgctcctaccaccccctcccagtcacccctttaccattagggtagcaagacaagacccctgtctaatggggggagaaaaacagaccctttgccaccttgaccagggctgagtccttaaatttctggatgatgatgattactatttaagagccagaggctggtagagctggtttgtttggaggaggcctcatggcctccctactctcaccgaagcaacttttccctcagggggctcccatcttcttattcagagaggcagctgaggcgggacagtggggctaactgtagagcaggcgagggcacaggctgctggggtggacccccttccgcagtgtacatatagtatctgtgtgacattttgtatattccagggggtagggccaccccctgtattgtacctagaggaggttggagctggcatatgaggaggaggttctaatcattatttgtggctgggaaacttatttattgatagcataggacagaggaaggaggcggggatggggttgtggctccctggtgatgtgactcccgtttattttgcttttcattttggagtaaatggatttagccatactgctcagcctggtggattcccgtgtccctcactgggtcctggagtttgtgccactgaacgaggagccctagagtgactgagcatgtccagctgggctcttggggaccttccaggcctgttacctgtatgctgcctggtgacacctggtggatttcacagggactgccatggcgcctatagggcacagtcccgccctgacagccaacagcctcagaagcctgatgtagcagtggccgggaagacaaataccagcacccaagggcactgacttccaccccaggcatcttccgttccatccccctgcctccctcgcctgtctgcacccggtggcctgttctgtctgtccctccagtgtacctggtggcctgttagtgctggctgccccgcaggctcctccagtctgagttcatggccctgccccctagtggccagagccggcttcgcaggataaaagccagctaagctccaggggctttccaggaaaagtgtcccttggaaagggtgtgtggccttttcactcctcccaacagcaccctagaaatggcttggccttttccctcccctgcgctccacagagaacacagccagtagaggacacattccccatcatccagaaatgggtttgattctcagccgagggacagcaggactggtagagactgtcaggccacacagctgcctgcacagcacccccattcttggtggggggtgggagggatggcgggggctggctgtccacaggccggacatgacagggaggctcactggaggtggcacactttggaggggcagtgtcaggggagaccttcctcttgttgggccacaagactccacaaggacagcacggtgacagattcccagtgctagaggcgaggcggtcagccatgtgtaggtgtatatatatatatacgtatatataactagatatatatatagagagagagagagagagagagagtatttatagatatttatagaacagggcaggggcataccacagagggggcacaagttttcagcaacggtcacacctggatcagctcaccactatgacagactaagtcacagatgaagggggctggctttggggctggggagccactgtccagtcacaggacacccgcccaggcaggcttggaaagggaggcctccgagaagaggaggatctgtttagaggtcagagtggggctggggctctcaggacgggatggacttgcctgacctgatcagctggcagttggagagaaagcagagagaaaatgggagagagaaatgtgagcagagagctggtgaggcaagcacagagcacaggcgtgctgcagcagctgtgggagggccggggaggggaggacacaggtgcaggtgtggcaaggttcctggaaaagaggggctggaaggaaaaggggaggaagatggagggaggagccggagcttcacaggtagtgcctgggggctgtggcagccctccccagcccacacacactggcctctcccacggcacccaggcagtgcacccacagttcagaccaatgctcagccccctcgggcttccctcttctctggtcaccctccccttccaacccactggcccagggccacctctcgccttggggagccccacccaacagccaccaggcctgatagagaaggaacactgcttgacccaggatggtgaagctaaaagggatggctggactgagtgagcgccagaggcccctctgggtcatcagaaagcccaggaccctctgaaaggaccctgggggaggcaggaagggcatatgccactggccatagacttataagtctaaggggggagcctcagctggttgtgggggcctgcaggttgcataggtgagcctgggcccctcctgctgggaaaagcagaagagggagagtctgtggcaggggaggtgggtgggctggctatgtggagctcagctgggccagcagggactgtggtccccttggctgaatagcacaggtgacccctaggagcaacaggccaaggtgcatgagcccgctggctggcggtagtgtttcagcaggggccagggaccctgccttcagtcacacgctagcaggtatgatggtatctgggagggagggaagggggctgtgtgttcctgcctggcctgtgaggtgtgttgtgggatgaccatgtgtatgggactctcaagattttatcctagatcaccactggattgccaacatatagaggaggtgggaccctgactatcaaccctgctctgcagtggatttggctctcggcactcccagactgggaactggataccctgccctggcagcatgactcagactgcacgacagttatgttgtgcccaggtgacattcctaggcctctggccgcctcagagtccagccccacacacaacgccctccacattcccagcccctacaccataaaccatgagttctctgccctctccgaggactctagagagcacccacatctgccaacttgggcatggaggctgttccaagagcccacagtcttagccatggaggctggggggctttggggccgtgggggccagccctggtacctgcatccagtaggatgctctgcacctgcagtcaggagttgtccatgggcccccgtgggcgtgctgattgtgttcatgaccgctgtgcctgctctgccgactcctccatcagcatgttcttgtccccatgcaagtacaggttggccagcagctccgagaagataaactccttgttctgagagtgggcaaagagggaaggaggttgggacctgatgcctgtgccaccctggccaccctgccaggccctgctggggctgtacgctggacttggagccccgggtatggcttttcagatgcggcttctacactgcttagactcgaagacccacctccccaccgctttttctcactcagatggggacactgaggtccagaggaaaagtcacctgcccaaggtcacagatctgggaggggacccaggatctatcatgccaccaggacacctgtctactcagtttttaatttttggagataggatctctctctattgccaggctggagtatagtgggcaagatcatggctcactgcagcctcaacctccttggctcaaagtgatcctccaaggttagcctgttgagtagctaggactacaggcaagtgccaccaccaggcccagctatttttaaaatttttttgtagagaccaggtctcactatgttacccaggctggtctcaaactcctgggctcaagcgatccttctgccttggcctcccaaagtgctgggattacaggcatgggccactgtgcccagtcccacgttataattctatgggacagctctggtctggaccgtgcccctctccctggacctggtcccatagggctggttgtcatctctggcaggacaacatggccacctgtgtccccagtgccacaggagccccctgcccccatgaggcggtgcacgcacgttgttgatcatgaggtgcatgatggtcttgggtgtgagaccaaccatgaggtcccacacggtcttgttgacaatggccacataggagtccaccaggctctgggtggtctccatctgccactccagctgtgggaccatggagtgcatgaagctgttggaaccattctcctcggccttgctggcctgctgtggagagcacgaaggcatcagggcggccaggccatgcagccaggctccaggcatccccaggatctcagccccctccaagggtacctggaacattgaggcacagggagaaacaactggccagaacacacacccagctccccacacaatctagagggtttcaggtctctgcctctcaggaccccagactctcccgattcagcctcgtcttagttctgactctagtacccagaatttgcctccatttcccaatccagaaattggaaaagaacatctccaggtccctcacttgaagacatggccagaggtggtgccatgctacagacacctggcaggaggtgggaagggcatactcactttccccttgtcctgggaggcccacacaccaacattgccgccaccgctgccacctgggagcacagccaaagtagacacacacaggaaaaggggaagggttgagtgaagctgggacactgcaccccaactttaatgtgttgatgaattcaatctgctaatattttgtggaggatttttgcatcaatattcatcagtgatattggcctgtagttctctgttttggatgtatctttggttttggtatcagggtaatactagccttgtagaatgagtttggaatagttgggtaaggcctctagttttggaatagtttgggtaaggttggtatgagttcttctttaaatgtttggtagaattcagcagtgaagcaccaggtcccaggcttttcttcgcagggagactttttattaccgctttgatgtcatggtttcttattggtctgttcaggttttggatttcatcacggttcaatcttggcaggctggatgtgtctagaaatgtatccatttttagtaggttttcctatttctttgcatacattgcttataacagccactagtgagcctgtgaatttttgtggtatcagttgtaattttcctttttcatcttagattttattcacttgtgtcttctttttgtcttagtcttactttggctaaaagtttgtcaacattgtttctctcttccaaaacccaacttttcatttcattgatgcttttgattgttgtcttcatttcaattccatttatttctgctctgatctttattatttttcttctactaattttgggtttgctttgctcttgcttttctatttctttaagatgcattgttaggttgattatttgatgcttttctacttttaaaaagtaggagtttatagccgtaaatttccctcttagtactgcttttgtcgtatcccataggttctggcatgttgtgtttccattatcatttaagaaatgttccaatttccttcttaatttcttcactgacccagagcatattatttaatctccatgagtttgtatagtttccaacatttcttgttactaacttctagttttattccattgtgatcagagaagatgtttgatattatttcatttttctctaatgttttaagatgtgtcgtgtgacctaagatatggtgtgtccttgagaatgatccatgtgctgaggaaaaaaatgtgtattctgtagcccaagggagaagacacctgcccccactctgctgcaacacacagcgctctgctcagggatggggcagtggtgtgctgttgttacacaaggggctctctgtcggggagggaacagaagtctgttctgtagtgtttgccattttcggtggtgcaaatattccatggctgatttcaaactgccaccgtcttctcagcctgggcttgtttgtacccacccttgggaaggctttccaggtatttgaaaggatgtgggtgttgtgatctcaactgtatctttattaggggacactccaagccaagttacgctaaagttcttgcagactcagaggaactgccctgatggtcttggataagatctagaagaatcatctgggctaccaggcattagagactcttattctgtacctgtaatttttctccaaaaaaacagtctgtctatctgtctgtctgtctctctctctctctcttcctacctccctccctccctttctctctctgctgggtcacttggagctggggtggactgatacaacatccctatggctaccaccactgggactgcacggggtcagacctaaagcttgagtaagctcaaggcccactgtcaacactacccggctattgcctatgctaagattcagattattcacaaaatgctcccaagtgaagaaaatactttaaccacatgaagtatcatgctacacaatatggtgtggtggggaagggtgcaggctctaaaaccagaaaacacgggttcaagtcctggccctaccaccttagcaaggttacatggtctctctgtgcctccatttcctcatctaaaatgtggggatgacaataatagtgtctatttcacagagttgttttgaggaaaataatatatgtaaagcactgtgaacagcagttagtgctatgtaagtgtttgctctagttattttaacatttcagatgataaatatctaccctgttattcagatgacaagcgtccctaagctgataacatgatgaagaacttttgggtttcttaattaccatcagttttgtgagggaaaaaataccacatgaagaagagcaactgaagcaggcgtgaggaggaaacttggcttaagattggggggcttggggttattaggctttcatcttctcaaatgtcctaagctccactgataagaagacgcttagtatcaatccagctaaaaaggaacaatagaccccacaagacactgagttagagacaaaaatagcagggtaataaatgaaatatggaaaactacacaaccagaaaaataaacagctaccagtacccaaaacgtggttaaatctcacaggattatattgaatgaaagaagccagccacaaacgtgcacatactgaatgatcccatttatatgaagttccagaacaggcgaaactaattcatggtgacagaggtcaggatcctggttaactttgaggggacagcaactgagaaagggcaagagggagccctctgtgttgatgggaacattctgtatcttgagctgagtggtggttacatgaaagtgcacatatgtaaatactatggagttggccaggtgcagtggctcacacctgtaatcccagcagttggggaggctgaggcaggcagattacttgaggtcaggagttcaagaatagcctggccaacatggtgaaacgctatctctactacaatacaaaaattacccagacgtggtggtaggtgcctgtaatgccagctactcaggaggctgaggcaggagaattgcttgaatgcaagaggcggagttttcactgagccaagatcgagtcactgcactccagtctgggcaacagagagagactccatctcaaaaacaaaaaaaatatggagttgtaacttaaggtatatgcacttcactgtatgtaagatactgtcttagtccatttgtgctgctataacaaaatatatgagactgggtaataggtaaagaataaaaatttatttctcacagttctggtagctgggaagtccaagatcaaggtgccagcaggtttgtagtctagcgagggctgctctctgcttctaagatggcaccttgaacactatgtcctaacataatggaaaagacagaaaaacaaaagaagaaaaccgagctaggtagctccctcaagccctttcataaggtcactaatcccattcacgagggggctcctcccttacagcttagtcatctcctaaacacttcacctcttaatgctatcacattggggtttaagttccaatatgaattttaaaggagacacaatcattccaaccatagcaaatatactctactaaaaagaaaaaaaggaaaatcttgtctctaaacataatattttaagagtttacatatttacagctcaattttctgcttgcttacatacatatttgtgaccatgagtgtcattattagccgagaaaagtttcagtaaattaaatttttttctcacattatctattaataccttattcagataaaaccaaatttctaacctagattttaggttgagacagaaacccatagtcgtttgttgcaatgtgagaatgacagagagagagattaactagcaggatccaactataaaaataaatttaagggaacagttctctactaatgactcccccagcaaatcattacttggatagcaatgaatcaactaaaaatggaagtgagaacagttcgagtcctttttgcaatggatggatgtttatgagactattaagtgaagaggttcacaaacaaggggataaatggcatggtaatttggagttgaatggagtaatcttggaaatataaaaatcgtgcttaatgggacttgtctacttgcaattcaataagccaacatacgtaaattcaaacagacgatggacatgaacactcagaacaaaattacagaagcagggctgggtgcagtggctcacgcctgtaatcccagcactttgggaggctgaggcggttggagaggtcaggagcttctgacgagcctggccaaagtggtgaaatcccgtctctgctaaaaatacaaaaattagccaggcgtggtggcgggcacctgtagtcccagctactcgggaggctgaggcaggagaattgcttgaacccaggaggcggaagttgcagtgagctgagattgcaccactgcactctagcctgggcggccaaggtaagactccgtcttaaaaaaaaaaaaaagaaaaaagaaaaaaaaattagccaggcgaggtgatgggcgcctatagtaccagctacttgggaggctgaggaaggaggatcactcgaacccagaaggtggaggttgcagtgagcagagattgcgccactgcactgcagcctgggtgacagagcaagactccgtctcaaaaaaaaaaaaaaattttacaggaataaatttagcaaagaggcaccaaagttaaggtaaggcccactgttccacctctgacgtctttaattcttgagtcatggggatggcaagccaggaacagagtcttctgactggaagctaaaaccagcctttgaggtgggtgcagagagactgttcagactaaagatgagaaaatgttcagactaaacatggtcgaaaatatcccgaaggcaagggcattttcaaagacagtggtgcttcgagaaagagaatgctgtgtgtttaaaaacaaaagaatggaaacaaggaagaaaaattgaccggagcgtagggtgaccatatgctctggtttgcaaggtacagctaaggttatgtctgctgtcctggtgcaattattatagtgcccctttcactctgaagtgtctggatttggatgataaagcatatggtcaccctaccaaagacaggaagttagccagaagacccatgtgtccattttaggcagtatggactgatccacagccaggctcgtgccacttcccagctgagcggtgtgcaccacctctgcctcgccctattccgccctgcccgggtttccaggaaggctggagctgaaccctcggctcccgcgctgctctggtgctacctgcaggttgtgtgggggaactgcttctccccaccccgaacctggacagccttggacttggcaaaaagactgtcaggtgctgttccccacatctcttgtctttccgctaacactttaggatagtgaggaagcaaaagagcttgagcttactaagctcctactgcgtactgggcacagagtgggcacttttctctccagcctcgcaattgatgggaaataggtgattgtacaactaggatacaggatcagagtgggctagcgacgtgctcacagtctctcagctgaaactggaacccaggggtctttgactctaaagctagtgctctttttgggtctccagcttgagcaatagttgcaaaatgcaaagagcaccatgaaaatctaatattgatccacataagaccgtattgcaaacagaaacatgcagtgtcttcgtgggagtgatggcgaggtggggagattatctcagttctatgtaacctgggaactctccaaggaaaatgaatgaagcatgaccgagtgcaatttgtctgataaaatctgtcagaacgtggggccttgtgggtcctgagtgaaggcaagaacccatggtgctggacatttgctaaggtgttctttatgaaatcactcagggcctcagtgcctccaccttctccatgaccccaggcagtttccccgtctgtcttcatcctactgcctggcacactatccatcaaactgcttttggggttatgtctcaataaaacaaaaatcatggtgggagtcatttacaccctagtgagagtcatctaagattcccttatcttctcagaccttttagctgaagttggttatgagagaggatggggagggggaaaagggtcggggcaagcacttggagcttgcactgtttcttgccaacgccctggcacagtgtgaatatgtccatctaaatggagagctctatgcatgttcctctctattccctttgtcaccaataccaattcccaaggcagagccccgggtgggctggcctgaaggacctggaggtaataggaaacacttggctttgggtttcaggtcaagctctgccagtgacttgctgtgtaacatcagacaagtcagttcacctctctgcacttcagcgacctcatctgtaaaaggctggtttggactagatcattaattttcttaagttttgcagttgttttttattttaacagtatattcaattcctcccctatctttattaaagtataattgacaaataaaaattgtgtatattgacagtgttcaatgtgatacatgcatacattgtgaaatgattaaaatgagttaattaacactttaatcacctcacatacttttttttgtggtaagaacatttaagatgtatttacttagaaatagtgtttactagaggtgaggaagggtaagggggagaaagtacccaaaggttggctaacaggttaacagatacaagagtacatggctgagtgcagtggctcatgcctgtaatcctagcactttgggaggctcacttgagcccaggagtttgagaccaggctggacaacataggagatccaatctctacaaaaaaattagaaattagccaggcatgttggtgcatgcctgtggtcccagctactctggagactgaggtaggaggatcacttgggcccaagaggtcaaggctgcagtgagttgtgattgcaccacttcattccagcctagggagcagagtgacaccctgtctggggaagaaaaacaaaacaaaacaaaaacaaagagtacagccagatgggaggaatagttctagtgtctttagcactatagggtaactataattcatgacactttattatatatttttaaatagccagaagagtggattttgaatgcccccagaacaaagaaatgataaatgtttgaggtggtggagatgctaattacgacttgatcattacacattgtatatatgtataaaaatattatactgtatcccataagtatacacaattatgttttgcttaaaaataataaaagcaggccgggcatggtggctcacgcctctaatcccatcactttgggaggccaaggcaggaaatcgagaccatcctggctaacatggtgaaaccccatctgtactaaaaatgcaaaacattagccgggcgtggtggcgcgtgcctgtagtcccagctactcgggaggctgaggcaggagaatcacttgagcctgggaggcagaggttacagtgagctgagattgtgccactgcactccagcctgggtgagagagcaagactctgtctcaaataataataataataataataataaaagcaaaaaatctactcttagtaattttcaagtatacattattaactatagtcatcatgctgtacaacagatctccagaacttacaacattatatttaattctgatcaaactactagttacacagaagtaacaacaaaatgatatctgttgcaagaaatcctcagtaaaacaagaaaagaagaaaaaaagaacaaaatggtagtgaaaggcttatatcaaaaagcatttcctctgccctttcctttcttgcctttgagtcctaattcctataggtcatcactttaaactcattttgcgacttcccctggtatgttatcgtcatatttctaaagaatgtttatgttgctatttcttgatttgttttcttcagtatctgtcagttcctggcatagctcagtatagggcttaccttcctatgaggtcttaatttccttgcctccatttcactaatttgactggatcacaatcgcatgaaatcaaaagcatttacattcttgtagccatctaaatattgaccctaacccaagtcccgcactgaaattgtttcatctctttcctttcttcccctggagttaataattgcttcagattattatccctcatttgctttttttttaaccaattacctacctattttttcagatgctccaaccaatctatcaaatgcctagtgataattatccaaaaactaagatacactggatactctatcagccccattattttcctggaggcttccctctctcccttgccctccatccttctgctccaaactggactcgactctcagcccatggcacggctggcattctgacatgtctctgcaccatcgtgtgaattttcttgctgcctcttctgtgtgcacctcctgttccctgatttactctctcattgtgttgcagtacatcttccagtgtcttcccgagaaagagtgaatggaagccaaactttctgaccctcacacattttagaatgtcattgttctaccccaactcctgattactagtttggctggatgtaatgctctaatttaagtgtaacttctcctcacattgggaaacattgctctattattttctagttcccagtgttgttgggaagaagtccgtgtcatgcagagtctcggctcttaacttatgacctgtcttttctctctggaagattttaggattttctctctatccttagttttctggaatttcctaatgatgtgccttgctgtaggtctttcttcattcaccgtgctagtcacctgatagactcttttgaactagaaaattatgtccttctattgcgggaagccaccagcaggttcatgtgagctgggtaatcacattcttttcttccaaggacggaggtatcaaggccctgggaaccttataagtggatggggagaaagggggcctgaggtgaatccaacaaagctgcagcacccactgagctcatgtcccagggctaggctctgcctgaggacaggagacatgggtgagacccacttcctgcccagtcgcatggtggggctcaggacacacatggtccaggaggcccccagccccagctacattgacatgcacctacctgtatgcagcgatcagtgagccacaggacaacttaggggaaggggcagctccagagtgcaggataggagggaagtaaataatcatggggtggggagtggccttgtggggaaggggcaaaggcagggccgtgtgtgtgtggtgtattgggggaaatggggagaacattttgtctgcccccttttctgaccactgcaccccttttatcatgaatagtttttcttcccatcatggactgagtgtctctgtctcctccaaattcatatgttgaagccctaaccctctgcatggctgtatttggagatgaggcctctcaggaagtcataaaggttaaatgaggtcctaagggtgggggccctgattcagtaggattagtgtccttataagacgagacaccagagagtgcactcactctctctctgcacaaatacaaagaagaggtcatgtgagcacacaatatggcagccacctatgggccaagagaagaggcctcagaatgaaacctaccttgctggcactttggtcttggatttcccagcctccagaactgtgagaaataaatgtctgtggtttaagccacccagtctgtggtattttggcatggcaccctgaactgactaatacatctccccaccctacttcaaccacatgacactagagggcttggcagttttggagtcccagctactcagccaacccagaccagaccaagcagaaactttcttctggaattttctgattaggaactaatggaggggagccccatcctttcttggaggcaaagccaggaagacggaagccccatggtgccaacagcctgactccaaccttgtggggaaagttgctctgagaacacaaaactgatctgcagactgaggtggagacagagacaaggaaaggagcctgcaaatcctaacagcactggtgattctgagtccaggtattcctgaggcccaactgttccctgccctgcccgtggctaacttactgaccaaggagcttcccttcttgcctaagccaactcgagtgaattttctgtcacgcacatccaaagagccctggctgcaatggcagggcatggcagggctgggctggctggagcagaggacggtgtgggtggaatcagcagtgacaggcacacaggaagtgcaggtatcgagtggcctccatgaggtcttcctccagccccgactgtgagcaaggctgggctcatacgctcagtaggtcagagtgagggatttggtcagaggtgccatgctcagggccatctttctatgagccagactctatgtcatcaaaagctttgccatcagagatagttttagtcacatcttgggttcacttgatcaattgctgttctcctgctttcaggatctctacactaggctgccccatgtgggtgttaggaagccataggcatcctgactaaaaacccagaccacaaaaagtgcttctaccagcctgcccagggctccagagggcaggaccgatgggtggtggggtgggccacgcctgggcagtcgtgacatgtacaccactcttgatctgtcttctggaacttttcactcctccagtttgggtcccggtggggcacacgtgggaaagaccatgaatacccatgtctctgactagtttccccatcagaagtggacgttgcaccaagcaccctcctccattaaaactggacagactaaggaccactttcccaatggatgggtcttcttggtccatctcatgctcccaacagagctccctccctgggatgggaatgcgccatgccaggagagccctcttgacccagcctccagccaaagccagtccccctgccaagcaggccctagagttacactggaggggaacaggcctcacctggaaatttcttgctgaaaattgtcagtttcccacacaagtacagcctggcagtttaattcaaattaaaaccagaaggagactgctgcttcagtctcgactgcttgaaaattacgttgtgtagagctttcatttgctggaaattgtgcagccagacattgtgcagattgacccagtagctacagcagtacacacatagggcgccaagcaaggacaagtgtgcacatgtgtgcacgcacacacacacagcagaaaatctagaaataaactattttaatgtcagctgtcatggaagttttgtgtcatttccccaaaaaatacaaattttattttatgatttagtcttgtttttatttagaattacttaaggaaaaggaaacgtgagtgcagtggctcatacctgtaatctcagcactttgggaggctgaggcaggaggatcacttgagcccgggagttcaagaccagcctgggcaacatggtgaaacccgatcgctataaaaaatatgaaaataagccagatgtggtagcatgtatctgtggtcccagctacccaggagactgaggtgggaggatcccttgggcccaggaggcagaggttgcagtgagccgagatcacatcactgcagtctagcctgggtgacagagtgagatcccatctcaaaaagaaagaaagagaaagaaagagagaaaaagacagagaaagagaagagaaaagaaaaagaagaggaaataagagaagagaaaagaaagagaaaagaaaagaaaaagaagagaagagaaaagaaataagagaaaagaaacaagagaagagaaaagaggagagaaaagaggggagggaggggagagaagaggaggggagaggagcaataggatcctgatatctggtgtggggaaacttaaatggatacatctgagaattctgaacctccagtttccactaaatgctctggtctaaaagaagtagccccctttccctgctaagagaagggcagctgccccttgccgggagactgggcaaagagcctccaacaaggcctcacagcaggatgaggtgtgtcgtcattgctgccccacattgacaccaggctatggtcattcttcatcatggcccaaggtcacaagcacagtctgctctgggagaatgatttttttttgccaaaaatgcaggagctgccgagtgtgtactggcagaatctaggagaggaggtgaagaagtggacataagggtgttggaccaggaggagactaaaggctgtatacacgagaatacagtgacctgggagcactctcaggatttaatgcttggcaaagacacctggggctccaacacagtgctggagtggctccttgaaatgtggacagaacagttgctgcagtgaattaggtggagattatagaattgcatttgcaaagcgtcaaagaagccagaaagtacagggaggtaggaatgttggaatggttcattatatgccaggagattcggaatccaccacttgactatgtgcccttggagggctcacaggaactcccctctctaggcaagcaaggaaggcactagtgagaagggcacctgaatctttgagagactcagtggcactatccttggtaggccaggatcgacaagaggagatgctgccatgagaccaggcttcgtggtgtcagtgggaacggtggaaggcgagaacagcggatgccaggtggtggcccttcaccatcatccacaaggtggatgtaattaacttaattggtaggaaggctagagtgacagccaggatgccttgacctccagggagctgttgtattggctacaaactgatggcattccaggggagagttacataggcagttgactagggtggttttttcttttgttttgttttttgagacaggatcttaatctgtagcccagtctggagtgcagtggcacaatcatagctctctgcagcctcaacctcctgggctcaagcgatcctcccacctcagcctcccaggaagctgggattacaggcatgcaccaccatgcctggctatttttttttttctaatttttagtgaagatgaggtcttgctatgttgcctagactggtctcaaactcctgagcgcaagcaatcctcctgctgtgacctcccaaattgttgggattacacatgtgagccctaggacatttcctgatttgtgtattcaggaaaaaacaagatctggcacgcagaaggctgcaacaaaaaattgcaatttcctacccagttttcagactgagacaattgagacctatagctcatggattgtaggggaggctgggtattcttggaaaaagatcctgcaacaacaccacatggtattcattaattattctccaaagggatctggggtcattgatgaaagtaactgtagctgatgaaaagggaatacccagactgtttgagggccattcatataggattagagctgaccatgccaccataagatccacaatgccaccatgtcccatccccaacaagactgaggacatgtgaaggctaggtaataaatggatccctggatgaagaggccacagccccatccggttgtcatttctctgtccctaaatatgcaattgatatgagtatgcttagaagctaacagagctctcactttactccctgacctgtgggtatgagccactatagtaggaagaacatgggggaagtctctgcaattccctcttcccacttccaggagcaatgcagtattccaggtggaaacacagagatttatcacctccctcaactgtgaccgctgccttataatgatagtattcttacatttccccacctgtcccttgtgccattctcatgatcattttacttccacatgttataaacacgacaatatgttactacttttgcctcggtcaattatttctagacatcacaaaaggagaaaataggatcttttctatttatccatgtatttattatgtcagtggtcttcattcctttgtgtagactcaaatttctacccagtgtcatttttcttctgaccaaagtactgcttttaacacttctcagagtgcaggcctgctggtgattatcctggcttttgtttgtgtgaaaaagtctttattttgtcttcattaaaatttttgaaatttttttgttgtttttttttttttgtttttgtttgtttgtttttgagatgaggcctcactatgttgcccaggctggtctcaaactcctggcctcaggcaatcctcctgcctcaacctctcaaagtgctgggatgattacaggcgtgagccaccaccacacctggcctcattgactttttaaaactcattttaatcccatatctgcagagttaatttttcatctctagtaattctttttgttttattttgacacaaggtctcactatgtgcccaggctggagtgcagtggcacgaaaacagctcactgcaacctcgacctcctggattcaggtgatcctcctgcctcagcctcctgagtagctgggactacaggtgcatgccaccatgcctggctaattttaaaattatttatagagataggtctccctatgttgcccaggctggtcttgaactcctgggctcaagcaatccttgtgtctcagcctcccaaagttctgggattacaggtgtgagccaccgcacccagcctgtgtttgtttgtttttttccaatatatcttccatttctctcttctcataatgttcagatttagatttttctagccttcttgaacatatggagcatatttatatgttttttaatgtccttatctgctaattacatcatctctgtcatttctgggcctatttccattgatttatttctcttctggttataggccatattatgcctgttgtttttttgttttgtttttttgttttttgttttgagacagcatcttactctgtcacccaggctggagtgcagtggtgtgatctcacctcactgcaatctccatctcatggttcaagcaattctcatgtctcagcctgccaagtagctgggactacagttgcgtaccaacatgcctggctaatttttgtatttttagtagagacaggatttagccatattggccaggctggccttgaactcctggcctcatgcaatctgcccacctcggcctcccaaagtgctgggattacaggcatgagccactgtgcctggccattgcctggcaatgttttattgactggtagacattgtttttgtgttgtgactgctggattttgttttcctttaaatagtgtgggactctgttccagcactagttaagttacttgaaataagttggatctatcaaggtttactttcaaactttgtgaggacagtttcagagaagcctttactccagtgctcatttagccccactattaaggcaatacttttctaaagcttctcttccatttcctaagtattatgaggtgttttcatccgcactagtgagaatatgaattctctctagcctgttgtgagctctggggattcttctgtctgctttctggcagttctttccctgggtactttcttctcacatacatccatatcagccctttgccaaaggcttgagggcatcttccatagctctccagagctcacgcgctctcttctcccacctcctccctggtactctacctcacaaattctaccggccttgaagaccttcccaagctctgatctctgtctcctcaatccaccaagaccactggactttggattcccctccctgtgttggagcctgtaagtgcttccggcagtaaaccgaggacactgtagggttcaccttcttttagggatcatagttctgctcgacctgttctctgatgtctgaaaactatcgttttatatatgttgttccatttttctagttgttcaaggtgggaggcaaatctggtccctgttagcaatcgtggccacatgtagaggttgcaggatgttgtttacgtctgtatcttttttttttttttttgagacaggctctcactctgtcgccccaagtggtgccctcttgcctcactgccaccttcactttgtggcctcaagcgatcctcccaccccagcctcccaaggtgctgggattacaggtgtgagccactgcacccggcctaaaattgtatctttcttattatcagtgaagttaaacattttttcctgtgtgtcagcggcatttgggtttctttttctttgaactttcatatttttttttccatttttcttagaatttttggtctttgtcttctctacttttagaatagaatgaatatgatattaatcatacttcgaattgtgaccatgatagagtacctgtattgatgatggtctcccagcataaacaactacaaagctggacaaagtacatgaagaaattgtcttcaggcattgggcaataggcagttccatgtacaatctgagagaagggaatcacatgaagtgactgctacatttttctggtggggaaagtttctaaaccctcaatgacagcacgaggaagcagagtccaagccaagaggatcagtcttgtttggtgaaggaaacagagactggtgctcagggctgctaaaatgtgtgtggcagagtatcagaaaggacggagttgcagaggagaagccccagaaatcttacagaggttgctgcaggtccttggccaaatcccaaacaatgagtgtgcagattgaggctctgcaaggcccagcacagaacagccgatggggagctgaaagctaaacagcgatttcagtcacagactgctggagatacatctgaattctggctcagccagagtctccactcttggaatctcagatcttgatgaatattccagacattcacagagggcctagaaggccatgccttgggattaaggaagattccctgggaataagggcaaaactgaaaaacaggtcaccctaacaaagcctaaaatgtacccttgacacacatgatcaagttaacccacgagtaatttaattccctgccaaaataaaactcaacactagagtaggataacataacccacatctctacaatgaaggttcacaacgtccaacagctcaagaaatactagatgtgtgaaaaaagtgagaaaatatatcctaaaattaagagaaacccagtcaatatgaacagacccactgtgcatggtggctcacgcctgtaatcccagcactttgggaggccaaggcaagtagatcacttgagctcaagacttcgagaccagcctgggcaacatggcataaccccatctctactaaaaattcagaaacgagttgggtatggtggtgtgcaggggcccataacccccaggctgtggactgtacccgtaggtaacctggtaggaaccaggctgcgcagcaggaggtgagtggtggacagcgagcattactgcctgagctccacccgccgtcagatcagcaggcattagattctcatagaagcgtgaaccctaatgtgaactgcacatgcgagggatctaagtttcacactctttatgagaatctaatgcctgatgatctgaagtggaacagtttcataccataaccaccacccccaaccccgtctgtggaaaaattgtcttccacgaaaccagccaggactgctggtggcacgtgcctgtggtcccagctacttggaaggctgaggtggaaggatggcttgagcctgggaggtggaggttgcagtgagttgagatcatgccgctgcactccagcctggacaacagagtgagaacttatctcaaagaaacaacaacaaaaaaagggccaggcatggtggctcacacttgtactcccagcactttgggaggctgaggcaggcagatcaccaggaattcaagaccagccagatgaggtggaggttggagtgagccgagatggtgccattgcactccagcctgggctacaagagcaaaattctatcacacacacacacaaaaaaaaagagagaaagcagacccataaatggctcacacattggaattagcaggcaagagctttaaagtaactacatacatacattaaagaatttagagaaatatcaacacctgtgaagatggtgaaaaaaaaatttagagaaataagttttagtataagtatgtcctaaatatgcatggtacatacttactaaaaaatagtttattttttatcagaaatctaaattcaactgggtgttctatatcttatctggcatctctaccccaaagccaagcaggagagaatccacagtcttatcttccagcaggtgacctagcctaggacagggcctggccaggggcaattgtgaattggatggattagagatgccagtcattcagtgtgtcaaaggtttgccagacctgcatacaatcaacattattattattattgttattttaatgttaagattttatttacaaagatttttgttgtacagaaagtaaaaatgctgttacagtcccagtgtaactggtagccacagatggttgactcaccaatcacagctatctacgctacagcaagagtctcacacaaaaacctaacaacacttacaattttgttggggtgaagtccctaagctcgatggtagattggtagattaccaagagggactacatggaggaagacggaatgtcacaggaactattctttggctctttgggtgggtgggtgtcctggggtttgtatcagctacctttttttttttttttttaacagctaccaaatccatgagcagtccaaccgatactaaacagttctgtttctgcaggtcatctggggtcttaatcatcttctccttcatcatccgtttctctcttcctctttttacctttcctgccttcttcctcctccttcatcctcatcctcatcttcatcttcttcaagtccaaattcttcttcctcctcactgacttcatcttcgtcatctccttctacattttcatcttcttcatcaaactcctcttcttcaccatcttcatcctcctcgtcttcttcgtcttcttcttcgccctcctactcttcatccacaccatccacctcagcatctgagtcaggttcctcctggtcctcttggtcatagccatccatgtaggtaagctggggcaggagcttgaagacactctcagtagtcattcatgttagtaacctcacagttaaagaggtccaggcttttcagacattctaactttttcaaaggttccaaggtgctgatatctttcagtttatttccacttaagtttagacgtgtgagatttggaagcttttcagctaacatgtccagacctccaaagattctattttcactgagttcaagctttttcaatttaggcagcttgggaagatttgaaactgagatcaagcctacatttattaaactaaggaactctaagttcacaaattcagctgttaagccctcaatttttccatcatttgatttgcaattgtccaagacaagttctcgaacagctgacggggtccagttcctcagctccaggtggatcctcctcttcatgtccatgttcccctcttcccccctcttcaaacttaactttccgcagcgggggcggatgggggagaggcatcctggcctgcacagcgagggccgtcagaagggtttgttcgcggcagaggccggcggcgcggtcctgggtggcgggcggcgtgggggcaggcgagcggagcccccggagccaagttactcacaggagcgtagaggacattatttttatttaattttttttttttttttttttttttttttttttttttgagacgagtcttgctctgtcgcccaggctggagtgcaggggcgcaatctcggctcactgcaagctccgcctcccggttcacaccattctcctgcctcagcctcccgagtagctgggactacaggcgcccaccaccacgcccggctaatttttgtacttttagtagagatggggtttcacagtgttagccaggatggtctcgatctcctgaccacgtgatccgcccaccttaggccttccaaagtgctgggattacaggcgtgagccaccgtgcccggccttttatttaatatttttgtctaaagcaactttaaaaatttaaacctgttatttggaaacatagattcagaggaaatttcaaagatggtacagagaggtttcatgtactcttcactcagtttcctccaaaggttctattttgtataaatgtagaacaatatctaacgatgtcatgtgtctaggtctataccattttatcacatatgtagactcctttaaccaccgctacaatcaagatacagaactgttccactgaaggggtggcctgccccttcacacctgtgggtatatctcgtcagatgggatgagagactgagaaaagaaataagacacagagacaaagtatagggaaagaacagtgggcccaggagacccgcgctcagcataccgaggacctgcaccggcaccggtctctgagttccctcagtatttattgattactattttttcactatctcagcaagaggaatgcagtaggggagcagggtgacagtggggagaaggtcagcaagaaaacatgtgagcaaaggaatctgtgtcacaaataagttcaaggaaagacactatgcctggatgtgcacgttggccagatttatgcgtctctccacccaaacatctcagtggagtaaagaataacaaagcagcattgctaccaacatgtctcgcctcccatcacagggcggtttttctcctatctcagaattgaacaaatctacaattgggttttataccaaaacattccattcccaggggcagcaggagacagaggccttcctcttttattaatcctcctcagcgccgatccttcacgggtgtcaggctgggggacagtcagctctttcccatcccacaaggccatatttcaggctatcacatggggagaaaccttggacgatacccggctttccggggcagaggtccctgaggctttccgcagtgcattgtgcccctggtttatcaagactagagaatggcgatgacttttaccaagcatactgcttataaacattttgttaacaaggcacaccctgcacagccctagatcccttaaaccttgattccatacaacatatgtttttgtgagctcaaggttggggcaaagttacagattaacagtatctcagggcaaagcaattgttcagggtacaggtcaaaatggagtttcttatatcttccttttctacatagacacaataacagtctgatctctcttttctctacattccatcaccatgaaaatccccctcctgctattcctctgcactcattcctggctcttcccctccactattcctactcctggcaaccactaatctgctttctgtctttataatcttgtcacttcaagaatattacaaaatgcaaaaattagctaggcatggtggcaccagcttgtagttccagctatgtgggaggctgaggcaggagaatcgcttgaacctgggaggtagaggctacagtgatcctgccgctgaagtccagcctgagaaacagggcgagactctctcaatgaatgaatgaatgaaggcctggcacggtggctcacacctataatcccagtgctttgggaggccgaggcaggtggaaccattgaggcctggagtttgagaccagtctggctaacatggcaaaacactgtctctactaaaaatacaaaaattagccaggcatgatggtgagagcctgtacttccagctacttgggagactgaggcatgagaatcgcttgaacctgggaggcggaggctgcagtgagcccagatcgtgccactgcactccagtctgggccacagagtgagacttcatctcaaaaacaaaataaaacaaaaccaaacaaagaaaaaaagaacattatataaatggaatcacacagtatgtggccttttgagactggcttttttttttttctactcagcaaatgccctttaagatccatccaagttgtgcatgttcctttatgtttttttctgtttgagatggagtctcactctgtcacccaggttggaatgtggtggcgtgatctcagctcactgcaacctccgcctcctgggttcaagcaattctcctgcctgagcctcctgagtagctgggattataggcacccaccaccatgcctggctttttttttttttttttttgagatgaagttttgctcctgttacccagtacaatggtgcgatctcggctcactgcaacctctgcctgccgagttctagcaattctcctgccccagcctcctgagcagctgggattacaggtgcctgccaccacatccagctaatttttttttgtatttttagtagagacagggttacaccatgttggccaggttggtcttgaactcctgaccttaggcaatccacctgcctcggcctcccaaagtgctgagtttacaggagtgagccattgtgcctggccccctttttattgttgaatagcatttcatagaatagatgtagcagtttgcttaaccattcacctattggggagtatttggttgtttccagtttgggactattacaaataaatctgccatgaacaatcatgtatgagtttttgtgcagacatcagttttattttctggtacaaatgcccagaagcaattgctaggtcatatattgaggtatatgtttaattaaagaagctgccaaactgttttctagagtgtctgtaccattttatattcccaccagcgatgtatgagagagttagttttgtctgcatcctcgccgatatttgatattatcactatgcttgatttgagctgttctaatagatctgtagtgatatcttactgtggttttaatttgcatttccccagtggttagtgttgaagatctattcctgtgctttaagtcaattcatttttaaaacctaaataaatgtatttaaaaaggaaacttttgctttgggaggcccaggcaggtgaattgcttgagcccaggagttcgagacaagcctgagcaacatggtgaaactccatctttacaaaaaataaaaagtatccagagtggtggcatgcgcctatggtttcagctactcaagaagtgaggcaggaggattgcttgagcctgggaggtcaaggctgcagtgagccatgattgcatcattatactccagcctgggtgaaagagcaaaattctgccttaaataaataaattaattaaaggaaatttgtgattagtgattctcagagtgtggaccctgggccagcaacatcagcatcaccatcacctgagaacttgttagaaatgcagattctcaggcgccgtcccagacctcctgaatcagaacctctgaggcgtgggttcagcgacctgtggtttaacacgccctcccggtgagaatcggtctcattcactacagatagaaggaaatggtaaaaatcaattcatccgcatatcgcctaaaatcctcttgtgggccccaggttggcacagcacacttttgggcaggagccccactcacagaggccgtgacaagaatgctcctgcccctggggttgtgcagtgacagctcacacagctccacgtggcggttctgagtttgggaagcgctgatgtagtcctactgcagcccttcctgcccttcaccggactgaggaaatccaggctctgaggagggcgagacttgcccaaggtcacccagcaacatggtcagtctcctttcccagggccctcacaatgcgtggcctgtttaaagcctgcctctattcactgctgagtgaaaaatccagctccaaaacagaatatggggaaggatactatcttgtgcagcttatgtttatagctgcagatacatgggaaaaaaagtctgaaaatactgttgaagcagttatttagggagagaagtggtttgctggttttttgtgtttttagcttttctgtatttcttaatttttatcacaataatcatgtttagttacataatcaaaatgtattaaatataatattaaaaatcaacatgaagcctgatccagccacggcctattgttggcagattcaggaagccttccagatagagcagccccgtacctgccccaggtcacaccctgggcctgggcacatgctaggtcctctgtctggataccctcaccccatggtggcctccacatctgtacccaccagcacctcctgtgggcaaggcccttgcctgcatccagccctgggcaccccctagaccagagggcacctcatggtctgagagtctgcctgtctctaaagagaggaaagctccttgggacacgtgttccacttgactatcacccctggcctggtacagaaaggtggacggtgggtatttggtgaataaatgaatgattggaatgaatccccagaatggtgatttccagaggcccttctccagctggcccaggtggaaccatttccacttttcacaggaaagccaggtgtgaggagtggggcaggtgtgtgtgaggggccaggttttcgaaggctgcatggacatggtgctttggggggtctgggggcggcagtgctgctgtgggagcctcagggagggctcatccctggaatcccccagggtatcctagtgcccccagctgctgtgcggtgtgagaattcctggctggtggggacacacagggatttgtttggattggccacctggtccagcccaaggagctgcacctccagccccttggggaaaaactcacttttgatgtgtgacaacagctgcaggcaaggggaggaagaggtgtgctgggcctcagccttagaagccagaagccagttcatgcccctaccttggtctaggtgggaaagggatgcggcctcagctagctctagggtcctgggttatggtcagaaccctcccttatggactcagtgacttgggctgacccagcccctccctgagcctcatcagtgaaaccagggctgggccagggccctcaacacctcccagctccaacctctggctttgtcccaggagggcaggagatgagacagaggtgacccgggctctcctgtttacctcaacctccttgtgaagcctccctctttctgcctgtgaggtgggtggggccggaaggagggaccacctgtgggcctctgacatctctgcccaggtgtgcctgcagagcctggtctatacccggtgctctgctacaccctacagcctggccatgacctccctgcctccagagcagctctggcccagggaagaagctggtctctgcatcgaatgataggtagaaaatggaagtggggatgatagctctgaaaaggagtcaaggaagaagctggtctctgcattgaatgataggtagaaaatggaagtggggacgatagctctgaaaaggagtcaaggaggaggtgccttcccaaggacgtggaggatttttccagaatggaacttgactggtgcgggcaaacatcaggaggtaggaagggtggctccctctgtgggagccggggccacttgcctgggccaaatggtgctaggctgtgggtaggggtgggcagagctggggttcccagagcctggggtccctgtccttgcagaggactcgaatgcaaaacaagtgtcccctgccttctggctgggggacatcctctgcttccaagcccagacatacaccagctgctacaagcccctggggctcttcagaggaccaatgggcagccatacccacgctgggccagcctgctggacccacctgcaccctggtcagagcccatgactgaggggactctctggggacaatgggggcagtctcatgctgccctcttacaggtggatccatccctgggatctggtgttgggctggggtgggctgaggctgttctctgctggggtgcctggtggacagcaggtggagcaagttctccttgactttcctggaccccaggacacagctgaacactgcactttaccctggatgccttcggattctcaggggatcctgggaaggaagagggggctgcccctgcagggggccagggctctgggccatgcttgctccccccagtaggcaccttctctccagatcaacatcacctgattcctgaaggcctgggctactgaccagagccccaactccttcaccaaggcctgtcttacatcagaccagctagtatgagtttggagccgaagggggcagagagagaacgcagggctctgtaagcgttctcggctccctgctgcggtaggcccagtagaaggccccctagaaatctgcagctgctgtaagtcactgggaggaagctgcagcagacgtgtgtttcccagcctggtagatgcagaggggtgtccgggcccccaggtgggaggcccaaatgaggccttggttgtggcagtgcaggaattctagccagctctggggccctgggcaagtcatttaacctctcagaaccctactcctggtcaccatggggctcttgtgtggatgtaaagaacccccctggccacttatgtcccatcagtggaagcctagcatgggtggagacccccgagactgaactcagtggtgggatccagccttcccagctctcctagatagagcccagagccagcagggtgggcttcctggagaagcaggtgctcctgtgggctggagagcatgagtaggggtccctttggaaaggtggaagaggctgcggtcagtggaggccataatgaggcagagcttgggcagaaggggcatgattgggggatctgaggcccaacagagactggactgaggacactatggccacctacaggacactgtgctactcaggcagtggaaacttagctagggctgggccccctggtcctgagtgaggcttcaccagtcttggaaactgtgcccaaggtggcttcatgtaagagcgcatctcagcacttttttttttttttttttttctgagacagggtcttgctttgtcatctaggctggaatgcagtggcaagatcatagcttactgcagcctcagactcctgggctcaagcgatcctcccacctcagcctcacaaagtgctggaattataggcctgaggtatgcagctcggttttaaatcttaataaatatctcctcctggtctgcttccctggctgacacacatgctggaatcttgcgcctagacagacatgtttctggacttggttccatttgttctgacggcctcctctctctcaatgaccgcacattacagtatgtggctattcttacacatttctgtatagacttgagggttagtatattaacgtcaaagttctactggtttttcaaggctggatggaatgtttgggttaatttagttgtgggcatcttgacaatataggctttccctccgggaacggtgattctgggacgcaggttttgcacattctggtttattgcttggctcgctgccacagagggatggcactgctccacacgccatgcccaagagatgtcccaccttatctttctaaatcaagctgaatattctcagttgacaggatatcatatcagtgctgcggggactcacttccccacaacccgagatgaagtgaggtggagactatggagcagatccgtgctgactgcattcacccttcctgacccgcactgctgctggccgcggctgtgtctgagtcgacagacagcattgatttggggacggggtgggggggcggtgctggagagatgcccctcacctcccttagctcctcctgtccagccagtgcttggccaccaaggcccctgacttccaggccccagtcaccactaacagggtgctgcatgggaacaaagtgtaggcccagagcctggagttcaggtcactcctccttccagtcgaagcctctatccctcccaggtgagtccaccctcattcctccatgggccaaatatcctaaacaaaggcctggacatggggtctttatccaagtgcccagaaaacacacacagaaaggctctgcaggcccccgtggcctgtcagaggtaagagcctgcccatcaaaatgcacagtccaggttcttgcagggaggtgaggaggggaggaagaaaaggtctatctcattctttcagcaggaacctaaacttgggaaagccagacgcagtacatttcttaatgatcctgatacttttataactggttacagcggggtcacatgcacaactgttttccaacatctttcaacgggacacataacatcctgcagcttatttttttattttgtaaggccaggggcagtggctcatgcctgtaatctcaacacttttggaggctgaggcaggaagtctgcttgaggccaggagttcaggaccagcccaggcaacatagcaagacccaggatacaacagagaaagaccctggctcaaaaaatatcttttccaagtgcagtgccatgatcacagctcaccatagcctccaactcctgggctcaagcgatactcccacttcagcagctgggactatcagagcgcagcaccatatctggctgatgttttaatttttagtagagatgcggtctcactatgttgcccaggctggtcttgaacgcctggcctcaagagatattcccaatgcgacctcacaatgcactggggttgcaggcatgagccaccatgcagcccctgcaaaatctaactgtccttcaggtgctccttttggacctcctagctagactgccattggcaaatgccagttgattatccacccacatgtatgttaatggatttcccatgttttatttgtctagaccaggctttctccacagcagcactgttgatgtttagggctggacagttctctgttctggagctgtttgcgcctcgcaggatgtttagcagcatccccagcctccgcctgccacatgccagcagcactcctcagtgtgacagccaaagtgatttcagatactgtcaaatatccccagggcggcaaaatcacctccagttgagaactgctgacctaaaaccctctggaacaatgttagatcatggtaatgatagcgcatactgctcctgaccttaatgggaatacctctagcatcaaagtatagtagtacctgtatactactgtctgggctgttattagtacactgtattagtccattctcactccgctatgaagaaatacccaagactgagtagtttataaagaaaagatgtttaagttgactcacagttctgcatggctggggaggcctcaggaaacttacaattatggcagaagatacctcttcccagggcagcaggagagaaggagagcgaatcaaaggagaaagcctgttataaaaccatcagatctcgtgataactcattcaccatcacgagaacagcatgggagaaaccgcccccatgattcaattatctccacctggtcccacccttgacacgtggggattattgcaattcaaggtgagatctggatggggacacacagccaaaccagattatatcctttatattagcatactgtatcgaagtataattttctttctttttttttctttgagatagagtctcggtctggctctggctggagtgcagtggcacgacctcagctaactgcaacctccatctcctaggttcaagcaattcttgtgcctcagcttcctaagtagctggaactacaggtgtgtgcaccccctagctaattttgatttttttttttagtagagacggagtttcaccatgttggccaggctggtgtcaaacttctggcctcacgtgatcccgccactttggccttccgaagtgctgagattacaggcatgagccaccgcacccagcctgaagaataatttttacaatgttaaaagcatgactttcatacaaataatgaaggaatatgtataagatattttctttaattcacaagggagttagcaacatggtgaagcaagttcaaggagctttttgagagacagtgtctgtaatgctccaggaagggcattctgaaatgtattctgagatagagacaaaacttgttaatatcctatagggaggtcaggcatggtggctcacacctgtaatcccagcactttgggaggtcaaggcaggcggatgacctgaggtcaggagttcaagaccagcctggccaacatgttgaaaccctgtctctactaaaaatacaaaattagccaggtgcagtggtggtcacctgtagtcccagctactcaggaggctgaggcaagagaatcgcttgaaccctggaggcggaggttgtagtgagctgagattgtgccactgcactccagcctgggcggcagaattaaattccgtctcaaaaaaaaaaggggggccgagcgcagtggctcacgcctgtaatcccagcactttgggaggccgaggcgggcggatcacgaggtcaggagattgagaccatcctggccaacacggtgaaaccccgtctctactaaaaatataaaaaaattagcccggcgtggtggcgggcgcctgtggtcccagctgctcgggaggctaaggcaggagaatggcgtgaacccaggaggtggaggttgcagtgagccaagatggcgccactgcactccagcctgggtgacagagcgagactccatttcaaaaaaaaaaaagaaaatcatattgggaaataaaactgccatctttgggtgttatcttttccactggacagaaaccctaagttaacatatatacatattctcaagaatattcataacatattctgtagtatatttccctacactagtggttttcaaagcatggtctcaaatgtcacctgggaatatagacacgcaatgctcaggccccacctcagtcctattgagttagaaactctggtgtgaggcccagcagccggtttcacaagccctgcaggtgatgatgatgcactctaatgtgtgagaaccacggctctaaatagtcaaatcatcttttttttttttttttttttgagacggagtctcacactgttgcccaagctgactgaaatgcagcggtgcaatctcggctcactgcagcctccacctcccgcgttcaagcgattctcatgcctcagcctcctgactggctgggattacaggcacccactaccacaccctgctaattttttttgttttttttcagtagagacaggttttgccatgttagccaggccaccgctctcgaactcctgacctcaggtgatctgcctgcctcggcctcccaaagtgctaggattacaggcatgagccaccgtgcccagcctttatttatttatttatttatttatttatttatttttattttattttatttttctgagatggtctccttctgttgctcaggatggatggagtacagtggtgccatcatggttcactgcagcctccacctcccaggctcaagagatcctctgacctcagcctcttaggtagctgggacaacacgtgtgcaccaggacaagcgggtaattttttgtagagactggggtctccctatgttgcacaagctggtctagaactcctgggctcaagcgatccaccggccttggcctaccaaagtgctatgattaaaggtcttaacattcttaaaaaatttttttgacatggtttaggatagtctagtaacttaacgtactgttgttttcaacaggctagtggttatgatttgtaaaagaactcttcagaaatgagctcaattttaccatgaattggggacactttacatttctattttatagtgcagtttaattgtcatgggctctgtcttttaaaaacctgaaagcctgcaacaataaaaccagctgcacctgttgcatgggataggcatggaattgaggagagagctcaaactacagtcagccctctgtatcctgaggttctggatccttggatttaaccaactgtgcatcgaaaatatttggaaaaagtaaaacaataaaaaaacacaggtcgggtgcagtggcgggcgcctgtagtcccagctactcgggaggctgaggcaggagaatggcgtgaacccgggtggcagagctggcagcgagtggagatcgcgccactgcactccagcctgggcaacagagcaagactccgtctcaaaaaaaaaaattaaaaaactttataacagctatttacaaagcatttacgttgtattaggtattatagtaatctagagatgatttaaagtatacggaaggatgtgcacaggttatttgcaaatactatgccatattatatcagggacttgagtatctgtgaattttggtatctctggggtcctggaaccaacatcctgaggttaccaaaggacgactgtattcaattttgtctctggttattagtctattctcaaatgtatttttcttgttgttttgtctttttgtttttgcctcttcaagtcaatgtcggaaacttagttgttctagactacccattagctcagagctaccagtaatcagactaccactgcaacctaagcaaccgatttttcttccccatcagactggcaaaaattaagataagcatctattgatgttgaagctgtagggagttttcctgagcaagtaattatgacagccctttttgctaggcacctagatgattcatcaaaatgaaataaaatacccatgcacttgaagaagttatctggtttatttccttacctgggtgctggttatgtgaggtgtacagttgatgaaaacttattaagctttataataggtacaattttctgtatgtgtagtagacgtcaatagtttttaaaatgtcttttgccacagcccgcagctgtgaataatgctattcgcttaacagtggaaaacgtgtcaatgacctgaaacaccctggctcccgggatcctacccccttaagttaaacaaatgaaataacttccactgtctttcctaatgtcttaattcggtcctcagttaaactggcggttggcgccagttttttccagggaaggattctgggagacggaggaggagacgccagcatttcgccccctgcacctccagcgggctgcggtccgctcccggcctcactcgagcaggccccgccctcccagaggcagttagtccaagtcacgtgatcgtcgactcagctgaccctgcgggaccggaaaaagaaattcccgggccctggcttcttggcgcgatggtgaggcactaggggcgaagcgaggcttgggctgctggagcgggaatgagggggcgccaagtggctccggaaactgggggaggttgtactggcctctccgcaaacacagtgtgtgcgggcgtgagggctgtgagtctggtagggaaaagtccaccactctcccgctcccgagacgggggcgggggtacggggcgggtaagacagagcaggccggccggcttagagtcccggtgcttccctggcggaaggaagggcccctgcctcccggggcaggaactagggcttgtctggagctgggagtcctttcaggtcttccccatccccaagaggacctcccaaggatacccccttccccagccctgccgtggggcttgtacaagaaggtgcttagaatcaggctcactcttccacactgttaggaagcccctccgctctttccagagccagaaagtagtagttttggggttgagacttatccatccatccatccaatccatccatccgtacgttctaagcgcctggtctataccatgaagtgtgctaggcactgggaggacttgagctgccaagggaaggggaaatcggaggcttgaattggagtcatagctaaggctccaggggcagagacctaactgcgccttgtgtgtagtgctaagggggcttcctaaggatgccatcaaacttaaaggcggatggatggcaggagctggctggctgaagtacagtttgtgtaccaggggtagggaggcaagggtgggagacgtgtgtcttcagacagggaacagcatgtgcagagacttcaggttagagagagtatggctccccaggaatggatgcatttcccatagctgggagagtatcatctgcaggttagggaaagatgaggctggacaagtagagaacaaatcttcctggctcttggatcaccacaatcaagataatgaacgtatccactggcctccataatttccttgtgtgaggggctattttaagaagtataatcaagaaaggctgttctggctgggtgcggtggctcatgcctgtaatcctagcactttgggagagtgaagagggtggatcacctgaggtcaggagttcgagaccagcatggccatggcactccagcctgggcaacagagggagactctgtcttatttttttattttttaaaaaaagaagggctggtctgatgtgtcacttaaaggatagcaagccactggccaggcgccgtggctcacgcctgtaatcccagcactttgggaggctgagggggacggatcacttgaggtcaggagttcaagaccagcctggctaacatagtgaaactctgtctctactaaaaatacaaaattagccgagtgtggtggcacatgcctgtaatcccagctacttgggaggctgaggcaggagaatcacttgaacctgggaagcggaggttgcagtgagccgaggtcgcgccattgcactccagcctggggaacaagagtgaaactgtctcaaaaaaaaaaaaaaaaggatagcaagccacacagagagtgcagcaggcatggaggcgggagcaaggctggtgtgccccagcagcagcagggaagctggagtggctggagttgtgtgggtatggggaagaggggagagagttcactcgtctctgtgaggcccaggactttgttttatcccatgctgtacccccagcacttagagtgggagctagcacagagaaggtgcttaattgatgtttgctgagcagatgaatgcctggagtagacctcagagcagggtttggtggcagggtgggtcagggagagagtttactcaacagcctggtgataggggagaacaagaggccagagggtatccatctatgtcggggaccaggggtccctggtgggcagcagtgtgggagacacacggatcctggccacacctcaggcctccctccagcctgattacctgcctccctcccttgcagaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccaggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcagtaagtatgaggccagccagggtccgggctcattctagaaggtgcacgcagcacacaaagtgcatggagagtccagggagacgacttaaccacggtcacatggttactagcagccgtagagctgggacctggccctgggtctcctgactccccacaaggtttcttgtcactgaggtctgctgtgggtgatcagaactgattatcgggcacctgccctgttctgagcctgggtcagcaggatgggagcttcttagaggccacatagccttgaatggttgagagctgagccagggtgtcggctgaggtctacttggcttgcctgctttgatcctgagagccacccaccccatctcacagtgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcaggtgaggctcagctattcctcgacgggtgagaggctctcccagatccgcctgactgcctcccacctgcccacctcttccctctgcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaatgtgtgcagggggttctgtttgggttcagatcaagggtttttgtgagagaaacacaagtgacatacaggccttcttggtccatcactcattttcttttctcaattgctgattgagggaggtcataggtaaggccaactgaggaccaaaatgcatctgcttgtctggtgagaagaaaatcagggttctagctcccagatctgggatgctcttggctctgctgtctttgccccctggccatgtcctcaggctagcagcacgttggtggccccaaagccaaatgccccttgtacagaaaggagattgcccttgtttcactgccatcttctatttatttatttatttatttagagacggagtttcgctcctcttgcccaggtttcactgccatcttgttatttatttattttgagatggtacagtggcgtgatcttggctcaccacaacctctgcctcctgggttcaagcaattcttctgcctcagctgcccgagtaggtgggattacaggcatgccccactactcccggctaattttgtttttttttttttttttcagtagagatgaggtttctccatgttggtcaggctggtctcgaactcctgacctcaggtgatccacccaccttgccctcccaaagtgctgggattacaggcgtaagccactgcgcccagccactgccatcatctttaggaagagagaagtgaccatgcctgaaccagtcattggcaagaggaacggtgttatggactgaatgttcatgttcctccagaattcatatgctgaagcctctgtccacacatgcacaccagatgagggccatgtgcgcacacgaggtggctgtctacaaggccagaaagagggctgtcaacaggaactgcgtctgctggcaccttgatcttgaacttcccagcctccagaactgtgagaaagaaatctctatggtgtaagccactagtctgtggcattgttatagcagctcgagaagactaaggcagatgggcttccaggactggcccagaccagccagggctccttgtagaaaaggctgatgccagggttggcacatggagggtacaaggaggactcgcctggagtatcttaaggaacctatcgaagaataatggcttgttccactggccaaagatgggacaatttgaacatcaaaagagatacttactgactccactcctgacttctgcttctgaaaaaatgaagtaggtgttttccctattcctcccactaagtacagttaacaaccctggatgttacatataaaacaaacaaaaagactccgagcgatggagagaaggcaccctagcctggctgggatcctcaggacctgaggctccacagagagaaattcctggaatctggaccccatggcccagtcaggttacacaaaactgatcatcacagatctgtagaactatacaaaagtgctaacattcatgattagggtctcagaaggtaaggaggaagagagtggaatggaaaaagtattcaaaaaaataatcactaaaggccaggtgcagtggcccatgcctgtaatcccagcactttgggaggtgggacaattgctttagaccttgcaactggcctgagcaacacagggagactcagtttctccaaaaaaataaaaaattagccgatcatggtggtgcgtgcttatagtctcagctactcagaaggctgaggcaggaggatcaatcgcttgagcccaggggtttgaggctgcagtgagctgtgatcatacctctgcactccagcctggataacagagctgagaccctgtctcaaaaaaaaaaaaaaaaaaaaaaaaaaaatgtatatatacacacattggaatatttttcagcccttaaaaagcagaaggttctgtcatttgtgacttggatgaacctagacgacatgatgctaagtgaaataagccaggcacagagagacaaatacctcgtcacctcacttatgcctggagttgaaaaaagggcctggggcagtggctcacgcctgtaatcccagcactttgggaagccaaggtgggaggatcacttaagcccaggagttcgagaccaggctgggcaacatggcaaacctgtctctacaaaaagtaaaaaaattagccgggtgcagtggcacatgcctgtggttccagcacttgggaggttgaggtgggaggattgcttgagccagggcggtcaaggctgcagtgaaccatgatagtgcccctgcactccagcctgggtgacagtgagaccctgtctcaaaaaaaaaaagttaaattcatagaagtcgacagtagaatggtggttagcagaggctggaggagagagagggtgggttgtggggaaaaggggagacaccggtcaaaaggtacaaagttccagttaggaggagtacattctggtgatttattgcccagcgtggtgaccagttaataatgatgtatacttcaaaatagctaaaagagggttttaaatgttctcatcacaaagaaataaatatttgaggtaatggatatcctaattagcctgatttgatctttttttgtgttttttgttttcttgagacagagtctcactctgttgcctaggctggagtgcagtggcgtgatcttggctcactgcaacctccgcctcccgagttcaagtgattctcctgcctcagcctctgtagtagctgggactacaggcatgcaccaccacccctggctaattttttgtattttttgtagagactgggtttcactatgttggccaggctggttttaaacttctgacctcaggtgatccgtctgcctcggcctcccacagtgctgggattacaggcatgagccaccgtgcccagccgatttgatcattccacaatatatgcatgtaacaaaacatcacactgtactccataaatttatacaattattatttgtcaattaaaaataaaactatagataagtcaaactggtattctaaaaaatgctccaccagccacagttgggcaagaagaagcaaaaatgaaaactgggaataaacaaagtgataaaaaaatcacaaggagactatccttggcaacatggcaaaaccccatctctacaaaaaaatacaaaaattaggtgtggtggtatgcaccattgtcccagctactcaggaggctgacgttggaggatcacctgagctcaggagttcgaggttgcagtgaaccatgatcataccactgcactccagccttgagtgacagagtgagatcctgtctcaaaaaaaataaaaaagaggttatcctgtctttttagtcaggataaccaaatagccctggtcaatgaggtaaagctatacttgacagatggattctatcaaatatattaagaatgacaattagaaaatcactttgaggctggacacggtggctcacgcctgtaatcccaatactctgggaggccaaggcaggtggatcgcttgaggtcaggagtttgagactagtcttggcaacgtggtaaaaccctgtctctactaaaaatacaaaaaattaggcatggtggcccccacctgtaatcccagctactgggaggtcgaggctgcagtgagccgagattgcaccatcgttctctagcctgggcaacagagtgagacctgtctcaaaaacaacaataaaaacctaaaactttattttcttttgagacaggatctcaaagcgaactttcgtatttttagtaaagacggggtttcaccatgttggccaggctggtcttgaactcctggcctcaagtgattcactcccccctcggcctcccatagtgttgggatttcaggcatcagccactgcgcctggccaaaaacccaaaactttatattcattgaatagcaactacccatttcctccttcccggcagctcctggcaaccaccattctacttgctgcttctgtgtgtttaactgtttaggtacctgatataagtggaaccatgaagtatttgtctttctggggtttttttgcttgtttgttttatgagacagagtctcgctctgttgccaggctggagtgcagtggcacgatctcagctcactgcaacctctgcctcctgggtgcaagcaattctcctgcctcagcctcccaagtagctgggactacaggtgcccgccaccacacctggataatttttgtatttttattagagacggggtttcaccatgttggccaggatgatctcgatctcctgacctcgtgatccacccgccttggcctcccaaagtgtcgggattataagcgtgagccactgtgtccagcctaagtatttgtccttctgtgaccaacttatttagtgcaatgtcttcgaggttacccatgttgttgcatgtggcagtatttcctttttttaaaggctgaataatattccatcatataccacattttttttaggggggcagggatggggataaggtttcactctgtcatccaggctagagtgcagcagcatgatcacagttcactgtagcctctgactcccaggctcaagcagtcctccaaccacagcctctggagtagctgggactacagatgcataccactatgctaattcttttcttatatagagatggaatctccctatgttgaccaggctggtcttgaactcgtgggctcaagcagtcctcctgtcttggcctcccaaagggctgagattacatgcatgagccaccatgcccagcctattatatatcacattttaaaaaatccatgtatcggttggttgtttccacatcttgggaataatgcttcaatgtgtgttatctcttcattggggtggcagttacatgactatgtgtttgtcaaatattgcagtctgaaaggggtaaattttactatatgtaaattatacctttatttaaacaagagaacaacaaagaaattactccatagattatttggtgttcacaaggtatgaaccatatgttttctaatgcagaggtctggctgccacagcccctgtcttgatcagtttcagctcccaataaagtgggacaatgagatattgggtgcctcctgatatgatgcaattcaaagtacagagcagtggccaggcgtagtggcttatccctgtaatcccagcactttgggaggccgaggcaggcagatcacctgaggtcaggagtttgagaccagcctggccaacatggtgaaaccccgtctctactaaaaatacaaaaatcagctgggagtggtggcatatgcctgtagtctcagctactcaggaggctgaggcaagagaatcacttgaacctgggaggcagaggttgcagtgagccaagatcgtgccactgcactccagtctgggtgacagagcaagactccatctcaaataaaacaaaacaaaacaaaaaacaacgaagtacagagcagcacctaggaagtatccctgaatatttatataatcaagcctttagatctaattcccagcatgcaggatgaaccacagatagaggaccaatctctgtgacaatatcagtgacaccctgaggatacattcagacaaattgagaatgtgatgcagcatctatctcaaacaacaactggctgagactcttcagaaaggtatcatgaagataaaagaaggggatgaagtgggtgggagagggaaggtggtttcatctagatttaaaattattaaaaagatataatccagccaggcgcggtggctcacgcctgtaatcccaacactttgggaccccgaggtcgggggatggcttgagcccaggagtttgaggctggcccaggcaacatagtgagaccacatccttacaaaacatgaattagccaggcgtggtggtgtgtgcctgtagtcccagctacttgggaggctgaggctgaggatcacttgagcccgggaggtcggaggctgcaatgacccatgattgtagcctgggggacagagtgagaccctgtctatatgtgtatatatatatatatttgggacaattggggaaatctggatgtggactagctattagatgatattaagaagttactgttggctgggcatggtggctcacttctgtaatcccagcactttgggaggccgaggcgggcagattacttgaggtcaggagttcaagaccagcctggccaacaaggcgaaacctcatctctactaaaaatatgaaaattagccaggcatgtggcacacgcctgtaatcccagttactcgggaggctgaggcaggagaatcacttgaacccgggaagtggaggctgcagtgagccgagatttcaccaccgcactccagcctgggtgacacagtgagaccctgtctcaaaaaaagaagttactgttaactaatttctaataacttagatattattagatattgtcaactaatatcaagttgttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggtaactgccccgaagcctgccccaaagcctggaaccccccaagctcggggaccccaccccgaagaatcgcgaccgcttccctgagggactacacctcccagcggctcccagcgcgctcccgggcaccgcccgttctggcgttaaccctttagtggctgcagtggcgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggcaagtggcaaagcagggagggcggaggtgaggagtcgataccccccaccccagggaccaggcgctgccgcgggccctttccctcccccaggcccggggcaggagctcggggagcccttcctggtgcccgccgtcctcctgcggagccatggggagcggctccagcgcatggcggcagcccgcccgcctcgtcctggcccctgccctgacccgggggcggccgcggggatgtccggtccgtggggcaggcccggttctcgctgcggccaagcggccgattcggccgctcccgccgctcccccgcgccaggccgagcttcgctctttccctcggtggtgagcggccagatccaggcgggtcctaagtgtggggggaggggggcgcagggaggggcggccacgcgatcctaagaccctttcagatggtgggagagcctggagaaagagacagcgtgtgcggagggggtgctccctcagatggggggtcaggaagtctccctcaagtgtctgggacagagggacagcaggggccaaggcggagatgagatccgtgagtgaggggagccgggaagaagtaaggctgcagccgcggccccgcaaggattgggactttcgtctaaacgcggtggaagcccatggaaggaagcggttagcagcaaggcagagtcctgctccctctgcagccccagctcccagcgccctgggctttccaggcacctgtccgggtaggggattgagggccgtggccaggcccgcactttcctgccagccgcagctggccacatgcccatctgaccctccgagttctcctctaaaaatggggctgacagccgctacctcacaaagtccacaccgggctcaacccgctgccttcctccccaacaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggtagggccagcaccaggtgtgatgaacatagtcgcgggctccacacctgactctcttagtgccttcttggccaacaaggggcgagtccctgccccttctgggcctcagttctctcatctgcagatcaagacagtatacctgtcctgggtcagctccctgagccagtgggcatggaaactcaaaactaattgggggccgggtgtggtggctcaagtctgtaaatcccagcactttgggaagccgaggcgggcagatcacgaggtcaggagttcgagaccagcctggccagtatggtgaaaccctgtctctactgaaaatacaaaaattagccgggcatggtggcacatgcctgtaaccccagctacttgggaggctgaggcaggaaaagcgcttgagccggtgaggccggggttgcagtgagctgagacagcaccattccactccagtctgggcaacagagcacgactctgtctcaaaaaataatgataataataactgatgggggaggagagaggagagccaagaggaggatgggtaggtactgccctgaggacatgtggccagttagtgtcagagaagctggggctcccacccacaatcccacaccacctctcagggctcccaggaggctaagaaggtggaggggctttaatatggtaagtgaggctgagcggaattgtttcaaggggatggggaggggactatctcatgacatggcttccgccttgggctttgtggtctcccacatccggcctgcccagtattctgtgtcctgtggtctcctctgcgccacttccctgcctgcagtagggtgtaacagccccacctgggatgtgatgcaggtcacctcacatggcacagtgttggccacttcctttcctctgaagaggaaacgtgtatgagtctctgcttcatgccaggccttgttctaggggctcggggtacagcagtgaacaagatgaatgtggtccctgctcccacagaactgatgttcacataggataggggaatgagaaatggacccatgccttaggaaaacccaacaggtgaaggaggtagaggatgacttggccgagggtgggggtacattagcaatggccactctagggaggtttgagctgaggcctgactgatgagaaggagccagccagaggaaggcattggaactggcaagagtcacaaatgcagaggcctggagtagggttggcaagttctccctttctgggggatgctgtgcgtccgttgacccttaggagacttggatacctgtgggatgggttggagatgtctctggtgccttagaagaaagttgactcctggccttcccctgtgtgaactccaagcacatccccagggaaacatctgtctttggtcctggattcctcccacctcagccttcctggggagtcacgccacaagttaactctgccagctggctctgaagtttctctcaaaccacgagcatttgggctgttttcttagtcccccagctggggcgtgtggcaattggcttacctcagggatcagggcacctcccaggctacccttgtaccttcaccccagaactctgtcttctgacccactcatcacacccattagtcagtcttgccatgacccttttccgcaaagaaacaagatgcacatcctcttcacggtgaggaggggagacccatgacccttggaggtggggtgggggctgctagggccctcactggtactccacatatctcctgcacagagccagacaatgtccaggatcttgagaagaatggaccctaccaatggcaaacccacatatggtctctaacccaccacaaatgctatacagggagctccagactgcaaacacacttgaggtcctgtggccacactgttctcatgtcctgaggagtctgaggtgataaacacacaacctcatatacaacctcatgttgctttttttttttttttttttgagacagggtctcgctctgttgcctaggctagagtacagtggcgccatcacagctcattgcagccttaacctccagggctcaggtgattctctcacctcaacctcctgattaactggaaccacaggagtgcatcactaagcccctggctacttcttaaatttttggtagagatggggtcttccttgttgcccaggctggtctcctgggctgaagtgatcctcctgcttcagcttcccagaatgctgggattacaggtgtgagccaccacaccagcctcaagttactttagatcagtatttttcacctttcacaatgaatttatttttaattttgtttttattttttgagatggagtctcgctctgtggcccaggctggagtgcaatgctgcgatctcagctcactgcaacctccacctcccaggttccagagattctgctgcttcaggcctcccaagtagctgggattacaggcacccaccatcatgcctggctaattttgaatttttagtagagacagggtttcaccatgttggccaggctggtctcgacctcctgacctcaagtgatctgcccgcctcggcctcccaaagtgctgagattacaggcatgagccactgcacctggccgtcctttcacaatgaatttaaatcccttgatgttcccatttaacagataggaaaacgggggcagggagaagaggaactgtaactcccagtttccttccccttgcacccagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggaccagaggttcttcaatggcattggcaactatctgcgggcagagatcctgtaccggtcagcaagcaggcatgggcatggggactgcggtgggccaggtgtgcccacattccccactgcctagcatggcttgccttgcccccactacaggctgaagatccccccctttgagaaggcccgctcggtcctggaggccctgcagcagcacaggccggtaagcccagagagggatggagcacacgtgctggcacactggtgtccacatgggccggcaaggagatgggtggggtcaggtgtccccagcttagctcaacaacaggggtggggaggggatgaactgcccaaagtctgaccaagctcagagagaaggtcagctgcctttacatggccctgctgacagacaggtcctgcccctgccccttcctcagagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccatcctggccaacatggtgaaaccccatctctactaaaaatgcaaaaaattagccaggtgtggtggtgggcacctgtaatctcagctactcgggaggatgaggcaggaaaatcgcttaaacccaggaggtggaggttgcagttgagctgagatcgtgccattgcactccagcctgggcaacaagagcaaaactccatctcaaaaaaaaaaaaaacaaaaaaacagtgtttcctccaagctgcccatgagacaggcaggacaaggattcttttatatatttatacacacacacacacacacacacacacgcacgtttatatatatttttggtagagataggatcttgccatgttgcctggactagcctcaaactgggctcaagtgatcctcccacatctgcctctaagtagctaggactacaggctcacaccaccacaccgggctaattgttaaaaattttttttgtagagacagggtctccctatgttgcccaggctggtattgaactcctggcccctagggattctcccatctaagcttcccaaagtgtcgggattacaggtgtggccactgcacagggccaggacaaggattcttaatcccactccaggatgggaaacccatggccgagtgggaagaaaccagctgaggtcacatcaccagaggagggagagtgtggcccctgactcagtccatcagcttgtgtagctgaggtctgggccaggtctaaccaggctccccactcctcccaacctgagcctgccctctgatctctgcctgttcctctgtcccacagggggcaaaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggtatggctgcctgctcccgcctcctcccctgcactctgcagccctggctgcccctcccaggcagctgccttaccctaagagggcggggggagtggtgggccctaaccaacctctgaactgctttctgagcccctcagggacccgtgtctcctccatccaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggtgggctttcctcatcactcccagaaactggctctacaggagaggatgggatggtggcctaggagcgcgtgtacaaaggtgggagaaaggctgccatggcagcccctggagtcttagctgaccatcttgcctgttcttcccccaggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttcttggcacctcttggtctgagatggccaggtaggaagggcctgctgtccggtcctggtgacagaaggcccagctcctcacaaggcaaactgagcccccatcccagtcctcaaggctctgactctatcagaggacagtttgcctctgcaaggacagcccctcagaggtggtacaaagaccctggccccaggcagcccaggagccagagctcctccagtccagattctccagggtccagggctgccccctcatcctggcaggagccaggcaaaacccacccttcggcccctccccagccccaggcccaggccctttacctgctggcacaggggaggggcttctcaactcatggtctcttcactggcttttggtggctcgaggtccccagtctctcctgtgggggctgcaacccagaccctgcacgcacaggtaccttaggatcttgcccctacccaccaaatacctgggaagccatcccaccccagacttcccacccccaccccaagcgtgaggatgggccctaaggggactgagcagcagggttcccgatccaaggatttattccacaagaaaagactgatccctgctttaggctggggaagcagaaattaggagtccccagagccttctacaaacaaaaccccagccccagggactcagtgtggcggaggctgaagcacgagcaacagggacagcacttggaagggagaaaaggtgagcttcaggcggttgtcccgaagggtcaagtggccagcagggtctggtcgctccaagagatcgcagctggagaacaggaggggccatgaaggctctgcgagggcgagactcgacccccgccccaatcccacaccgccactcacaggatggcctcctgaaccggcagcgacaagtgcagccagcagtccacgtggctgccgtgggcctcatacagcctcaggaccagcgagcggcgctgggggctgctctccgcctgcagaggaacacgtctggtgggaggggccgagggcaggcccagttcggaaccccgtccccagcacgtcccaccccttgcctgcttgacggtctccaatacgaccgcgggtgaagacacggaaaacgcactccaggaggtggcgggcgctgggctgggggctggcagagccaacagggggaagtttaggctgtaggcagcttggataacgccagcatcctggaaagagcctggggtacgaccaggaaacaatgctggtggagaatgggggctaccctcccctgtccctagaaggggcaggaagccaggttgctggggtttgggctcagggaagggcagagaggtgtctagggctgcaggaaggccccaccgtccccagcactcacccttgtgcggcatcagtgcataggtgaactcgtggcgccccgtgtcagcagtagcgtccggggctttaggcgcccgcaagctggggtgaggagggcgcgtaggggccacgctgaagctgttggagttgtggtcgggaagacccatttctccatgccagctcccaggcctggtgggtaccccacttacagcgagaggctgaggatgctgcctcgcactgacgcgccatacttgcagtcgttgagcagggccagcccaaagccgtgttctgacagatccatccagcgatgggcccacacctggagggcagatccaagacccacttggtggccctgtgcccctctttgtgctcccagactccagagctcctgtcactaggccgagcacaagctctagaaccacacaactgaactccagctcccactgtacggggccctgggcatgccacccaacctgcctaagcctcagtttccttatctgtgaaacgggaataaataatagtactcaccccatcgaatgatcatgagtatcaaattaaatgtaaaactttgtttttttcacacaggatctcagtctgtcacccaggctggagtgcagtggcttgatctcggctcactgcaacctccgccctccaggattcaagtgattctcctgcctcagcctcccaagtagctgggataacaggacatgtgccaccacgcccggctttttttttttttttgagatggagtctcactctgttgccaggctggagtgcagtggcacaatctcagctcactgcaacctccgcctaaagggttcaagcgattctcctgcctcagcctcccgagtagctgggataacaggacatgtgccaccacgcctggctaatttttctgtatttttagtagagatgggggttcaccatgttgtctatgatggtctcgatctcttgacctcgtgatccgcccacctcggccttccaaagtgctgggattataggcctgagaacactgcgcctggccaatttttgtattttttttttttttttttttgagacagagtctcgctctgtcgcccaggctggagtgcagtggcacgatcttggctcactgcaagctctgcctcccagattcacgccattctcctgcctcagcctcccaagtagctgggactacaggcgcccaccaccacacccggctaaatttttgtatttttagtagagacagggtttcatcgtgttagccaggatggtctcgatctcttgacctcgtgatccacccacctcagcctcccaaactgctgggattacaggcgtgagtcaccacgcccggcccaatttttgtatttttagtagagatggcgtttcaccatgttggccaggctggtcttgaactcctgacctcaggtgatccacccacctcggcctcccaaagtgctggaattacaggcgtgagccactgtgccttgccaatgtaaagcatttagtgcaatgcctggcacacacgttaggaagcagcaaatgttgattatcctcttcctccccagcctgttccacacaagcagtctccccagccagggaggagtccaaggccactcccaccctgccatgtcagacctcaaatcgagcccagtcccaagaggtattgtagtgggtaggtcgctgcaggtgcccaaactggatctcataggtggcctgggaactccgcacgcgagcagggaactccaccttcaggaacttgtgggcctcatgccagtgtacctgggagtgggaaggagggtgggagtcagggaaggaagagacacaccaaggcctggggctggcccctccttaccaagcacacttggggaaaacagccaccccctaccccccgactacctcggtgtggaagcggacataggggcagccaacgtccagcacaacctcctggctaagccgactgttggggctgatctgtagcaagaaccaggcgctgccccgcaggccgccctcggtgcccactgccagggtccctgcctggcccagcacaggcttcctatgggacaggggtggacatactgatccagagcagcctgtgttcccaccacctccaccatccccacatgctgcccagcctataccgtgtctccaggtggtagtccatgacgtcccatgcatcccagtacaaggggacatcatcaaatagcacaaactggttccccacggcgccctcagcaatggcctccctggaaggacatgggattggtgctgtacaaccaactgacctcgctgtctccagctgctcttggtggggtagggtggagtgagtagacccagtggacaggggactactgcccagcctgccctgctccatgtgtgggttccagcccagagccactggtgggctgctgtgggcagtgttgtggcaaggggagagaggaaatggcctggggtctacttgccaggcactgggaaagggcaatgaggatttggcacctgccagaggccaccaggaccaaggacgtcaggcgaccagttgggtccagcttcactcggatgatgccattgtccagagtcacggagccatcagtctttgtgggaggaggccttgaggctgagtctgtaggggcttcccacaccaaaagtcttcccaccccaaccccagccccgcctcaccacttgctccagacaggggagctcaggaccctcagttgtaagaaagtatcccagcacagttcctgccccccagggcatgcaggactcacctcttgcactacgaacacaggctgctggggcagcaggggctgcagtgaggtggggggaggaacaggagcatagcccatgctgggcactgtcaccagggctgggggtgaggcctgggcatcagtgcagccttcctgacctttcaggaagcttgcgcaggtggggatgggttggtggaagatgtgctactactctccagtcaggggcacccagatccctcggggtatcccaggcctgatctgtctggcctccatccttcctgctgcagtagcaacccttcccctcagctcgtacctaggctgtgggccccgcccggtttgggcagggccatcacttcgatccgcttccagggcagtgtgttgacgatgaggaggccctcaggacctggctccccagcacacagggctgcggctgcagcgctgagcagtgtattgccatgggaacggatgtctgaggaaagactggctggtcataggtgggcaacaggtctggaatgtgcccatgggtatcccacaggggacactctgggctcagccctggggttggagagagcaggcaggactattgtgagcctaaccttcataatggcacatggcttcctctgccaccatctggatgcagcttccagtcaccacatcatggaactggttcagaagaaggagcctgcaggggccaagggcagggatgggaaggctgggaggggcaggcacagaggtaactgcagtgagcagtcaggtggatggcagggacagaactgggctgacctccagaggtgctgcagctgggctgctgggtataggaactgggcactgcgggccagggccaggctactgagcagctccacgtcgtgcaggatccgctcacattcccggttccccttcttgatctgagcccaggatgggaagattagtctggagcctgcttagctgtcccaggacaccttccaaagccctcccttgctcagaatccctgaggactcaccaagggcctcgtggagaaggcctctggcgggtgacctgccttaaatgccttccctcttctccccgcagcccaaacccttctttcttcaggggtttctgcctccttcaagctttcttgaccaacccaggtcttgaacttctctcctccaaacttctcttcccctagatctggcctgggctctgtcccctgctgccttctctgaccctctgcagatcaagggcacaccctccctgcacagccctgcaacctccccctgacctgggcatgggtggtgtatgtgccattgtgcagctccaagaagagctccccaacccacgtgcacagctgctctgagtcactctccagtgctgagaagagctgtcttggagaagatagctgcaccctgaggagaccacaagcctaggtctcccagccttggagaccacatggctcacccttcttccacaccaaagcaaaggatccagctcctacagagaggagccactccagaaagctccccgttcacagatggccagccctggacgccctaggagagcctctctctctgatgggctggagcccttaccagcttcagcttctcccccacccacccccagggtggaagtttggaggaacccgtggtctaggattgggacaggacaaggtccagaggaggggttgggcccaatgtctgagggaaggcagggctcatggcaagggcccagggtggggctaaaggagagccaaggcctggcctgacctgggcagcccatccgtattgctcaggcgcttcaggcggtccagcatggtctgggtggggccaccacccccatccccaaagccaaagaggaaggcactgtggttggcccgccccttgtcccggttgttggccacggtcttcagcacctagacaggtgagggcaggccagcatggatcagcctggaacaagccagccctctccagcctgcccctaccccaccaccctaggtgacccctcacctcctccacgctgccctgcatcccataggagtcgccaggtgggaagtggaccagtacacgggagccatccaggccctcccagaaaaatgtatggtgctaccagcagggaaacagaagcagggcagagaggccagagtcagggctgaggcagagccaggccttccagacttggtcctgcccctgcctgctatgtgaccctggcagaggcagagtgagggtttggtggtctgtctaggaccccacaataagggggagaggcaaatgggccaggcgggactgaggcccactctgaccctgaccccccgggggcctgcttactgggaaggagttcaccaaattccagctcaatttctgggtgagaaagcgcctgatgccacagccgtgcatgatctgggggagctgtgctgagtagccaaaggtgtccggcagccagaactgtggagaaagaggatcctggagtgcaggaaccagagctccaggcggactcaccccagcctcagcccctcagcactccaagtcgagcgccagccccactcgcccacagcctggtgtagcagctctcagcctacctcagagcacatcttcccaaactcctgcagaaagaagttctggccctgcaaaaactgcctcaccatggcctctccactgggcaggttcccatcctggcagtgaaggaagtgggaggcagcccaggtcagcgctggacggggagcaggcaggcgctcaggccaacccaatccctgcaggagaagccagggctgctcaaacatgggagttacagccagaactcaggaagggcccctgtccttcaggcctgactgtccatctgcctgagggggtgcccaggactaggccatgcaacttgtcacagcgctggaggctctcctcccccttgaagtcccaggccttgagatcccagggactaatgagccagccctgccacacagcggggatgagtggcccgtggaaactcaccagcaaagccgggagggcggggctacctgagggaaggctgttgtcatacagttcaaggctgaggagtgcccagtgcacttaccatctccacccaggtgccccccacaggcacaaactgcccacggcacgcaaactcctggatgcgggagtacaggccagggtagcggctcttcacccattccagctgctgcgcctgtgggcaggttgaagggagctgggaccagagtgacaagggccccacccaggactgagcatatgggactcagtgtgtggctgagggtgaggagcagccctgaccccaggcctgggaagccttcagggcctgtggagctccagggagggccacgtgcttccctcctccctcacagctgtccctctgacctgggagcaggcaaagatgaactcagggttccgctccatgagctgcagggcggtcacccagctccgggcacatttcctcacagtctctttgaagggccaaagccaggctatacggggagtgaggtggaggacagagggagcagcaaggctgaccaggcctgggctgggactccagagggtcacctagcccccctcccatcccaggcccttcaccctggaaagccctgtggtgtccctcctaagtggtcacttcacttcactccagcgaggtgggaggaggggctggggaaaggaggcggcagtgctatgaggccaattatacaggtcaggaaatggaggctccaggccccagaatagcctcagtcctcttggggaattagacatcccctagaggatcctacgagaagtagcagggactaccctgcccctgcacaaacttgatgtatacctgggaacagaggcatggctcccaggatggagccagctgtcctaccagaggtgctacagcctctcctgactcccaggctgcagttcctcccttaccagcccagaacctctcacaccttaccctacatcttggcacagcagagaaagcccttgttctgtgatcccaaaacttcggctgcatcagaatcaataccttcaggagcttgttaaaaatgtggatttcccgtaaaactcagacactgcaaacttgtccaggaagcctctctggaatcccccaacccagctggagtaagtacctctcctgtgctctccagtgcctcagactccccaccattgtgacaccaactctgcctgctgaatctgtctctgtaatcctaccctcaatatctagcatgggccccatgaggcatcagattttgttgaaagaataaatgaggctgggcacggtgggtcatgcctgtaatcccagcactttgggaggccaaggcaggcggatcacctgaggtcaggagtttgagaccagcctggccaacgtggtgaaaccccgtctctactaaaaatacaaaaattaaccaggcattgtggtgggtgcctgtaatcccagctactaaggaggctgaggcaagagaatcgcctgaacccgggaggcagaggttgcagtgagccgagatcacaccattgcactccaccctgggtgacaagagtgagactccgtctcaaaaaaaaaaaaagtgaatccaaagcaagcagagcccacagtccagccccccggccccgttttacagacggggaaaacgcaggtccaagaggagcaagaacttgctgagcatcacacagtgcttctagggcacatccaggtcttcaagggcactcctgcttccccagccagcccaaccagctgctgtcctacctgtatcaatgtggcagtgccctgtggcatgaatggtgtgttggctttcacccccatgttggccaaagaacctggaggccagggcctgggccactgggaaggtctcgggctgggcagggtcacacacgttcaccatctgattggctgtgtacagggcctggaagctgcgctggttgtccttcccgaggccctgcagcagggttctgccccttaatccctttttcaagcacagcttccagacctaggctccactgatctcagggctctcagcagagctcccctgacccccaaccctttttccctgctggtccccctgctcagcaccgtctccctcctccccttcacataggaaaattctctcaaccctcaagcaggtggaaaccctcgtcctactctggattcccagagtcccatttatctgacccaaagaacaaccttcttggagcagggctctagagggtagcagggggtacagggggtgtcaagtaccttggctatgcccagcagcagctccagatccaccaggagcatgtggacatcccggtggaacacagctagctcagcccggctcagctggaacatcttctcagggtcaggggctgcaatcatgcttcccttcccggcccccaggagcccattgcaggctacttccacatagagagtgaggctacaaagatggggagacagcctcaggctaagggactggcacagtactccggggacttggggaaggggcacccaggaggcatccagctgagcccaacctgtctgcttccaggatccactacccagaggatcccacagtgtgacaagagtgcatgtgggagggttgtggtacaaacaccagatggatcccatgtcttgctgtcagagagaataagtagcaaagtttggaaccatgtaaagtacgctgctgtttagtcttatatttccaaagttgtctttgcaaagcactgccttggtcttggaaccctctttgcatattaaaatcatgttcggatctcccaggctcaaacttttagacccaagatctaaaaccaacacggccaacatgggcgggccattcattggagaacaggctgggctgtggtgatgccatacttaggcttcagagagcaaacacgacttccttagggaggccttcctgactccacttcgctgctaagtctagagcaaattcctcagtggagtacccaggatttccttccagagccctcagttttgtaattatatgagtgaatctgtctccctttgttggcaagggctattttattcaccaccatactcccagtgtctgaaagcatctgaaacagtgtcaatctatataaaatacattcataatgtctaagaagtgtttttaatggtgtcataaaatgtccatgttataacatggaatgtaagaagtcaggatacaatcttaactagtaaaaactataccgggatgagccgggcacggtggctcattcctgtaatcccagcactttgggagactcaggcaagtggatagcctgaggtcagcagtttgagaccagcctggccaacagagtcaaaccccgtctctactaaaaatacaaaaaattagctgggcatggtggtgggcacctgtaatctcagctagtagggaggctgaggcaggagaattgcttgaacctgggaggcggcggtcgcagtgagccgagatcgtgccattgcactccagcctgggtaacaaaagcgaaactccgtctcaaaaaaatccaaaaaaacccccccgaaaaaacaaaaaaaactatgccggaaagatacaccaagaacatgaatactgggccaggtgcggtggctcacgcctgtaattccagcattttgggaagctgagaggggcggataacctgaggtcaagaatttgagagtagcctggccaacacggtgaaaccctttctctaccaaaaataaaaaaaaaatagctggacgtggtggcacacacctgtaatccctgctactcgggaagctgaggcatgagaatcgcttgaacctgggaggcagaaggtacagtgagctgcgatcgtgctactgtactccagcatcggcgacagagggagacttcgtctcaaaaaaaagaacatgaatgctgagatgttaataatgttcatctctattctagggagtggaataacggtagttatttacttctttgtgctttcctgtatttaccacaggcaaacattgctattatttttgagacaaggtctcactctgttgcccaggctgcagtgcagcggtgtgatcatggctcactgcagcctcatcctcctgggctcaggtgatcctcccactcagcctcccagggtagtgtgggtcactgcacccagcccattatttttatggttaggaaaaaatcatgcttttaaaagcaaacaatgagatgtgaggatgattgtgctagagcagaggcgggcttatgagatcactctgggcctcagctcctccttgctcactggtactccctccctgacagcactggtcaaccagggcacagggactcaccttcgggggtctctttcccccagcctgtcagtcaggacatagctggtcttctcaccctctttggttaaaccctagtagggaggggagtgagagagacaaggcttgaggcttttggacagttcaggtaaagtgtaagccatggggagtcaggcccctccatctggttcccagctctgggtcctctctcccaagcagggccaagattggcaaatcagggacccttggcagtagatgccccaactcccatggcagccagcaccatgaccgtcaaatagcccctgtttaccagtggcaaacccatggtcttatgggaagggccctgggaaggggttaggcagcctgagtgtggattctggtggcctctgcacccctaaataaataccgggaaagaaactccgtgaagtcaggggcaggtttgcctcattccctgctacaccctagtgcttaagggtatggcccagaatggacaccaggagatatttgctgagccagtgaagggaggaagggatggtctctgccttcttgtagccaggaagaacagtcttaaccccagattgagagtcagtccaatttgaaatagaagctgtgtgaacctgagtgagtcaactacacatctgtttcttaatttgtaaatgggtataaagacctactagataggagtataaggactaaacctgataagggtggagcatgaataagacacttaacagtggttatagctggggaatgggatgggtgataaggagagatccattactttatctagaactgtttgaaatgttttcctataagtttgtattatacacaataaaaactaaggaccaattgcacagatgcccaagtggcaacttccctagtcctgaaatcctgataccaccctgtgggcagagcaactcagctgtggcttctccagagtccacagaagaagggctgtagtcatttcagggctgaaatgtggccatacctggccctaggacagggttcctcacctggacaggttctccatcacgccacaccagaccttctccatcactttcccagcaaaggtgaacttcctggcccacccatgcctctgggatggtcagctccacccggaaccagcaggtccaccatctgcaagagagctgttgtgataggcctagaggtagaagtcctatcctgatatccttccttggataaagtgtcggcaggggcttgaaactctccaagcatctgcagtgtcacaaggtactcagctttgagtcacaagaaaggagcaacaaggtgagaagcaagatgagggaaacaggcagaggcgtcaaaggttcgtgatccctagggtgcccttcctaagggatgtccagaggcggccacgtgggaatgaaaaccatcccctgaagacccagggaccagagagctgttcccagcagagggtgctgctcccagcagagggtgctgctcgatcccacgtagttgtctacggcagagggcagacaacgaaggtgtggctgggagctgggttgggacttcccctaggcctgtggccccgcccacccgctgggcgttacctacgtgggtccgaagctgtcgccgacctgcgcggggcggaagtcccgctggactgcctcctggtagggaagtctctccggcgtcaggaagctggagagcacagccacagggcagctggccccaaaaagcctgcgtgggacgggccggtgggcacatgctggaggccgccccgtttccgcctgggggccagctggccggtggggccgcactttccctggatcctccgccaagagggctgcctggccgctccgcggcacagtccattccctaccccctcctccccggcccctgccctgcccgcggcgggcactttgtcccgcggcccgggtggctgcagcttaggtttctccccggaaggaaagcttgaggcgcacggttgcggtcggccggctgcgggggaccaggggccacacctgccgcggaggttacagtcggtaaagtagagcggcgacacgaacttctccacccgctccagcgtggtgcgccagtgcttcaaggccggcgcagccgccatcgccgggctctcgctcctctttccggaaggcccctggcgctaccgttccgctccacggcaggaaaccaaaggttccggcgtccagagggcgcctcccagtcccgggcagcttttcttggaacaccggcggctctcggaagcccagctgctgtctgaactttgagccgagttggaagctagaaactgtttttgaggctctcctatgttgtccgaaatagtgggccgcagggaaaatctcaaaataaaatgggaaatttgacgattagaactctcgaaagtctcaagacagagacttaggccattcggcaagacaggcgggagcctcagctgctgcagacccagcctcagaagcagcaaccgggagacctctggctctagctgtcggtgaacacggaaagtggtgtttgcttaacgtggagccagactacccggaataggtgttttcataccggacggagatcagggtgttagtgagcagggtggtagagctttacgcccaagttactacgacttactcgattacacgctttactgaatgtatattgctaactcttgcacatcaccagaaactctggagtttgaggtggcagaacagtcatggcattgacgatcccaatggaaaaatgtatttcaccatacaggactgtagagtcccgggaagccataataccagaaacagacctccagtttcattctcatccctagtactccactgacagctttattttttttctcctggggttgccaagagtctttgtctataaaatcattaggaacaaaaaaaaatacacaagattagccctgatattttaatggaaatactgaccaagtttacaacatttcaaatgcagatcacacggaaaggtgactaagtacagaataacaaatgtgatttaaaacaaagataacctgctgctgcatataatacaggttgggtttagagcttggagctcagatgtcagacagcaggaggaataaaaatgctacttgtgaaaacccaggctgtaggtaaaacttactcttttgttggttgcactggtgggttgggactttctcctgaactggccttgaaatcctatcctgacctgcaggcaagtgctctggacaaaacactgcaggggcagcaacagctggggctgaccctgatcacaccccaccaatttcccctatggttccaggtcaacatgacctttcttgagggaacacggggataggtgaattatttgagaaaacctcaagatctttcccctaaatcagtacacatgaccaccgccaagtcagacactgccccagctttgccctaaaatctcatcccacaaagctctttttggcaccctacactttggctcacagtctcttctccccagtacaaaaaaagcctaaaatcaggccagggtggctcacacctgtaatctcagcactttgcgaggccgaggtgggaggacagcttgaggccaggagtttgagaccaacctgggcagcatagcaagaccctgtctctacaaaaagttaaaaaattagctgggcgtggtggcatgcagctactcaggaggccgaggtgggaggactgcttgagcctgggaggtcaagcctgcagtgagctatgatcgtggcactgcactccagtgtgggtcataaagcgagacactgtctttaaacaataaaagcctaaaatcagagaggtctaccatgtgttttgaaaatccaggagccaaaaaattttgtttttctttttggtggtggtggtgatttttaactaaaaagcaaacataaaacacacagaacattgctggttacaactaagacttgcgtaatggttgctgaagaaaaatccaccagagtactgggaggggctcagttggtctttgttcagaaagtccaggttaaccacatagaaaaatcctaatcattcatgtttaaatgtctgctagtttaaatttatgtaattaaaaaaataggtatcccatttcaaattctctccctcccaactccatttataaggtataccacatgccttatgcacacttttttttcaaacactggtttggtatttaagttgctcacccccatccatcaccaatgtgaataagaaaaaatatatagaaatacaaactacatagcttgacaacttacccaaatataaaatattttcagattatttgaacaagggaaaaaaacacgtactaaaagacttaagtattctaagattttggaatattttgatttgggacaagtaacaagtattttaagcaaaatcctgtttctaccctggataaggaactgaagtcaaaatccctgcttcacagtattttctggtgaggacaagggacgtgggttgagagtttattccttaagtaagaaccaagctttatttatttacaaaaaaaaaaaaaaaaaagttgggggcaaaggggaagacaagttttacacaaaagtactacaatggtaactccctttggtaaaaagtgtaataaatgtcttgtacatctgttcataggtactaaatctgaagccacagtactatggtacacaagaagctagagcagttatgctagcacatcaaagcatatttcttttaataaaaaattgacagtatgtacattatgtacaaaaaaacaagttaaaattgtgtgtgtgtgtgcgtgtgtgtgtcagagagtaaagctggtggatggcactaaggtagactagtaaagaggcagatacaaaacagttccacgggagctaaaaaggacaactgatttgaactcgttgaggttgagaaccagaggagagaaaagggtaggcagcaagggaatcgtcaggaataaaatccacaagatgatcaatcccaaagccaaactgcaggtcccagataaaacctaatgggtgatcttagatgtgctcgagtgaccagaaaaaaaaaatcaaatccagcttttttttccttttgtggggaggggagaggagcagtgaccatgatagttccaatccatctgagtattaagtccttctccagtctgttttgtaaatgcatctccatccagtcaaagtgtgaacagcatccggttccctcattgaaagttaggccacaggagactccagtcttagctctgctggtgtgtgcaagcaaactgcatgtctttgcttgcatggacttccttcccctccagggcaggctatacccaaaaccctttgggaaaagttccagcttcagctttgtaaggtattcatgttcctaacaggtagcccacttggtgccaggctgcaccagccacacacaggtcaggtggccatgtcccagagaggcccagtgaggcttgaaaggcatcttccttgtttcttcagtgtgtgagtgcataggcccacacacacatccccacacacaccccaagttatctgctctggctttgcagttaaggggctttgaatactgtgccgtatttgacacgatacttgttaatgctcacaaaatgcagggtctctgtatcacaggtggtggtacagggcaccaggccctccagcccctcacccatgagccacttgctggtctctgctgccatttcacggggcacatgctccttggtccatttatctacccaggcctggaatctctgatgtagacgcttgcttacacgctcatgggactgcaaaacagaaaaaaaaaattttattaaatgaagcagaaccaaaaaagagcccttcaaatacaaagcctaattttcttctaaaggagcaaaggaaagatgtgggctcaagtcttagataccactgtttttttcttaaaagaaaaaaaaaaggattctctgtttaaagagaagttaaagaggtaagaacatagaacatgtgagggcatgaaaatccataaagcctccaaagaaatgcgaacacaggctctgggctgaaaaagctcgctgttctcaattttagcatgcgttagtataaccgagggaatgtgttaaaaaatacacatttctgaccaggtgcagtgactcatgcctgtaatcctagtactctgggaggctgaggcaggcagttcgcttgagctcaggagtttgagaccagcctgggcaacatggcaaaaccccatctctacaaaaatacaaataataactgggcgtggtggcacacacctgtagtcccagctacttggtaggctgaagtgggaggatcgcttgagccaggaggtggaggctgcagtgagccaagatcgcaccaccgcaccccagcctagatgacagagccaaaccctgtctccaaaaaaaaaaaaaaaaaaaacccaaaacccccaaaacccacatttccttggtttaccaatgtgcattttaaaccagcaatccagctgattctaatgtatcctgggtaggacccagtgagccattgatcacttctatcagcatggagatccacctctaagccagacagtgcaaagcaaagggcttaaaaccactctccctccactgtgttaccccaccctgggaagcagagtccaggcttggcagatgttctgcagggggttctgttcccaccaacacattcaataaaaatttattggtgtccacatgcaaggatactagaagagatacaaagacaaaactggtgttgcccagtgtcccaaataatgtgaatcagagacaggcagacacacaacacatagcaaaaaaaatgagccaggtgtggtggtgcacgcccgtaatcccagctactcgagaggctgagacaagagaatctcttgaacccgggaagtggaggatgcagtgagctgaaatcatgccactgcgcttccctcagtgccatgagagaagtagagcagactcttgaacaacacagctttgaacagcgcagggccactgataggcaagttttcttccacctctgccaaccctgagacagcaaaaacaacccctcccttcctcctccctcttcagcctactcaacaagatgagaataaggaccctttatgatgagccacaaccacttaatgaagagtaaatgtatcttctcttgcttatgacttaacattttcttttctctaacttactttattgtaagaatatacagtataggctgggcacagtggctcacgcctgtaatcccagcactttaggaggctgaaatgggtgggttgtttgaacccttgagtttgagaccagccctgggcaacgtaaggagaccccgtgtctattttcattaaaaaaaaaaaaaagaaagaaaaaaagaatgcagtatatataatacatacaacatacaaaatatgttgtttatcagtaagccttccagtcagtagtagactatcagtagttccattttgggggagtcaaaaattatacacagatttgactgtgcaggggccagtgccccaaaccccttgtcgttaaagggttaattatacattaaactgtctgctcaacatctcccatttgaaagttttgtagtcctttcaaacttaaaacagcacttcatctgtctcccaaacctcataaccctttcctattaacaggtgagcccctaaaatctccacttaagcaaaacaaaacaaaccaaaaaaccccaaaactaatcaggcaccatccttgatgtccttcttttgcttacccccacatttgatccaacaccatctcttgtcaattaaatatctaaataatatctacatctgggcgtggtggctcacgcctgtaatcccagtactttgggaggctgaggagggtggatcacttgaggtcaggttcgagaccagcctggccaacatggtgaaatcccatctctactaaaaatacaaaaaatcagccaggcatggtttgagacacagcgaaactctgtctcaaaaataaatgcataaagtctacaatgtaattcttgcaattccactgccaccctagtagtacgggtggcccccacatctcatttggacaagggcacccttttgagtggtctctgctcttccaactttatatatacccatctccactgtcctcacagaactccaagctatctttgtcaaatgtcccagtgcatctcaaacaaattacaaaccatggcctatcattagacaaagtgatgtggcctctgcctacccttctaacttcatgcaaccttgagccacaatggtgtttgtaatttcttgaatatgccaagtcctttcctcccagccttgtactagctcttttgtctagaaaacacccatcctctactcttcaccaggctaattccttgtcattattcaggcctcaagcatcacctcctttgagaagcctcctccagtgaaagcaaggcctgtatgctagttacccttgatcacttcacctgatttgtttccctggtagtgcatatcatcgcattacttcatctgctctacttcatggctgtagtcccagggcctggcataacaccctatacgcagctgcaccaggaaggtttcacaattgagacagaatgtaaagacaggtaggattcatacaagcaaaagatcagatactacttgagatgtaaatactgggagtaaattcaccaaaaaggtgccaccgggtatttacgtgctcttacaggctgaactgtattctccttaaaattcttatgttggccgggcatggtggctcacgcctgtaatgctagcactttgagaggctgtgtcaggtgagactctgtctcaaacaaacaaacaaaaaatcatacattgaagtcctagcccccagtacttccgaatgtgacctcatctggaggcagacacacacacacaggtaggaacaccatatgaagatgaaggcagggatctacaagcccaggaatgccaaagattgccagcaaagaaccagaagctaggagaggcctagaagagattgtccctcacagtcctcaaaaggaaccaacactgctgacacttgactttggacttctagtctccacaacttttgtcatttaagccacagtctgtggtactttgtcacagcatccttagcaaccaacatacgtacttcctcagttaagtctcagctccaagaacaggtttgcataaacaaagaaaaacaatcagaagactctgggcctcccctggtcctagctagggtgggagatgtgtacagaaatttcagttactggttctcacctgatgagcccggagcagggcggtcctccgatacatatagtcctctgatttgatcacatacaccatcttgtaggaattcagcttgaatctacactccagcttatccagactatccacattctccatggtcttcttgctgtttccttccttcccttccttttcctgctgctctcgaccacgttgacacttccggatccgccgtagattcctattgcagaaaagccccggaggatgagagctcgtccagatgcagattcccgtgacttccccaaagtgagttttctttattatatgcttgcatagtactcatcccaatttgttaaatacatacacaaatgttcagttgtttcactgcaaaaaaaatttcaactgcaaaggtacacagaataaaaagcagaaatcttcacccatcccctacttgacttagcagatgtagccagttaagagttttaatgagaaacttctaggcctctgtctgtaaatttacacatgtaattaccagctacagttctgctttgggatttgtttttaagacaaaataggatcatactatatattttgtcctcaacttttcacttactgtcatgaatattttttcatttcatgatagatttgtcttattctctttaactgctgcagaaaaatgtaccccaatttaccattccttaacagtttctttcaactgaggttcctcatctgaaccacataacaaaaatttatttgaatgactatttttaaaaattcccccagatgatataaactagtgccattctacatacacaagaaagaagataattcacatgaatggatgccctgaggggtggtaggcttgctaaatctcaacatccagtgaaaaaagttatcagctagacaattatattgtttctcataacttgctattaaaaacactgcttcaggttggccactgtggctcatgcctataatcccagcactttgggaggcaggtggattgcttgagctcaggagtttgagactagcctgggcaacatggcaaaaaccccttctctacaaaaaaaaaaaaaaaattaggcaggtgtggtgacgtgtgcctagagtctcagctacttgggaggctgaggtgggaagatcgtttgagcccagaaggcggaggttgcagaaagccaagatcccaccactgtactatagcctgggacacagagccagacactgtcttaaaaaaaaaaaaaaaaaaaaaaaaccaaccagcccaaaatattgcttcagtgagaatctttgtatacaagtatttctgtagacagcagttctttgtccaaagggtcccaggaccctttcaggagatctgtgagatcaaaactattctcataataatactaaaacattatttcccttttttgctgtgttgacatctgcactggcaccattaaagtaatggtgaacaaaaatgctggtggtggcgccaaactgtatttgcaatatcgaacaaattgttaccaaattccaatatcaatttgtacatcactgagcttttcatacagttgtcaaactctgttggtttatcttgtaccatcaatgaatccattttacttccatgattttgcaccttcatgcgactgcaattcaagtctttgaacttcacactgaccatacaatgacattaagtgaaaaaagccagtttcacttaagaatgtttctgatgggccagtcacagtggctcatgcttgtaatcccagcactctgggaggctgaggcaggcagatcacttgaggtcaggagtttgagactagcctggccaacatggggagacctcatctctaataaaagtacaaaaattagccgggagtggtggcgcgcacctgtaatcccagctattcgggagggtgagacaggagaatcacttgaacctggctggtggaggctgcagtaagccaagatcgcgccactgcactccagcttgggcaacagagtgagactctgcctcaaaaaaaaaaaaagaaaaaaaaagtttctgatgaagcagtaacattttctattaaatcccaacccctcaatttacatctttttaacatgctgtgtgataaaatgggaactacacataaagcacctttgtgtgctaaagtacaatggtattcttatagaaaagcacttgagcaattgcttgagttgtaagtggatcatcatttttacccgaaagaacaactgactaaatatagtcaatctcagccaagtatttggcagatgttttctcaaaaatgaacaagggagcctatcacttcaaggaaaacaatgttgccaatggtaagactggaattttcaagcaaaactatgaattttggtgaactggtatcagccaccctgagcttgacagcttcccaatacttaaagatgtgtttgatgacctagcgatagcgatattaaatcaatgtgatttcttttggagacactgtaaaatatatcaacatttagtaggtgtgtataacttattttccaaatagccaattgcgtaaagttacaaaatcatagaggaaaaaaagattcattcatgatacaaaataaatcaatggatttttacaactgcatgaaaagcccactgatgtataaattgatattccaactaacctttaagaaactatcactggggccgggtgcagtggctcacacccgtaatcacagcactttgggaggccgaggtgggaggatcacctgaggtcaggagttcaagaccagccagaccaacatggagaaatcccatctctactaaaaatacagaatcagccgggcgtggtggcacatgcctgtaatcccagctactcgggaggctgaggcaggagaatcacttaaacctgggaggcaggggttgcagtgagctgagatcacaccattgcactccagcctgggcaacaagagcgaaattccgtctcaaaaaagaaaaacaaaaacaaaaactatcactggtagttttgttgtcatatcaaagaatatccagttatctgaaggatctgaaaatattcctttttccagctacacatttgcgtgaggccagattttcttcacatatttcaatcaaacaacatacataatgcaacagattgaatatagaagcagacatgagaatccagctgttcttctggtaagccagacactaaacaaatttataaaatataagcaatgccactctattcactaatttttgttttgaattagcttttcattaaaaaatattatttaagaaaatataatagggatatatatatatatatatatattttatttttgaggcagagtctcactcggtcacccaggctggagtgccgtggtgcgatctccactcactgcaacctccgccttccggttcaagcaattctcctgcctcagcctcccgagtagcttggactacaggcgcctgccaccatgcccagctaattttctgtatttttagtagagacagggtttcactgtgttagccaggatggtctcgatctcctgatctcgtgatccacagcctcggcctcccaaagtgctggagttacaggcgtgagccactgcgcccagcccaatattgttatttttcaaatgaattaaagattgaaaacatttctttgtttttatttctaacttggtaaatattactagtataatccatataaacaaaagctttttggagtactcatgctctaagagtgtaaggggtctcaaggccaataagatgagccccttagctgtcagacaaatcattagaaactgaaattctggagggaagattccatacacttcaactaccctgccaccagaacgattatatcaatttccttttcctcacagtacataaatgtgcctccttcctcatatcatggtgagagacacatgatgacaggtttattgtagtatgttattagcatggagcctgttttgttgagaggaacctgacacagagcaactgctcaaatgtgttaaatgattcaatgaatggagaacccggcagggccctttttgctggtatctcttttcccatgttctcattaggactcaataagtctaataacactgggatgatactttcttggaaacctaagacataagatttcaattcaaaacttttaggaaggaagaaagccattctacccattttatacttcttaaactgttttcatatacttggaggatcagtatcacaatctgcctatacacagagggaacatttttaaaattctgtgcagaaaagagttaatgtagcaggcctaagattgctattctttgaaaagcctgcttataaaagttggcccttggctgggggctgggatcttggattttgggcaatgttctaccattccttaactcatataagtgtctcactgtacctaaactatttgtacaaactctatagcttatgctgaaaatgtgctttctttctgagagtttgggattttggtacatgctaggcatacagtgcctagatgactacatctcaataaaaatcctggcacagagtctctaatgagctgccctggtagacagcattttgcatgtgttgtcacattcattgttggaagaattaagagtgtcctgtgtgactccactgggagaggattctaggaagcttgagcctggcttcctccagctttgccacaggcaccttttcgctttgctgattctgctttgcatcttctcgctgtactaaatcagtctgactatatgcagagtcctgtgagtcctcttccatcgaaccatggagactctgacacacattcccatccaaagtacggaggttattgttgattctctacaactctcacctcccagatgctttgacacatgctccaggtaagctcatgttgtgacagccatataaaaccttgaattagcatccccagcagatagaacaaatgaataaaatatgtgaaggccaagaacgtgaaagtcatttaactctccattcctcaatcatgcacagtatggactgctgacagatgacatggctcactcacctggggagaaatactggtttctgtgctagatgttcacgaagctcaggcgaggtagtatctgaattcatgtatcgctccacgtagtctgaccagcgctaagatggcaaacacaaaatacaggtggaaggaaatcacaaaaacagctcctaatgcattgggcactctagtaaattctatgattacaatgccccgaattcataaatttcaagatcaaaaaagtccctttctataaagacatgattgttagtaggtattggaacacggattaaaaattctgttagccagcaatactgctaagtttctgaggtgctaaggttatgagaagtcataaacaggtagaagctggctcactgacaagtttcatttccccacagagcattttgttaaagaacaaaatttatagtggcaaatgtgtgaaagtttccttcacattacaatctagatttctgacatcgcttaaaaaaaaaaaaaaaaaaaaagatctgccaacaagccaacattcccaccaaaacaagtcatcccacacgaccccccccaacatcatacatatggcctgcatctcctgtgtacattatctgccataaccaactatgataatcacacctgtctattcaggggttgaaaactctggactttatcagtccaataaaaagtaaacatgacacaaagaatcaagatgacatgagaaagacctcatttgttgttttttatactttaggaaaaaacaggaaagctgccaaccataagacttccttagaggagatagctttactaagtgcaagatgaggttaacatctataaccaggcagcccgtctcttcagctgaagacatggctggattgacttgtactttaagcatccaggtcctgacccttaaacaggcctgaggtgccttggccttttggcagacagggtcactggacagactctcaaggcacgccagctctgcttggcacctggggtctgtgatgtacttgctcatacctctgcttccacagggtcatccgaattctcctcttctgtgtccagaagctcaatagtcagctggacctggccttggctctgaataaacataagctgcaaataagaaacctaagcgtaaacaaaagaccgtctctgtagctgtaatctatcttctcaaggaatgagaggtgcagaggcaataaacttagtaaactttgctccaactgaagagatgaggaagatactagatcttgggtggccagtgataaaggcaaaagtctacacttactacaagtaaaatgaaatatattaaagcaaaaggtactatttcatgtttcaaacttctagaattcgctaaaataataatcaatgtcagtaagaatgttttacaaaacaaatattttgtcagaaagaaatatggcacatgtagccagaaccacaaaatgtcaatgctctgtccattggtaatcccacttctaggacgtaatagaggaggtaactatcagaatcacatggagaaggtcagagcctggaaggaaacctgagaattttttatttcaaccttcttcattttacacagagacaaaactgaaattcagaagagttctggtttctcaaggcacaccactaatcaatatacatgcagagccagaagctagatctagctcagtgttcttttaaagctttaaaaattgctctctgctagtaaagcttacaacctgacaataacataatatatacacacacaaatacagttatttccaaaatagatttcggggtgggggcagaccctgcattttcacaatttataatttaagaattgcaaaatctgtctccagtattcataacaggatgtcattaaccagtccccatagtgggttggacgtctaggatgtttccaactatttgcttttataattatccattataatggtgaaaaattggaaacaacctaaatgtccaccaatacaggcattaattctctaaaaagtgaatatcaaatagccataaaaaagacaataaagacccagaagtgttgttaattgagcaaaaatacattaaagaccatttccggtcagatgcagtggctcacacctgtaatcccagcactttgggaggctaaggcgggcagatcacttgaggccaggagtttgagacaagcctgcccaacatggtgaaaccacatctctactaaaaatacaaaaattagaccgggtgcagtggctcatgcctgtaatcccagcactttgggaggccaaggagggcagatcacctgagctcaggagttcaagaccagcctgaccaacatggtgaaaccctgtctctactaaacacacacacccacacaagctggccatggtggcacgtgtctgtaatcccagctactcaggaggccgaggcaggagaactgcttgaacccaggaggcggaggttgcagtgagctgaaatagcaccactgcactccaagcctggacaacctggacaacctggacaacaagagtgagcctccatctcgggaaaaaaaaaaaaattagctggacatagtggtacatgactgtaatcccagctactagggtggctgacgtgtgagaatcacttgaactcaggaggcagaggttgcagtgaaccaagattgcgccactgcactccagcctgggcaacagtgtgtgtccctgtcttaaaaaaaaaaaaaaaaaagttaaagaccattttgtccagtataaactctttcaaaatatatactcaagcatagagaagtttagaatcatagagatgtcatcaatgataatttcaggaaagaattctaaggtgactttttttggttatctgcattttattttcatttttttgggacagagtcttgctctgtcacccaggctggggtgcagtgacgcgatcaggcctcactgcagcctcgacctcccaggctcaagcaatcctttttttttttttttgagacggagtctcgctctgtctcccaggctggagtgcagtggcgcgatctcagcttactgcaagctccgcctcccgggttcacgccattctcctgactcagcctccagagtagctgggactacagacgcccaccactacgcccggctaattttttgtatttttagtagagacgggggcaatccttctacctcattctcctgagtagctgagactacaggtgcacgctaccatgccgggctaatttttgtattcttgtatttcttgcagagatggggttttgccatgttgcccaagctggtctcaagtgatccgcccacctcggcctcccagtgtgctgagattacaagtgtgagccatgtgtgctgggcctatgttttcttttctataatgatcatgaccatggatttcatgtaccaacatttttctaacaataatatttacaaagcatactatgaaaaatgttcagagaaaaagaatacaaaattgtaaaaatcatatataactagttttttttttttctttaaaggcaggaaagaaacaaagtagattgtccaggaagacaattacttccactttgtagttctctggtgaactcattaaaaggtccaggagtagaatcacaggtcaaagtaccccggctttaacttctggttcagagaatcctaacaactgacattgtcaccagcaaggtcttcgactacctgaccaactctcaccttaaagcaattctcatctgacattagctgctcagctttccgctgatacgttgactccaggaggctccttgagttctgtgtgttcagctggcctccggtggccccattattattttctgccaggtaaaggtcagtcacctgcacacagatctcatcactcacgatatgctgcagctggaagcaaacaaaggcaagcttttagtgaacacagaaaacatttctccattatacagtcaacgttcctttgatgtagtcattcaactccaaaaaggtttttctttttttgggggggtgggggggtgctggcaattttagaaaattaatcacacaaaccactgtatcattttcttggagaataatcaagccaggattttcaaccatatcagtggtccatggtaaaactttcctatctatttaaaataagaaccatagagaactcaggataatcgtactatttaaaattctaagcatctttaaataattttctataggtcatatctttattgcattttaaaatcatttacaattggctctcatacatattctttctcatttgatcttcacaactgccctgggaaggcaagctagacagagagttggggccagttaggagacaaatttacacaatgcatcagaaaggtggctcacgcctgtaatcccagcactttgggaggccgaggtgggccaatcacctgaggtcaggtgttcaaaaccagcctggctaacatggcgaaaccccatctctactaaaaatacacaaatagccgggcgtggtggcaggagcctgtaatcccagctacttgggaggctggggcaggagaatcgcttgaacctgggagatggaggttgcagtgagccgagactgcaccactgcaaagctcaccgtgagctggggtgaggaagggagccttggagaatcatgaatgcagtatctatgtctatattcccaggccaactacaaagcctgaaactcattaagtatttaagaaatagctgctgaattattgcccaggggtgctcagctgaagaaggagggttgggactaaaagtcaaggttcctgactcctagcccaatacttttccaaacacatcacctatttttctgtatctgatagaaagtatagggcttaagttgtacataaagttaactcactttccatacaggccaatcatgattgactatcagtagcttttgtgacaatcttaggaaactaatgactagaaagttgaacgtttcagagttcccattctcatgtcatgctatttctattttgaaataaaaatccttccaaatgaaactttatcatcaaaatgacagaagtgaaaaatagatacaagaagaaagcaaaacgttaatttcaatattgatttgtctgtttaaaaaactttaagatgatcataaccaccaagccattctatttttaggaagacacattctttttaagtgttaggaaccatgataactatttattcttaagtcctaaatgaccagtatgtgtattagtagataactggacacagtgaaaggtcagaacggtgactgagtgtggcagaaagggcagtatctccagcaactacagatggataaataaatcacaatgagtccagataaaggattctgatacaaccattaaaataatgcttatgagtacctgatatcatgaggaagattaagatacagtgttttaggagaaaaaagaaaaggtggaaaaaaacagatggaaagcatgacttcaatcatacatacagatgcttccactttctactttctttttgagacagagtctcgctctgtcgcccaggctggagtgcagtggcatcgtgatcttggctcagtgcagcctcaacttcctgggctcaagcaaccctcccatacctcagcctcttaagtagctgggtctacaggcatgtgccaccacgcccagctaacttttttgtattttcagaagagacggggttttgccatgttgcccagtctgatctcaaacttctgagctcaagtgatccacccgccttggcctcccaaactgctgggattacaggcgtgagccaccgcctctactttatactttcttgttgaagtagactgtattactgattccccacccatactctctttttggatatctggcccctcctcgagtcttcagaaaagacagcactacaaatccagagacagctacggaactcccacccccactgctaagcagatcagattctctatcttgctaattggagatgacagagagggtgttcaatagattttttgaggaggagcatctgtatggaaaggtctagtaacactgggaccaggggtactgggagggcaagccaaagcctcagaggctggaggagcctggagcacatgccgtatgttcatctgcagagcaaagcacaagcatggagcagaagtccagagtgaaggcatgcaggagagaaaaatcacctcccagcccaatccttccatggtgtggtcctattttgagttctgtacttggatgtctgtgaggttgcctattgtattcttaatacaaatccctcttaagccagcctacaataggtaagataaatgtaatggcttcacttggctggaatgcagtggtgcaatcacggctcactgcagcctcaacttcctgggttcagatgatcctcccaccttagcctcctgagtagctgggactacaggcatgtgccaccatgcccagctaattttttgtatttttaatacaaatagtgtttccccatgttgcccaggctggtctccaactcctggactcaatatatctgcccgccttggactcccaaagtgctggtattagaggcatgagccaccatgaccagccttgactttgaaatatatgttgtacattcagtcagcagtggaatctgagggaacaccaaatatgaggagaatgagagaagagatacctccagttaaaggagttgagaagcttgaaaatgttttaaaaagtcactgtaggctgggcacagtggctcatgcccgtaatcgcagcgctttgggaggctgaagtaggtgaattgcttgagcccataagtttgaggccagcctggacaacatggcaaaactccatctctacaaaaaatacaataaattagccggtgtggtggcccctttggtcccagctacttgggaggctgaggtaggaggtcaaggctacagtgagctgatcacaccactgcactccagcctgggcaatagagtgagaccctgggttggaaaaaaaaaaaaaaaaaaagtcactgttttggggttttctggatgaaacctgtttccattaaaaaaaaaaaaaaaaagcggggggtgggtggagatagtatttattactgattcaaaatcataaccagatacagtaaataattgtaactattgtttcgaaaaccaacctcagaattattaaaagttagttttattggattttttttttaagctgtgctggtggtatgaaagacttcgttcctagctgaagcagcagcaagcctgtaatcagcaacataagcacagggtaactggagtctgtattttatataaatttcagggaagttaaggaagattagtctgaaaaagtatgactatgggtgactatgtatccatctaatgatttctgccagttaccatccagacctcttatgggaaggcctaacaacttcttcaacttattggaaacaactatctgacaactttcccccagatgttaaggttcatttatatgaagggctcttcctcaatcctgtgtagatactgtgggaggagtacagaggcatgcacccttccaaaaccaaggcaaaagcatgggtactttgcaaagaattcaatattttagcccaagagaacattaagcaacaagctctttccttctacagtggcagtgtggattctagaattagaaattgctttttacaagttttcacttaagtacttcaccgcctttctgctgagctattctatggaagagggctgtaggtagccacggtacccaggtggaacagcatgatcctaaagccctacttccacaaggaatcgcagtggcccatggccacgtggttcaaccagccagcccagaagatctgcagatgcaagcaaaagtataccacattgacctgcaccctgcatctggacccatctgacccatggtaagctgccccacagtgaggtaccacaccaaagtacaagctggcaggggcttcagcttagaagagttaagggtgaccagcatccacaagagggtggcattagtacaccatgtccctgtgggccaatgttcagcacctgaaggagttaagactccaagctcaacctcttctccaggaagctcttagcccccaagaagggagacagttctgaaaaactcaaatcagccacccagctgacaggaccaataatgcccatatagtacgtctataagaaggagaaagctggaatcatcactaagaactttaaggtatttgccagtcttcacacagcccacatcaattttcagctctttggcatatgggcaaaaagggccaagggagccacagaacaggatgctgaaaaggaaaaatgaagccctgctggggacttgcagtcaatcagcagtagagctgggtctccagaaaaagaaaaaagcagttaaccaacaatctctctgggagttcagaactcaagtccaagaagtagaaatgtgactatctgttacaagctattttttatatcattgttgtaaagaacaacatgtttacaagttcccagggtgccacaggaagaacacacaaaaccaaccagaaacctaacttagagggaaccgcagatgagtgaggtgggcagagtattataaaagatgttatgtgaaccctttcttataaaaagaatttcaaatattaaacaatgcaagtacataagagttaccaacaccttgaccaggcgcagtggctcgtgtctataatcccagcgctttaagaggccaagacaggaggatcacttgagaccagaagttcaagaccagcctgggcaaaacagtgacaccctgtctctatttaaggaaaaaaaaaaaaaacttaccaacacctatggaagacgcaatgttccacactgtgtgcttacccatggcagacaaggtaagagatagacaagttgtgcaggaagctggggtcaggaccactgcactctacaggtggccagcaagaaaggatatggggtaggcaggctcatacactgcaactttgttaacatgagaaatcaggcatcacattaacctcccctcctctcttcagaaccctacgttcataaacactgttatatgaaaaagttgcctttccttttccttgcgtggcccatctctaggtaaggatttcttcccttactcaccctagcctcctccatgccctcacctgtctgacaatgctctggatcagtttgtccatggtaaaggcaatgtaggcatgaatggtgaacatctctctcagtgaatcttcatactgtgatgagtctatgttgccatccagcaggctccgcaccatgtccaggaaagctgggtaataatcttctacatcaacatccactgtgggagagatgggattggtgaggccttaccttgctaagaaaagactagggatagagtacagggcaaatcccacagctggcctaaatggcatttgaaagtatgaacactaggtattcaaaatatactcactcattccaatgtaaacagagatgaattccgacaggtgactacaatcaccagcactatcagagtgactctgcaactttaacagtggcttctaatattctgactaccatgctagaaagatacttctttatggtactgctgggccactttcagagaggaaaatatcctagggaagccagtccttcaaagagctgttggctcccctgctgagagaggaacctactctcccagcctgcacaagagcattcctcacatgggtcacttgctcataaagctatttcaatgaagcataaagtacagatgaggaaaggcagacacagccatactccagcactgggaaacctcttgggaacacaaaaataggagtgcaaattaaatcctttatgaataatgaagtaatctgcatttgtcaaagtccttttgtttaaaaatggattcgctacgttgtatttcacaaattgcattaaatcatctgtagttgctgcacatgaatcatttcaatcactagctagaataaatctcatcagttgttaaagacatttggcaactagcagagggcacaaggagtattaaagagtgctgcctttagcttactaaagacccatttatataaagttcaaaaatagacaaatctaatctctagtgttagaaatcaacaaagtggaaaaaggactggttatcagagtactggttatgtttcgtttcttgaacataggtacgtctagtctgtaaaaattcactgagctgcacaattctgatttgtatacttttctatatatacatgccgtaccttatatgtatttttttgtagagatggggtctcacttattaaccaggctggtctcaaactcctggcctcaagtgatcctcccacatcggcctcccaaagtgctgggattacaggtgtaagccactgcacccggcctatacattgcacttcaacaaaaagttgactaaaatgaaaaaagttacaaaacgaactatttgtcactgactaattggttacttgctagttgtgtttgtgctggagaaaaaaggctaggagcaaaaccaagttgtctccatttatctgaagtctgacgaattcattaaaaaacaggcaaaacaggacaaatactgtttaaaagaggcaactggcttgagtttcatcacagactatcacattctttagctccatagaataggtataggctatagactccaaaatataccactgctatgaaaactgcttttatgccagaataaagttttgagtccaaaccacagatttgtccaaacaagctgtggtaagtgtgagggttggcattatcagacaagacaacattatgtaagcctcaaaccaggttaagtcagtggccaagccaggaataggccatttaatttctaatttctacccaagtagatggaatcaccacaatgagatctaaaatttatctctttcgagctaggactagtctagataaaagctttcagaattatttttcagtgtcattagctcctcaacagatagaaagctagggccatatctgggcttcctacatcagcaacacataaaaaaaaaaaaaaagaagaagaagatacactcctcaggttggctatttccttaagagcccagaagaaatgcttcatgaaaaagcttttggctcacagctcaagtacctaatttatgacgtgaactggaagcaggcagcacaaaattacataaagcacatgacagcgtcctgaaccctcacttactttccttttcctgagttctacatctttatccctgtcctgcctgttctccatgtctcatatcaccttttgagttccagtctcctttccataaactatttctacatattaagaatgagccataaaccccactggttaaacagaagtcctgctcaaaaatatgagaaaattctgttttaagcactaggaatttatgttctgtcatggattgaaattggctgtgacagtttagtctctatctgtactttgaaacagatggcagtaacccagaaatctgccatttgagaaattaactgtgatacccccttcccaggtgcgtccacagtaccaaccactgaccaagtgtccatgatctaagccctgcataggatactttgcacaaagcaacaccacaagcaactagagcctccatttttcagataaacaggttcagagagtttaactacacagactctaatgcctgtgctctattaataaaagaagcagtcccaagtctaggtggctctaaggtcctcaacctcacacatcctctgtaaatcagaggtctcggcactcactaggttctttgagacgtagctgaatggcagggctgtcactcttgtctcgctttatgcccagcacttcccgttcccattctctctctcggttttcttcttcaatttgccgttcggcttgggaacaaatccgtagcagcctcaggcagagaatctggtgcagtcgcataaaaatataccagttgttgttgacatagaagaggttgtatacttcatccattcctcttaatttttgagctgctgtgttactaaacagtaacttggacttagggggactgcccccaacaccattgtgcttcttaactgcccctgtggcttcatctacatccatctcttcttcttcctcttcctccacatctgagagatcacctctttgggcaaagagcaaatctggaataaaatgatgcatgatttgttttatcttatatttgtcctccttctgaatgcctgtctgcctcttcacatggtggataatcagagcagcagcatcttccagtatttgtttgtcttcatacgcaagtgagaggtgtgggccaacaggtacaccagcattctcctccgtagcctgctcttgcctctgatgggacagagacacaaaagtattctgtgagatgtctacagcgacaacatgtctacaagaccacatcagccatacatcccattatcaaccacagtgtctatatttttctaatcaaaaacttaggacctgggactgggagcggtggctcacgtctataatcccagcactttggtaggccgaggagggtgatcacttgaggtcaggagtttgagatcagcctggccaatatggtgaaaccccgcctctactaaaaataacaaaattagctgaacatggtggtaggtgcctgtaatcccagcccttgggatgctaaggcaagagaatcacttgaacccgtgaggcaaaggttgcagtgagccgagatcgtactactgcactccagcctgggcaacagagtgagactctgtctcaaaacaaaacttaggacctgactataacaataatttttgtccctcttccagaaacaaataggtaatgacagagacgtggtttgatgtcaaaatacaggtaccttctacacactgatgacttacagggagagtaggacagaattggaaccatctttctttcttttttttggcagggtcttgctctgtcacccaggctggagtgcagtggagcaatcttggctcattgtaacctccgtctcccgggttcaagccattcttatgcttcagcctcctgagtagctgggattaagaagtgcaccaccatgccaggctaattttgtatttttagtagagatgaggtttcaccatgtcggccaggctggtttcgaacttctggcctcaagttatctgtccacctcagcctcccaaagtgatgggattacaggcgtgagccactgtgcccagtgggactatctttcaaaattctggattagtatctatataaaggatatgatatgagatctgtgatttactttacttctggggtgggggtatggagggtgacaaagtaacatcagcaaaatatggaggattaagtttatttattttattgattttgagacggaatcttgctctgtcacccagactggagtgcagtggcatgttctcagctcactgcatcctccacctcccaggttcaagccattctcccacctcattctgccgagtagctgggactacaggtgcacaccaccacgcctggctaatttttgtatttttagtaaagacggggtttcgtcatgttggctgggctggtctctaactcctgacctcaggtgatctgcccgcctcagcctcccaaagtgctgggattacaggcatgagccactgtgcccggcctgattaagttcacataagagctcattttactatttttaaagttcaggatcaccccactccaggaattcccaattgcactgcatttatgtttctatccatctcctaaaactgagcccacggaaaccaggatttattgcttattcatctctgatcctagctcctagtactatttatagtcctggtaggcatgctgaataagcaaggattacaaagagtttggtggtcaatgacaaattttgaagctgtaagtaaggagagatgggactatatggatacaaggtattattgtttgaaggaaacaggtagtcggagaagtggaaaatggaggcaggaggtataagttgaaaccaggacagtaaactaggaaactagtcaaacagcttaggtataaaggtatagtttagatttaaaatggtagaatgaggaatagaaaaggctatgacagctatcaagcaagaatcaacaggtcttagagagtctcacctgcatttaacaaaggtaatttccagaaatcaaagctgtgctaaatatagactagagtcctctcacagatgcagaaaccccccgctcacctcatcatagatactctcaatctcattgagtaagctcttagacctcaggaccttggtgtcattctgtttaaagttgatcccctggtggtccagagacttcaagtagtatttctcattttgttctcgccatactttgttaaagcctctctgagcttctcgccattcttcctctttcatcttcaacctagtgaagcgggaagggatggaaacaacacatgggaattcagagggtttagaagaaagaaatttgccaggcttactttagttaaagaaaggtgcaaagctatattaggtctctcaaaattactggcaacttgggatgctatcaaaccagtcttgaactctgtttcatgagggaattactcatccaagacttactttgaggaaatgatttatctcaaagtcaaataatttacctagaatggttacttaaaaacagcattccagggaatatctttcaggtataagtattccttgaaaaaaagagttcttgtttctttgctataggactttgcaaaacgttcacaatgctaatagaaacacagaagtccaagacaagagaacttgcacagttatgttcctctggatacagtcaggaaagttctgatcagaactgattctaataacccagaagagaacagactaagacaaaaaaaagcactaaaactgaagaataacctgtatctcaaaagccagaagttaaatgctacaggcaagaagaagaaaccatcaatctgtgccagctcttgaggggaagatgagggagaagaaaccatcaatctgtgccagctcttgaggggaagatgagggaggacaaatcaaatctgggtatttgtgaactgtgcagcaaataagaattaatttttaccagatgatactgagagagaaccaagctcctaacaaaggattcacagtgtggtcaataatgacatggggctgggtgtggtgtggcttgtgcctgtaatgccagcactttggggaggccaaggcaggaggattgcttgagcccaggagttagaggccagcctgggaaatatagcaagacctcatctctattaaaaaaaataaaataaaaattagctgggtgtggtggcacattcctgtagtcccagctattcgggaggctgaggtgggaggatcacctgagcctgggaagttgaggctgcagtgagctgtgttcacactactgcactccagcctgggtgaaagagtgagatcttgtctcaaaacaaaacaaaacaaaaacaaacaaaccacaaagatgttaacaacagttagtcctgagtgtggcaggaacatgggtggtaattatcttcttttcttttctgtattttaaaatactcccccaaacatacacacagagccttccaccatgaacttacaagatttgttctctaatgttggttacacaggacccccaaaagaagttccattctgcacctgaattccaacaaccagggttggggagaaagagaggtctcatgggacaaccaggttgaaaatgagagccttatttaatgagacactgaaccggtagtgaagtacactaaagcactaagggcacatttgctcatgtaccttttaaggacaattggaacagcaatggagggattctttctcagaccatcaatgatgtcagctgctttatcagcatatatcctctggagtgcttttctatggatgacttctgatgtgcccccaagggtgttgtccaagcgaaatttggcttgttcttcagcagacaagcgggaaagcttcttctgtattgcttccagaacccggattgttgccagattggtctctaaaactacatcaagctgaagaggaagacaaagaagggtatgctcaggacccaaatcaaaatagaatagagtagtgtttagaagaataaggtagggagtcaaactccttggatttgaatcctggttctgccctactagctacataagactgtttctttatcagcaaaatagggataacagcacctattactctcacaaccctgtgtctggattaaatgatacaatccacataaagtatttagcacaatacctggcacataagaaccacaggatgaagttggataaatggtagttattaccaccaccgtcgctgctgccgccaccaccaccgtgtgctttgcttaggactactgattttagaccagaggaaccaaacaggagatgactttactgaaacgtttccctgaactttcctgaattgctaagatccattatgaacaaacaataacaatcaaaacaatcccaaaagaccgctttgtcttgagagttttttggtttaacttgaaatatttaaatatattcaaatacttaaatattcaatagccttgttccacatccagtaataataagagcagtgactatcataacttaaggagttcactgttgtagctgcgggtaaccatttaaattcttattggactcctggcaacctttgagtctactttttccctagcttaaaataaggttctctaaatgagaaacagaaaatgaagtaaatgagcagtctcaacggtctacaaccaactgtttgcagaagtgttccctaagttttcttgttttgggaatgtggtagtcatttggtcaatatttctggcccctcttgctctccaattatgaacaaaaaatggactaaacttcctggctcccttatgattggatagggccatgtaactagttttgaccaatgagttgttatgagatgagtagaagtaatgtttattacttctaggctgcagcatttaaaggtgtgagatcattccaagctctcttttcctcctagtgactagcaacattcataatggcagcaatcccttggcctgaatccccaagtaattctgatatgccaaatcccctgctaaacatcaatgtacatgtagaatgattagaaattaaacccattggttttacaagtcactcagatgtgggagttgtctgtactgaggcattactaacctatcttgattggtaacgcacattccttcaaactagctcatcccaccaaatcttaaacacatgcacaccccacttctttcatgtttgcccttgtagtcacaaatgggaaatgaagttgcctctcatttggaggcataccagctgagagaggataggaacactctgtcaaaaacaaatgccaagctctgctaaactcatcagttaaccttactaaacgtaagtaacaaagaaatgccttctttagcttgataacactccctatggaagttaacatctgtcttgatttagctttctgcaaataggtgcaactccttataaatgctggggcaaagatggccaaccacctgccagtggccaggcagcatgtggttctcaattaaaaacacaccagaaactgctgaaccaagtgtgaggcgggaaaactggcaaagagctaaaagagtaccaaaacaaacaaacaaacaaacaaaaaccagcaagatacctatccacacaagtaagcacagccagtcaatttaatgtaacagatacactaaataggatacgtatcattttacatctttagacaaaccagacttccctttttaaaaatgataatgtaaaccagacatataaacacactgaggattgagcccactttcagtagtccctctcctgatataggtggtatggggccttctaccacctcatttattcactccactcttcccttcctaattacttcaaaataaagctcctgggacaggcgcagtggctcacacttgtaatcccagcactttggaaggccaagacgggtgggtcacttgaggtcaggagttcaagaccagcctggtcaacatggtgaaacccatctccactaaaaatacaaaaaaaattagccgggtgtagcggcatacacctgtagtcccagatacttgggaggctgaggcaggataatggcttaaactcgtgaggcagaggttgcagtgagccgagatcacaccactgcactccagcctggttgacagagcaatactctgtctttaaaaagaaaggggtccctaatttagccttctttcaaaaggagccaatcaggccaggtatggtggctcatgtgtgtaatcccagcactttgggaggccagggtgggatgatcgcttggacccaagagtttgagaccagcctgggtaatgtagtaaaacactgtttctataaaaaacaaaaaattagccacagggggtaggaggcaaggggagggagagcattaggacaaatacctaatgcatgtggggcttaaaacctagatgatgagttgataggtgcagcaaaccaccaaagcacatgtatatctatgtaacaaacctgcacgttctgcacatgtatcccagaatttaaagtttaaaaaaaaaaaaaaaaaatttacccaggcatggtagcacatgcctgtagtcccagccactcggtggcgggtaggggtgggggtctgaggtgggaggatcacacttgagtctggaaggttgaggctgcaatgaactgtgattgtgccactgcactgcagcctgggcaatagaatgagaccctgtctcaaaaaaacaaaacaaaacaaagcaatcagctgggcgcagtggctcacacctgtaatcctagcactttgggaggccgagacgggtggatcacgaggtcaggagatcgagaccatcctggctaacacggtgaaactccgtctctaataaaaatacaaaaaattagccggacgtgttggcgggcgcctgtagtcccagctactcgggaggctgaggcaggagaatggcatgaacctgggaggcagagcttgcagtgagccgagattgcgccactgcactccagcctgggagacagagcgagactccgtctcaaaaaaacaaaacaaaacaaacaaacaaacaaacaaaaaacaacaaagcaatcaataccagaaacatgaaagaaaaatgccagttctcagagctggtttgctaaccatggcaagatacttgctaagggtaacaatacacacagatcttaaataatttaaaaacagcttcaagaaagtactataaaccttaggatactgattttcttcaccatgcaaaacataataatcttaaaatgccatgcaaaatcaaaagaactattatttagtcatcaatggacaatttcagttaaaagggctaaagtggcctagataagtcacatttgccataaagcatgtactaatatatacatttgaccaatgcataaagcatggaaagtaccacaacaagcacttaccatagaagaatgtgagcctttggctcttccatcttaataaccctcagagacaggtactgatagtctcactgagcatctcccatttcccccaacttcaaatgccaaacaagcttgtacctcaaagcgttcatcttcacaacgataaatatgttcttcatattgagtcttcttggaactcacaaaggtagagtcctcagaccacgaagggaaggaaacccaggtatcatttaaaacctttgggtagaagaagagagactgaaacaaaagcctaaaaaagctttctggtgattaagcattctgaatgaaaagacaaaactctagcagagaaataggcaactaatattacttcacaaatttcacctttagcaagtttacaaaaagctattagtaagaaaagggtgctgaatataagcggaaatataattccagtgctttgggaggacgaagcaggaagatcacctgagcccaggaggagtgacccaatctttacaaaactaaaaacttttatttttatatttttagctgggtgtgaaggcatgtgtaagtcccaggtacttgggaggatcatttgagcccaggaggttgaggcactatgagccgtgatcacatcactgcactacagcctgggtgacaaaacgaaaccctgtctcaaaaacaaacaaaaaagtagaaaacattttctttttaaaaaggattaaaagggttcttaatttcatcattcatataaattctcaatccttggtaccaccactcccttctggaaaaagctgaggacccagggctgatctttgctagggaaggccttacctctttacagagaggagtccgtcctgtacacttgggctgctggtaactctttggtaaggctcgatagctggagcccaatcgtttacaagaagcataatctatctccatagcaatgccctctgtggctcgctcctttggataagtttccagatgtacagactccttatagcccagaaagtttttaaaccaattaaacaactcagggaatttcctgaagaatcaaaccaaaaagtgacaagcaattaggggcaggatgcagttatcctgaggtatgactactaccatctggttttggatcagaaatctgctaccagggatgaattatttcctgcctaagaagaactgcttctgagcatttggtttcccctttttctaataaaatactctcagatcagttaaagtggtgatcaaagagttgtaccgaaaccaggcaaaataacaagccattcttttgatcaagaatattgctttaatgttcacataattcttaggttgtcaaatatagtaaagattccagactcggtgtagtggctcatgcctgtaatcccagcactttgggaggccgaggcaggtggattacctgaggtcaggagttctggaccagcctggccaacatggtaaaacaccgtctctactaaaaaacataacaaaaattagccgggcgtgtggtgacaggcacctgtaatcccagctacttggggggccgaggcaggagaatcacctgaacccaggaggcggaggttgcagtgagccaagatcatgccatcacactccagcctggggaacaagagtgagacttcatctcaaaaaaaaaataataataataatttttaaaaaaattccagaactctgggagagatttttcttgataaacatccagcactggttagaagatcaggagaccactagtcttggccattagtcgataaatacttaatgccctctctattttctcatctctagagctggactagaagacttctcaggactcttctggcactaacatttgagtcaactgatgtatctcaagtaaattaactttgcctatcatatactctcacaaatcaaacattacctggtctccatatcatgcatcagggctaagcccctcacttcacttaccccaggaaaggagagactagttgcacaagctcagcacgagagatcacctcctggttaaaaataacaagacagcgtaggaaattttcgtaggcttctgcactccgaagagcctttcggaccttatggagacaacgggaagaaaaacagtttttgtttttcttaaagtggggaactgaaaagggcctcgctctgtcgcccaggaggaggcgcagttgtgtaatctcagctcactgcagcctcccatcctcagcctcccaagtagctgggactacaggtgtgagccaccatgcctggctaatttctaaattttttgcagagacgaggtcatatattgcccagctgccctgccattagtttttaaaaactggggaaatttgtggctgggcgtggtggctcatgcctataatcccagcactttgggaggccaaggtgggtggatcactggaggccaggacttcgagcccagactggccaacatgctgaaaccccgtctctactaaaaatacaaaaattagccaggcatggtggcacacgcctgtaattccagctacttgggtggctgagtgaaacataagattatcacttgaaccctggaggcagacgttgcagtgagctgggataatgccactgtactccagcctgggtgacagagcaagactctgtctcataagtaaaaaaataaaataaaaacggggaaatttaaactgatatttgatgacactaaggaatcaacgttagtgtttttagatgtgataatgattatgtttgcaataaggagtttttttgttttgttttgttttttaaacgcagtccagcactgttgcccaggctgaagtgcagtggtgcgatctcagctcactgcaacctctgcctcctgggttcaagcaattctcctgcctcagcctcccaagtaggtgggattacaggcatgtgctactacacccggataatttttctatttttagtagagacgaggtttcaccgtattggctaggctagtctcaaactcctgaccacaagtgatccacccgccttggcctcccaaagtgctgggattacaggcgtttgagccactgtacccagccacaaaaaggagtcatttttaaaagaaacttactaaaatatgtatggatgaaataaggtatctgcgatttgtctccaaataaactgggatgggtgggaatatatatgaaacaagtaactggctagaattgggaaccgctaaagctggatggtaggtacgtgaggaatcattttactattctgtttatgtatgttcaaaattttccagctgggcgcagtggctcacgcctgtagtcccagcactttgggaggccgaggtgggtggatcacctgagatcgggagtttgagaccagcctggccaacatagtgaaaccccattctactaaagaaaaaaatacaaaaaaattagctaggcgtggtggtgggcacctgtagtcccagtgactcaggaggctgaggcaggagaatcgcttgaacccaggaggcagaggttgcagtgagccaagatcacgccactgtactccagcttgggcaataagagcgaaactccgtctcaaaaaaaaaataccataataacaatttaaaaactgagatctcggagtataccttctcatatgcttgattctccacaccatatcagagttactcaggtttttgttgcctctttttcttttttttttttgagaccgagtttcactattgttgtcctggctggagtgcaatggcgcgatctcagctcactgcaacctctgcctcccgggttcaagcgattctcctgcctcggcctcccgagtagctgggattataggcacctgccacaacgcccagctaatgttttttttgtatttttagtagagacggggtttcaccatgttggccaggctggtcttgaactcctgacttcaggtgatccacccacctcggcctctcaaagtgctgggattacaggcgtgagccactgcgtccggcctgttgcctctcttaacatgtttacagcaagaatctttgccaaggctgttttaaactctggtaatctggaataacgctctcttaagatagttctgtcctctgatctggtcttttttcttcctctatttacaatattgagcatcttaataccaaaaacccaaaaatgatcaatggcatagacaaagtaaaactagtctagctagattaccaatctggagtttcagttccaaaataagtatttagcactgtgatcctttggtgaagaccacagactgccaccaaaccaagtggcttatcagcaacccctgctccagacttccgtatgcttttcttaactattcatcagtagacactatatagaatctagacttttaaagctaaagataaaagaacactgtaccttttatactgtataccctatttacctttactttttattagcttttaaacatacacaaaagtagacagaagtataacgaacctatgtactcaccccaacctcaatgatctatagtaaattttgtttcatctatacttacttctcctaccactgcattttaaagcaaattccagacatttcatctagatatagtatatatgtttaagaaaaagtactaagaaaatgccattacaggactgggtgcagtggctcacgcttgtaatcccaacactttgggaggccaaggcaggcggatcacctgaggtcaggagttcgagacagcctggccaacatagtgaaaccctgtctctactaaacatacaaaaattagctgggtgtggtggtgggcgcctgtaatcccagctactcgggaggctgaggcaggaggattgcgtgaacccgggaggtggaggttacagtgagcccagatcacaccattgtaccccagcctcagcaatggagtgagactgtcccagaaaaaaaataaaaaaaaaacaaaaaaacaaaaacaaaaacaaaaaacccattactcttagaaattaacttattttcagaagactccttaaggcaaggcatggtggctcacacctgtaatctcaacactttggaaggcaaatgctgaggccgaaggaggaggattgcctgagcccaggagtctgagaccagccagggcaaaacattgagaccccctctctccaaaaaaattttaaaaattagctgagtgtggtggtctgtacctgcaagtcccagctactcaggagggtaagaaggatcacttgagcccatctcttaaataaaaaaggccaggtgtggtggctcacacctgtaatcccagcactttgggaggcgaaggagggctgatcacccgaggtcaggagttcaagaccagcctggccaacacagtgaaacctcatctctactaaaaatataaacattagccaggcgttgtggcggggcctgtaatcctagctactcaggaggctgaggcaggagaatcgcttgaacccaggagatggaggttgcactgagccaagatcacaccacttcactccagcctgggcaacaagagcgagactctgtctaaaaaaaaaaaaaaacccaaaaatgtaaaaaagattccttaatagcatctaatattgagtccgtgtcaagttcaattgtctaattaatgtcttaaaaattggctattggccaggtgtggtggctcacacctgtaatcccagcattttgggaggctgaggtggatcacctgaagccaggagttcaagaccagcctggccaacatggtgaaaccctgtctctactaaaaatgaaaaaattagctgggcacggtagtaggcgcctgtagtcccagctgtttgggaggctaaggctggagaatcgcttgagccagggaggcggaggttgcagtgagccaagattgcgccattgcactccaagctgggcaacagagtgaggctctgtctcaaaaataaaaataaaaataaaaataaatcagcttttaaattcagaatccaaagtctgcatgtcacatttggcttatatatttcttaattcttaatttataatagcttcccttccatacccttttcttgacatttattggttgtgatctagacttccacacttgtctaagagcaccaaccgcccaagcagactttggtaatgattcacatcagagctaaggactcaacactcttgcaggactctcctgcaaaaagctcacataggcacagcagacagaaagggatcaggagatactaatcacggagatgttaaatcatctgcccttctgcaaaacccaagaggcagaaaatagagtcaatcaccacagatcaatccaggttgattcctaccagtgagaagcccaacaggtgccagctaccctgatgaaagtttcctgctaatcatcaagttgactccgaggagcaaatcacacttaagtttatgtggccaaactaaggcaccacacaacatcatttatgccaataatctcaactctcgttgctcattagaatcagctgggtagctttgaaaacatgcaagtaaattagaattcccctgaatgctatgtatgtgtgtactacaaataactatcacagcaataagattacaagtcatcggccaggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtgggcgcctgtagtcctagctactcgggaggctgaggcaggagaatggcgtgaaccccaggaggcggagcctgcagtgagccgagattgcgccactgcactccagcctgggcgacagcgagactccgtctcaaaaaaaaaaagattacaagtcatcttaaatcctcaaaaattggtacaggcactggtactgcctgccacacagacctggatatctacaatgggagctccaaacatctttcaagagaaacataatacattttctaaaaatctgtcttctgccccaaactgcttcataaaaccaaagcaaacaatgctaccatttttctagctatgctaatagtactagcagactcaaaggactcacaactgggaaactatgttaaaaaacagaaagtcctaattagcctgacacctttaaaacgaaaccttccagggggataagatgattttcttttggcattaacaggcactatcaaatctaactcatccattactcaccttatcaaaaaataacgattctgttccaccaccatgtttgctggcatctgccatagaagaatccttcagattgagcagtttgggtttcttctgcaaaagaaagatacaaacatgtgagattcaacgagtggttttctctgaattttatttttgtctgtattcaatggtttcatcactgaaaccactgctgattaataatttgaaacaaatgagagaactctaaccaactcactccataccctctaagatttcaactcatattttctatttcagtttgcctattaagtttctttctacaacagaggttcaaagatcattctacccccaaaatattttctccagaaatgatcatgacattactgtgacaaacttttagaatatccttactttttctaggggcccaaagtaacttcatgtagaatctaatgccactgttttgttctcctaccagctgagggagaaaaggctgtttgtaaaaagagctcacaaattgacagaaatcaatctttaaccctgaataatatttcaattaaaaatttacttaaaaagcataatttgctgggcatggtgactcatgcctgtaatcccagcactttgggaggccaaggtgggcagatcatgaggtcaagagattgagaccatcctggccaacatggtgaaaccccgtctctactaaaaatacaaaaaaattagctgggcgtggtagtgtgcgcctatggtcccagctactcaggaggctgagacagaagaatcgcttgaacccaggaggtggaggctgcagtgagccgagatcacgccactgcactccagcctgggcaacagagtgagactccatctcaaaaaaaaaaaaaaaaaaaaaaaaaaaaaggcacgccagcaatatccactcagactaatttaatattgttcttctaaagggaaccaacaggccatgatataatcctgtcaggcaagaagttacttttaaaatccaccacttactctctatgaagaaatgcacaaactttgtgagaagtagcacatttaccttggctatctcagagtatactttcttaagagccgcagcctctgcttacactgcctatggagaaagtaggcggagaattttaagcccccactatattcttgccacctgtaggtaatcaagagtgggcggacgtaaatccaagcatggagtgtatctactgagctgattcttgctacccatataactaattctctttattgaaatgaagaaatagaaaccattattatgttcaacttgatttcaaaagatttcaaaagaagaaaccatgacaaacactaatgaaaaggatacttcaaaagtgtcagtaacacctagtacgtcagaccttgtagtcagtcaatcactattcatcagccacctcttactattagaaattcccaaacttttgtcattatttaattctgcagacatatctgtctcttctatattacatactgctttgaaattcactgaagaattaaacattcaatacatacaactagccctctccctatcatagctgtgttacatcaaagaagggagcaagctaagttttctgcaggcagaccatcagtgttaactataacaaaaaacatcatgtaatggattactaagaggagtttaagacttccctctgctacagcccaaaggtcctgccttggagattaagatgatacacataagatctggtaacccaacaaagaactttgagcaggacagggttctagaccagagatctcaaaaaacacatgcactctactcacaagaggacctcagagaccacttatttctgaaataattctcaagctcaagaatgttctttcttaacacaaggcagatttaaagcatcaaagaagaaggggccaggcgcggtggctcacgcctgtaattccagcactttgggaggccgaggtgggtggatcacctgaggtcaggagttcaagaccagcctggccaacatggcgaaaccccatctctactaaaaatgcaaaaattagctgggcgtggtggcacacgcctgtagtcccagttactcaggaggctgcggcaggataattgcttgaacccgggaggcagaggttgtagtgagctgagatcacaccactgcactccagcctgggcgacagagcaagactccatctcaaaaaaaaaagaagggaaaaaaatttcaagtattggaaattcttagtagcaaccaaaacattaaagaaatgacagctcattgcaaaggagagataataaagaactcagaaaagtacagtaatccaagcaatcaatgttattctaatactcttttgcaaagccagataaactctgcactgagtttctgtgacacaatactaacttcctccaaatatctaggacccaaccgttaacacacttaagaacacatgactgccgggcacaggtaatcccagcactttgggaggccgaggcgggcagatcatgaggtcaggagatcgagaccatcctggctaacacggtgaaaccccgtctccactaaaaaaaaaaaaaaatcagcccggtatggtggcatgcgcctgtagtcccagctactcgggagggcgagacaggagaatcgcttgaacccgggaggcagaggttgcagtgagccgagatcgtgccactgcactccagcttgggcgacagagcgagactcggtctcaaaaaaacaaaaaaaaacaacaacaacaaaacacatgaccacctctagagtacctctccattagaaatacttgtgagtgtcaaaatgagcagctgctgcccattctcaccttaactggaggggtggttcctgtaggatgtctgcggatctggcagccattctggctgggcctctgcggcttgttgttcagttggggcttcttgacagtgcctccatgatcatttctcacagaatcaaccttctcagcagttgttttgcttaaaagctgattaagacacatgaatgagattaatgctcttatcaaagcaaacaaatatcatctaggaaaagtccccttctgagcacagttttccaactcatctaagataataatagtaaatagtgtaattcttattaaaaaaacataccacggagctgttggcatctggtaggaattgtccaaactctgacaacaaatcttcctggtttttaaagagacgagcaacctgggcatacacctcctgctctgtcaatgctggagtgtagtttcctccagcttccttggcatttctctgctctttctgaggaattgcaaatgaaaagagatcatttgggctactgttttgagtcactcatctttgcacgctttctggaatcactgttatctatttaggctgcatgtaagaagaaagtctatgttcttagcacccgttctgaccacagactttcaagttgagaaaaaaaaaaagttgaagatggtggatgacaattcctttcaaaactagggtagtaaatatttttgagacggagtttcactcttgttgctcaggctggagtgcacttgtctcggcctcccaaagtactgggattacaggcgtgagacaccatgcccggcctagggcaataaatattaatgcccaggggaccactaccaactgacaaaaccttagaaatttctcctcctcctactgtacattaactagactatataaatcaccatctaactgtcccagataaaactgagtttcatttcatgggacagtgactaacaatcctgactgaggccgggcacggtggctcatgcctgcaatcccagcactttgggaggccatggcgggtggatcacctgagaccagcctggccaacatgttgaaaccccgtctctactaaaaatacaagaaatcacttgaacccgggaggtagaggctgcagtgagccgacactgcactattgcactccagcctaggcaaaaagagcaaaactctgtctcaaaaaaaaaaaaaaaaatcctgactgaatgttgcagggcaatcaagtcaggcaaataaaactggctttatagcatgggggcggtggctcacgcctgcaatcccagcactttgggaggccaaggtgggcagatcacaaggtcaggagttcgagaccagcctagccaacatagtgaaatcccatttctactaacaatacaaaaaattagctgggcgtggtgggcggagcctgtaatcccagctactagggaggctaaggcaggagtatcacttgagcccgggaggcggagactgcagtgagctgagatcgtgccactacactccagcctgggtgacagtgcaagactccgtctcgaaaaacaaacaaacaaacaaactggctttaaaaacatgcatgatagtttctaactggttaatttccagtatgaattaatggacacaataatggttacttgttattggactagatgccctaagagggtgacctggttaagacaggctgaatgggcactccttacctgatatgtgtgcaaaatctccaggaatgctttgtagatgtctggttggccctgaaatctgttcttgatcttattaacatagttgatggcatgattaaactccacaggttgattgttctgcaaggatggggccgttcccaacgagattgtcactggtgtgtgaggctggaccggcggagaacgtggggatgcatacggtggaagtgggggagtctgctgactggccggagtatgtgcttgcagttgggagggctagaaagaaaagaaatctttattctcttcagatgcatagatgagttgatacaaggaaagttcaaactaaagagaaacaaggtgtcaacgtatatcctttatttactcactcaggccaggtcattttagtccaacacaaatcatactgggcagcagtgggagttgtaggcggttcaaacatgctgatacaaatatttcagtctcacattttctaaataaaaccttaaaactggagccatctccaattacagggaagaatttttcatatgcaatgttttagcttagtagctcaacaagtacacatagaaaaaatctcattctacatagccttttgatgtcaacaacaagacaactgttgcagtagctccacataaaaaagtcttctacgccaactctgtcctgtagaactgagatgatggaaatgtcctttatttgcactgtcttatacatagccaccagccacatgaggttactgagcacttgaaagctagtgcaaatgaaaaactgaatttaatttaaatagtcctatgtggctagtggctactgtgtcagacagtgtggttctagaccaagaacaccccatcttcatcaccatcactatcactattcattagatcttctacttagcttgatataatctagttagtgaaataactttcataaaataaccatgtgggcagcagcacaatttgaccaggataagacgatggtttctatctgtgctgtcaactactactacacaaagtcaccacctgttgggatgttcatggttttataagcagaaactgtaaaaagaaagaccttgaaagttgttgctgtgttgatttaaatagatacctaagtaagtgatgtgtaaatgtgaaccatgtcatagtgaagttttcatacagcatttttctatgacgaaatctttgtaactttgtttctcagtatctaagtcttatataaaggggaaacatcaaaggaaggtgctctctagggatgcattcatattgatgcaatattttccaagtgctcaccttgctgactttggcaggtgggggctgaggagctggctgggcaggagctggggctgactgggctgaaggctgggaaggatgttggggtggtggttgaggctgtggctggatgccatgggtgggaatctgatgaacctggccaggagttgtcacattcaccatgtcattggtttgcacctcaattttgtagccagggggcaagaaggtgttgaatcccattatcagatcggggtggcctttgaatagctgggacacacgactaatcactcctggggtgtcgatgctgataaaaaacaaaaagaaaagtgataaactgtaagcttaacaaacaccctgttaagaaaaaatttcatgtttttttttcttttgagacggagtctcactctgttgcccaggctggactgcaatggtgcaatcttggggtcttggctcactgcaacctccacctcccgagttcaagtgattctcctgcctcagcctcccaagtagctgggattacaggcatgcgccaccatacccggctaatttttgtatttttaggacaggtggggtttcaccatgttggccaggctggtctcgaactcctgacctcaggtgatccgcccaccttggcctcccaaagtgctgggattacaggcatgagccacctcactcaaaatttcactttctactaggttttctctaaacaggaaaacagatcatctacgcattttaaaattaacacacgaactctgaaattccaaagccatttagttttagactcaaagatacttggccacaatttgttttttttttttttgagacagagtctcattctgttgcccaggctggagtgcagtagcacaatctcggcacactgcagcctccgcctcctgggttcaagcaattctcctgcctcagcctcccaagtagctgggattacaggcacccgccaccatgcccggctaatttttggaatggtcaaaatttttaacagaatatatgttcattgtaataattctaccaagcagatactcagatgatatatataaagctacatatcccaaacaagattcactctttgatataccagtatacatcatttcagcacacatctacattgttcagatgagttacactcttacaacagtgaaccatgccagaatataagggtatctaaaccaattcagaaaccaagtagcctaaatcactaccagtgctacttccctgattgagacaaaacactggaaaaaatttagttaaggaaaatttaccaatagggataaaaaagtctagtggccataatttccatcaataaaggtatgcataaaataaaggcatgattttgaaaattcagctgcaaaaaggagcatcctttatcttccagtaaataaactatatcctcttccttccaaaatcaatatgccagatacaaagcttgagtacaatcacacatcttttacctctgagatttaaattccttcatgatgtcaaggaaatcattgtagacctgaggctgactaccaaactgcagcttcacctggtcaagataagatagcgcatcctccacctgaggcagggataaatatcaaggttataaaaagaaagtaagctcataattacaaaaaaaaaacaaaaacaaattatttatgcctaagtatgcttaatgcagtaaatgaagtaaaaatatattaaatatatacttaaaagttagtatggataccaataataaactcaagcttaaaataataatcaactcataaaatctgtagccttgccttggaaaattttgaacagaatgatcagtgaagaataattacaatgatatatcatttattaattcatttcacaagtatctactaaactgcaacataccaggcccaatgtgagtaccaaggattcaatgacaaataatttgtagcccctcgtctatagacatttgtttgtatgtagtcaggaatcataacacagtgggtaacccggtaatcactccatgcctggagatgacatgggaaggacacgtcttctccaccaaaaaaagtgaggcttccccaggaggtaatgtataaactgagacctaaagatgactataagctagcaaaagtgaagaccagtgaagaaaatcaaaagcggcagcacgggtaaaatcctagacaggatacgatatgggatatttagaaatctgaaaacagtttagtttggctggaggatctgtagtgaagaggaaggaaaagtaacaaaatgagacagaaaaaaaagcaggatctagattctgaaaggatttgtaaatcttgtgaaaaagcaatttagatttttatcatctgcattttcgtgtacgcaatttgactgcagtgttgagaaaaaattggcacaagagcagaaaagattgaaaggaggtaggaagaccaggtatgctacaggaataactggacaactcatgtgaaaacagtggcttgaattatagtactggcccagaacaacagagagaactgcatagataaaaaagctttttgggtagtagaagtgacaggattggggaactgactgaatagaggagctaagggagagccagcattcaaaagtgatccgccacggagcactgaggaagaacagtcaagagtgactctcggaccgatcaaagcccacatgccactgcatcccgcactcagcgcttacatccttccacatcaccaccacacccaagagaaagcctgaaggggatgctaaaggagatagagccaaggtgaagaacaacccagagaagatccgcaaggttgtatgctaaacctgctcctccaaagccagagcccaaccctaaaaaggatgcaggctgggcgcagtggctgacacctgcaatcccagcactttcagaggcagaggtgggaggatcatctgaggtcaggagttcgagaccagcctgaccaacacggagaaacccatctctactaaaaatacaaaaattagccaggcatggtggcgcatgtctgtaatgccagctactcgggaggctgaggcaggggaatcacttgaacccaggaggcggaggttgcggtgagtcgagatcatgccattgcacaccagcctgggcaacaagagtgaaactcggtctcaggaaaaaaaaaaaaaaaaaaaaagtcccctgcaaaggagagagaggaggtacccaaagggaaaaaggaaaatgctgacactggcagggaggggaataaccttgcaggaaatggagatgccaaaacagaccaggcacagaaagctgaaggtgctagagatgccaagtgaaacatgtgcatttttggtaactgtgtacttctggtgactgtaaagtttgaactataaagttatgaagtttgtaaattttgaaataccattgtttaaatcaagctttataaaaatgcagaattttgttttgctttttctaaagcagtgttgttatcgcacacagaacacttcattgttgttttggtgggaaggatcacaggtcactaatagaatgtctttgaagctggactgacgtggggaaaacacctttcccttctagttttgagagacttcctcttggcttatagaagaaattccctgactttatttacttatttatttagagacagagttttgctattgttgcccaggctggagtgcagtggtgcgatcttggctcactgtaacctctgcctccggggttcaagcgattctcttgcctcagcctcctgagtagctggggttacaggcacccgccagcatgcctggctaatttttgtatttttagtacagacaggatttcaccacattggccaggctggtctcaaactcctgaccacaagtgatctgccagcctcagcctcccaaagtcctgggattacaggcgtgagccaccacacccagcctagattccctgacttttaacacacatggccaccttggcacaaacaccttgtgggatggaaaaacaaattcatttttacatcctgttctccctccccaccttcacagacctaactcccttttacccagacacctgttgggacctaacccccaataactggttaccaatatgtcaggcagtcaaactttccagtgatgccactgaaatggcagccctcaaaagagcagtggttgctttttctagactgtggatcttcagataagtcctgccattttcatttcacttcctgaaagtcagggttggcttgtgaaaagttgttaaacaacatgctaaatgtgaagtgtcaaccttcactctaaactttccctgttcagagcatcaaatgagacttcactgggttttatagtggcttttttttttttggtagctcattgttaaggattgtccatgttctgcctgaaataccatgactgtttttggaaagtatctttaaagctggatacagtttggctgggggagaaaaaaaactgacctatcacaaagaagaacaggttggaaaggctaagctatgagtctgatttaggacagagacacccaaaagaaatccccactaggtgtttcctatttactctgagatacgttaagttttattttggtagtttaactgaagcctaaatatttaaaattatacaaaatatcaggtttaagaaatttcagaaataaacatttgatgtgatttaagccagtctttttcttttttttttttttgagatgggagtctcattttgtctcccaggctagagtgcaatggcgcaatctcgggtcactgcaacttctgcctcctgggttcaagtgatatctcctgcctcagcctcctgagtagctgggattccaggcgcatgtcaccacatccaactaatttttttgtatttttagtagagatgggatttcaccatgttggccaggctggtcttgaactcctgacctcaactgatccgcctgcctcagcctcccaatgtgctgggattacagatgtgagccaccacacctggccaggcatagatagtcttttgatttgttgcaaaatggaacatttacattcaagtcaatcattaactggtgctgtggtctgaaatgtgtcccacaaaattcttacatcgaaacttaatcaccgatatgatgatattaagaagtgaggccttcagaaagtgattgtggagccctcatgaatgggattagggaccttataaaagggctggagtgaaccagtgttagtcccttcggcccttctcccttccagtgtaaggacacacattcagggaccatctcgaaaaacagagttcaggccctcaccagacaccaaaccaactggcacctggattttattttattatttattttatttattattattattatttttttagatgaagtcttgctcttgtctcccaggctggagtgcaaaggcacgatctcagctcaatacaacctccgcctcccgggttcaagcgattctcctgcctcagcctcttgagtaactgggattataggcgcctgccaccacgcccagctaatttttgtatttttagtagagatggggtgtcaccatgttggccaggctggtctcaatctcctgacctcgtgatccgcccgcctcggcctcccaacgtgctgggattacaggcgtaagccactgcgtctggcctatttatttattttgagacatggtctcactctgtcacccaggctggagtgcagtggcacaaattcggctcactgcaacttccacctcctgagttcaagcgattctcgtgcctcagcctccagagtaactgggattacaggtgcatgccatcatgcctggctcatttttttgtatcttcggtagttttaccatgttggccaggctggtcttgaactcctgacttcaaatgatctgccctcctcagcctcccaaagtgctgggattataggcgtgagccaccgcacccggccagcaccttgattttagatttcccagcccccagaacttctccagaactgtgagaaataaactgctattatttagattatacagtctcaggtattttgttatagcagcactaatggattgagacaaatggccgcttttttgtttttgttttttttgagacagagtctcgctctatcgcccaggctggagtgcagtggcgctttcccggctcaccgcaagctctgcctcccgggttcacgccattctcctgcctcagcctcccaagtagctgggactacaggcgcccgccaccacggccggctaatttttttttctatttttagtagagacgggatttcactgtgttagccaggatggtctcgatctcctgacctcgtgatctgcccgcctcggcctcttaaagtgctaggattacaggcgtgagccaccgcacccggccccgagacaaatggctgtttaagagttcttcagacttccattacggccatggttaatcagtgtttcggtgttgctagaaatcagattgtatagttggtcaatacccacttgtttgatggttagtttttctatacaaatatcatgacaatttctgttgaaattcaatggactattttaattcatattctgaactttccatactaaaatgtttcattaatgaccaacttaagtgaacacaaaatatattaagtttgcaaaaggaaccaagactttggaagatatttaagaatagcatgcatcattacacaacaaaagaacagttatcaataagacatggtatggtataaggtaactactgcagagacggaaaaagtacagaaacccaaaagaaagcaattatgtgtgatatgtatatgtctgaaacaaaaaggtactgaaagtcacagcaaaccaagcaaaccactgtttaaaaattagttataggccaggtgtggtggctcatgcctgtaatcctagtactctgggaggccaaggagggtggatcccttgaggccaggagtttgagagcagcctggctaacatggaaaaaccccgtcctagtaaaaaaaaaaaaaaatacaaaaattaggcttggtggtgcatgcctgtaatcccagctatttgggagactgaggcataagaatcacttgaacccaggcaggggagggtgcagtgagttgagatggcgccactgcactacagcctgggcagcagagtgagactctgtctcaaaaaaacaaaaaagtaaaataaaagttatagaataatcctatgctttaaaaactctgcatgacactcacataataaataagacacctacatgtaaaaatagtgaggaaattctctcatcacctaaagcatagtccaactcttatataaactctctataaatgcatgtatacagttctaggtagcacaacttaaaaaaaaaacttggatgtagttatttagaagctacagatttaaggaagcacttggggagacccttagactctgctgataaagtttcttagctcacttcaacagggatttactattaaggccccgaatctcctgaagtctacaatcttgttgggagagaaaaacacaagcaactgtaaagataacctgctaaatatgtaccaaatatcactgctgctgacattcaataactaaataacaccaaacatgcctcaaatcgttcaaatcccttcttgtcaccaccaatctaccaaagacaaaaaacaaaaaaaaaagacaatgttgaggcttgaaataatgtgtaagcattctcactgaacatttctttttttttgtttgttttttctgagacggagtttcactcttgtcgcccagactcgagtgcagtggtatgatcttggcttactgcaatctctgcctcctgggttccaacgattctcctgcctcagcctcctgagtagctgggattattacaggcatgcgccaccatgcctggctcattttgtatttttagtagaggcatggtttcatcacatttgtcaggctggtcttgaactcctgacctcaggtgatccacccacctcggcctcccaaagtgctgggattacaggtgtaagccaccatgcccggcctacattattatagaatataaatgatttattgaagttgattcaaatgcttgtaatgcattttaagactgatccaaaaatgacaggcaatgtgggaatactgagttaaattacatggaggtacaagaagcattttacctctcctcatcagaaaggaaattcaacaagttattttatgcaggaatatagtcaagagcttgtgactaaaagaacacaacaagaaatcctaactctatctatgactcactctataaccccaaatccaaaacctttccttgtttccttgccagtttccataaagcaaacaaaacataatccatatacttataccaaagagtcctgtgaggaaggtgggtaaaaactggtgttgtgctttgatagggttgattgaaaaaggctatagaaatacatatgtttttgttagtttaataagcaagtttataagctattttgcaacattaaagtataactactgaatatacagtgttaatacagaattaaatcacgcacaaccaagttttaaaaaaaatattttcaggacttagtaaagtgctaagcccgcagcaataatacattttggtacacagccatcactctacaacagactgaaaatgttttaaaggaaacatcaatattccttatacacattttcccaaagacagaatccagagtgaagcttcaggcctaaaaaacctgtactctctttaaaaggctatgcattagtcaatactatgtaagccaatatagagagtaaattttacaaaattactctaaatcacatagctttgctgtactttataatatttatgtagcatttaatactcttaggccaatattaaacaagttcccaagaatccacaccaacgagggcagggatcaagaagaactaaagtaagtatcagggaaaacagaagaaacaactatttgctgcatatggatatgtccttagagggtttatttctcattcgtgcctgcaagcaacataagtaggttgcaataaccaaatgaagatttaacatctcttcagagttcctccatttattatttcctgaacttaattttatataaacgtaaaattagaaaaattgaaacctgaacacttgctgcaacaatcacatattttgaaaagtaacattcaagtggtcagagatacaaggttagctgggaacacaagcttcacttctccagggatgcctcatgaatttcaaagcactgaaaacgtaccacacatactcagcagaaaatatgaaaacactgataattcattcacagttacagttttccctgaactttataaagattccccccaaaaaggagcatgtgttttactaagaatggacttgatgatgtgagtcaattcagctattcataaacaggaataaaaagataaaggtaataagaacattacaggcatgagctgggcatagtggctcgcacctgtaatcccaacactttcgaaggccaagatgggagaatcacttgaggccagcagtttgagaccagcctggggaacacagtgagactcccatctctgaaactaaaaactaaaaaaaaaaatttttaagaatttaaaaagattgaactgtaagatatattactgggccaatttactgtactaacctgtagccaatcatatatgtgctcaatagagagttcaaaaggaagcagccaaaaaatgaattttaaggtttattttgtattaaaatggccccacaatcctgataacatttgaccgacatgcattcatacagtccacaaacatttgagtatattcttctctggatcaggcactgatgccaagataggaaacataagcaaatttcacaaaacaaaaacggtaaaacttgtgattcgacagctagtatctcaggttagaagttgtaccaccacaaccaacaagctgcaaccagtatttcctgctaaagataaattttttgacccaagaaaaagagctgaataccaccttcagcctctgaaattgctgctgtccctgcactggtgcaactggtggggctggatgagcatgactctggaccacctggcctccgtggggctgcaccgctgttgggtgatgatggctgctatgaactgctgctatagcgggcccatgactgccggagctctgtggcatggctgaaacctggggtgaacaaaatacagacaggaaacttcaaggcttgtacattcttccccaaatgagtctaaataactaacacaaatgcacaaagataattaattggaaacccaaatttctgctgggcgtgatggctcacacctatctcacctacataggaagatcgcctgaactcaggagttcaaggctgcagtgagctatgatcatgccactgcattccagcttgggccacagagtgagaccacgtctctaaaaagagaaaagaaagcctgggcaacatagtgacacccatctccacaaaaaataaaaacttggccaggcatggcaacatgcacctgtggtcccacctactccagaggctaaaggaggaggattgcttgagtccaggagttcaaggctgcagtgagctgtgatcacaccactgctctctagcccaggtgacagaatgagaccgtctctaaaaaaaaagaaagaaaagaaaaagaaagaaacccaaattttccacaaaaggaactggttaaataaattacagcccaccaaagttataacaaaattatttgtagctattaaaaattatatagccgggcacggtggctcatgcctgtaatcccagcactttgagaggccaatgcaggcggatcacgaggtcaggagatcgagaccatcctggctagcatggtgaaaccccgtctctactaaaaatacaaaaaattaaccaggcgtgttggcgggcacctacagtcccagctactcgggaggctgaggcaggagaatagcgtgaacccaggaggcggagcttgcagtgagccaagatcgtgccactgcaatccagcctgcacgacaaagcaagactccatctcaaaaacaaacaaacaaaaaaatatatatatagtttagctgggaacagtgtctcacacctgtaaccagcactttgggaggcccaggcagacagatcacttgagttcaggagcttgagaccagcctggccaacatggtaagaccctgtctctactgaaaataccaaaaaaaatagctggacgtggtaacacgcatctgtaatcccagctactgagaggctgaggcacggtaatcacttgaacctgggaggtggaggttgcagtgagctgagatcatgccactgcattccagcctagaaaacagagcaagactctgtctccaaaaagaagaaaaaaaattatatagtttatctcaaactgtctgtggtaaaggatgagtttttttcttaaaatttcaatccatcagggaccacaacttttataaaaatccaataaaaataaattactatgaaagtgaaataaaaaatacataaacccgccgggcgtggtggctcatgcctgtaatcccagcactttgggaggccgaggtgggcggatcacctgaggttgggagttctcgagaccagcctgaccaacatggagaaaccccatctctactgaaaatacaaaattagacaggcatggtggcgcatgcctgtaatcccagctattcgggaggctgaggcaggagaattgcttgaaccagggaggtggaagttgcggggagctgagatcacgccactgcactccagcctaggcaacaagagtgaaactccatctcaaaaaacaaaacaacaaaaatacataaacccgtaattttttttcttacctttttattgagacagggtcccgctctctcacccaggctggagtgcagtggtacaatcatggctcactgcagccttgacctccccaggctcagatgatcctcccaccccagcttcccgagtagctgggactacaggcatgtaccaccatgcctggttaattgtcgtactttttgtagaaacagggtttcaacatgttgcccaggctggtcttgaactcttgggtatggagtccacctgccttggcctcccaaagtgctggggttatagacgtaagccactgtgcccagcctgtaactttcattactggattttacaaataaaaaatgatcatgtccaattgctctaatagtttctaaacaatttctatacttatgccattacaaactagtaacaaaggatacagattagccatttttaagccacacttcaacaatgatatatatggatatatttgaatctgaaaaaaaagttcataatccacaagttgaacatattcatgtactgtatataaacttttaaatagttttttaaagcacattacactggctgacaaagaccctgtctcaaaaaaataataaaagcacattacaaagcagtatgataaaaagatttcaaaccttagacaactaatatatagcaaaatgttggcatttaatcttgtggttacagaattaaagatgactcttactttgtttctttttgtttttgaaacactctcgctctatcgcccaggctggagtgcagtagcacaatttcggctcactgcaacctgtgcctcccaggttcaagcgattctcctgccttagcctcctgagtagctgggattacaggtgcctgccaccatgcccagctaatttttgtatttttagtagagacagggtttcaccctggttagactggtgtcgaactcctgacctcaaatgatccacccgtcttgggctcccaaagtgctgggattacaggtgtgagccaccgcgcctggcctacttggcttattttgcttatcttgatttgctacgagcactgtatctaatgtaaaataaattttttccccctaattcttgatggtttggcctcaaacaaatgtcttttctattcttttatctcagtctttctcctgtcctcttacaagtttgaggaaataaaagccaaaactactttccttctatatctatttcaagaaatgctacaaaatttttttcagaacttttttcctttttcagaattgttgatcaccacagaagacaacaatctgtccaaatgcccaaatgccccatccccaaaataaggagactaaataacatgaaactttctttctctaaacaatgttaagttttataccacaatttaagagagaataaaactttttttcaaatcctcacttttataaaaattatcctggagggagatgaagaaatgagggagagggagaaaccaagcaactatgcataaatccacagaaacaaaacaaggtgtattaagagtaaaaagaaactatttagacaattctaaaagctctaatgtacctcaaagatgggctagtattctgagcttctgtattccaacatgcatgttttttacagggtttacaggctttcactagactgacttatacaaacacattatagtttccattcggaagaaatttaactatcccaaatgtagaaaacagtcattaacctgtttagataatgaaagtaatcacccaaggtaaacaagcaacttttttttcttccaagtcctaaaagatgccatctgttggcagtcttctgactgctgccccagccccacaggaagggattagacagcctcaaggggactcctgaggaagagtgacacctaaggaatcaccatttcctacttcagctgcatttcctcttctttatatttttatactaaattcctagaaatggaattgccaggtcaaaaactaacaaaaccatctgacacaaactgccaaattgctctcaaaaaagattacgtcagtttatattcccattaccagccgtacatttttaaggtcactaacaaatgaggttgaaggcctccccagaccagttatatgctgaagtagaaagatatccactatatattaaatgaaaagagcaaacagcacaatagtatgtaatgtatgatccacattgtacaaaaagaaaagcagaaagggcggacgaggtggctcatgcctgtaatcctagcagtttgggaggccgagtcgggcagatcacttgagtccaagagttcaagaccagcctgggaaacatggtgaaactctgtctctatagaaaaaatacaaaaattagccaggtgtggtggcatgcacctgtagtcccaactacttgggagactgaggtgctaggattgcttgagcccaggaggtgaagggtgcagtgagctgagatcatgccacagccttccagcctgggcgagagtgtgactctgtctcaaaaaaaaaagtaaatttagatagctagacaggttgatatagatgagcttgtatatgcatataaaactggatacccaagaaattcaccagtgggagaaaatctgaggtgtgacagaaaaaaagtcattttatatcctttttttaaaaaaaaatcaaagtgtggcagggtgcagtggctcacacctgtaatcccagcactttgggaggtcaaggcaggcagatcacttaaaaccaggagtttaagaccagcctgcccaacatggcaaaaccctgtctctactaaaaatacaaaaattagccgggcatggtggcttgcgcctgtaatcccagcgactcaagaggctggggcatgagaatcacttgaacctggaagccagaggttgcagtgagccaagatcacgccactgcactccagctggggcgacagagcgagacaccatctcaaaaaaataaaataaggccgggtgcagtggctcacgcctgtaatcccagcactttggaaggcagacaggcggatcacctgaggtcaagaccagcctggccagcacagcgaaaccccatctccactaaaaatacaaaaattagctgggcgtggtggtgcacgcctgtaatcccagctactcgggaggctgaggcaagagaatcgcttcaacctagaaggcagaggctgcactgagccaagactgaaccattgcactccagcctgggcaacagacagagagtctgtctcaaaaataaataaataaataaataaaataggctaggcgtggtggctcacacctgtaatcccggtactttggaaggccaagaggggcagatcacctgaggtcaggagttcgagaccagtctggcccacatggcgaaaccccatctctactaaaaacacaaaaaattagccaggcatggcagcaggtgcacgtaatcccagctactcgggaggctgaggcaggagaatcacttgagcccgggaggcagaggttgcagtgggccgagatcgcaccactgcactccagcctgggtgataagagcgaaactccatctcaaaataaataaataaataaataaataaatgaataaaataaaaaataaaaaaaccaaagtgatacattactttcataataaaaaagggcaaaaaccaaatttcttcacttctacaaaacagagtaacagatgaatgatcagtgttggtcaggacatagaacaggaatatacaatgcttgggggaacttgctaaagatgcatataccctgtgacacagcaatccctttcataggtacttgacaaactcttgtatgtcctcaaacctgctgactggtttccaacaggttaaggagtttgcaccacaatgtaaaccaacgatggtagacccttgaataacacgggtttttgttttgtttttaaggagacagggtcttgcactgttgtccagtctgaagtacagttgcttgatcacagctcactgcagccttgacttcctgggcttgagcaatcctctcacctcagtctcccgggtagctaggactacagatgcacaccactatgcctggctaattttttatttattttttcaaattaattaattaattctttctttttgagacaagttcacactctgtcacccacgctgggtgcggaagcatattcactggagcctcaacctcccaggctcaaatgatcctctcacctcagcctcccaagtagctaggaacacaagtgtgcaccattacgccctgctaatctttatttttaggagagacggggcttgctatgttgcccaggctgatctcaaactcctgggctcaggcaatcctcatgcttccaacttcgccaactgttgggattatgggtgcgagccactgcactcagcaacaacacaagtccacttatacatggattttctcccacctctgccaaccctgagatggccagactaacccttcatcttctttctccctcctcctcagcctcctcaatgtgaagacaaggatgaagacctttatgatgatccacttccacttaataaatggtagatatattttctcttccttatgattttcttagtattttgtttcttctagattattttaagaatatagtatatgacaaatatacaaaatacatgctaatcaaccatttatgttatcggtaaagcttctggacaataggctatttgtatttaagttttaggggagtcaaaaattatacattggccagacgcagtggctcagacttgtaatcccagctctttgggaggctggctgggggaggatagctttgggccaagagtttaggaccagcctgagcaacacagcaacacctcatctctacaaaaatcataaaaattagccaggcatggtggtgtgcacctgtagtcctagctactagggaggctagggcacgggaggactgcttgagcccaagagtttgaggctgcagtgagtcatgatcgcaccactacaccccaacaggggccacagagcaagacactatctcctaaaaaaagaaaaaggaaaaaagttatacatgtatttttgactgcatggggggaagtcagtgcctcaacccccacactgtccaagagtcagccatatttcactacaatgatgtttaattcagctgtcttttttaaaaataaatagcaaaactgtcttaataagtgcgttgatttaaattctggcacaagcttcttattttgtcatgaattgccactgagtgcactaagacaatatcacaatgttcacagcagcacctttgtaaaagcaaaaacctggaaacagcccaatagtccaacagtagaattgacaaataaattgagtatatgcatgtaatttacactacagtgaaaatggtggaattacagcgatctataaaaatatggggtttttaaaacaaagtgagtcaaagaagaaaatgtttccatttatataaaagttcaaaaataccgaaactaaacaattatgttagtttttttaagtaaataaagtcaagggaatgataaatacaaagtttagatcagtggctacctctgaagggagggaaaagaagggagcagagtgggatacgcagggaacttcaaaggtcatgacaacattctttttttaaaaacttgtatggtgagtacacagttatttttttttttaccttacacatactcaacaatttttaatatctaacacagtattaaaaaaagttttataattgcctaaaaccactatttctcttccctcattctagtcccttggttggctccagcttacctggtagctgggtgttacagagtactgaattcccgtagctgactgcatggtctcagacactgcttcatacacaggaggggcaggggcaagcacccggtgctggtgaggaaaagcctctgtgctgccagggatccgacgctgctgggctgcatacaccggtgactcctggtcatccaaacgccgcttcattctgtgctcatgctcagggatgcactacaaaacctgcagaaaccaaaagcaatagcatgcaagtcaattctcactccagtatgatgtacgccacttaggaccagtcacccaagtttagtaaaagcttgactcccagaactgatcatctatttcatcttagtgatgaagtttaagtgcatgtgggcataccaccccccaacacagtgaacaagttataactgaaaaagacaaatatttaaataacataattttaattaatttggtattatgaagttgaaaaatacgctccaatttaaaaatataaacacaaccttgtttccctttattctctagttttctcctcaaatgctatcactcctaatattaattacatatctacatgctgcaaaaatattcaagtgcttcttctttttttttttgagacggagtctcactctgttgcccaggctgagtgcagtggtgccatctcggctcactgcaagatccacctcccgggttcacgccattctcctgcctcagcctcccgagtagctgggactacaggcacccgccaccacacccggctactttttttgcattcttagtagagacggggtttcaccgagttacccaggatggtctcgatctcctgaccttgtgatccatccgcctcagcctcccaaagtgctgggattacaggcgtgagccaccgcgcccggcctcaagtgcttcttcttaaatcctctcaaaacctactactataattgtggtctaatttaaaatttgtttcaacaattataatggtatcatggaaagaataccgtgccaggaatgggaagacaaagattctagacttgccaatttaagatgctacgtaacttcaacaagttcctcattctatgtgaatttcagtttctccaactataaaataagaaaagttggaacagatcactcctaaattttcttctggttttaacagttataagaagagattctcttagcttaataatacctccgtgggagacaatttcattcctgcaggacacagtaatctacttggcccagtaatctacttgggtcttcagagcttttccatatcagtatcactaacacaagcataacacaccatcagtgagaaagaatgaatcagccatccaaagaaaaaaggccccaccacttttccagtcccaaaaaaatctcttaaataagataccactgctatggaaagaagataaaatttacagtaatagtgggagatttggcaagccaccccctcatctgaaatacggttaagttaaaaaaaaaaaaaatctttacctaattcataagtctacccaagatcttttctttatcctctgggagcacacaagccctgaagggaaagtagtctttacaaggactctccatggctgtttcaccttttctttgtcctcactatagtcctcaatctgcctgccactctaatccttagctctgaaatcctgtctcaggtttttctcacatttcacatacctaagtgggaccctgacacagcagcacaacccattaatttgcaagctggctacttttatctatttgtaaactcaagccacaaatatgctctctgtggcctatataacttcagactaagtctctcagctttgtgtgtgataatatgtggaactcagttaaatggagttgagaacgtttctgacagctgctgaggacaaataatttaaaatgtcttagctagttatgctttcctatgtttttctagcatgaaatagcatgtttagcttagtattcaaaaaccttttagacatattaagaggttgagtatatagatttatgcatgttatttgccactaatcaactacgaacactaaacctcagcgtgttttgggatgaggaactgagtctaatcacaggtagagtaaaatgtctttttagctatttcttatatacgttcatgactttcagtggtttggtcttgggttctgttggtttaaaactgatgcttaactcatcggagattaacctctgtaaccaaaaatgaagtcaatactttattggccggatgcagtggctcacacctgtaatcccagcactttgggaggctgaggcaggcagatcacctaaggtcgggagtttgggaccagcctggccaacatggtgaaaccctgtctccagtaaaaatacaaaaattagccaggtgtgatggcgcacacctgtaaaacctgctacttgggaggctgaggcatgagaatcgctagaatccaggaggcagaggttgcatgaggggaggtcccaccactgcactccagcctgggcaacagactgagactctgtctcaaaaaaaaaaaaaaaaaaaaattatagaaatgttatgatagggcagcactgggtttaaaaaacaaaaacttcataggctggtcacagtggctcacacccgtaatcccagcactttggaaggccgaggtgggtggatcacctgaagtcaggagttcgagaccagccaggccaacatggtgaaacccagtctctactaaaaatacaaaattagctgggcatgatggcacgcatctgtaatcccagctacttgggacgctgagacgggagaatcgcttgaacctgggaggcggaggttgcagtgagcaaattcgcaccactgcaccccaggctgggggacagcgcgactgtctcaaaaaataacaacaacaaaaaaaaactttataaataataagccaaaatcagatgtgaagagcacggcacgactatagaaaaaacactagagtaccttttaagaactggattctgttggatgggagaatgtttgagggcaaaaaataaaaacaaacaaaaaagaactggattctactccaaactctatctaccatgaagctttctaattttggccctgttttcaaacaggggcaaaaggaggggatcagcctacattagtgatttccaaatgctggtttatgaaccagtctataaggaaaaagaagattgtagtgagcttttcatacattaagtattacagtactatggtttattctgatatcatactctatcttttggctgttaaaatatcgtttcttttattaagtgattgggatttcatatggtacttaacttcatccacctccagagtttgctttccataccacctctacaacactacagaggctgaactttctctgaaccatactttattcctttaacaattaccactcataggccgggcgtggtggctcacgagatcaggagatcgagaccatcctggctaacatggtgaaaccccgtctctactaaaaatacaaaaaattagccaggcgtagtggcgggcacctgtagtcctagctactcgggaggctgaggcaggagaatggcgtggaccgggaggcagagcttgcagtgagccgagatcatgccactgcactccagcctgggcgacagagcaagactccatctcaaaaacaacaacaacaaacaaacaaacaaacaattaccactcaaagttctattcctaactctctctcaaataaattgcttccgctctaatcatacctcctggtttcaggccctgatcatccttcacaacaaccttataagcaaggtgttctctaatttatgaatgaggaaactgaaaaacaaagattaagtaaactgcccaaggttgcacagctagtaagaggcaaagctgtgatataaatccaggaaatctgtctccagagcctggctcttaactacttcactaccttacctctcacagaagagaagaagtgaaggaagaatccctttacttatttaaggcacacatgcagggagcaagttcagctttttttaacctttcacacacttagctaactcatccttcttcagcctaaacctaataaagcagaaatgctttagtagcattcattcattaaaagcaaatgttcagtgagtagatatgaagttggtagatgatttcagcccttgccctctaaaaccatatatagcctcactagtaataaaaaacgtgtaaagtaggccgggcgcggtggctcatgcctgtaatcccagcgctttgggaggccgaggcaggcggatcacttgaggtcaggagttcaagaccagaccggccaacatggtgaaaccctccctctactaaaaatacaaaaattagccgggtgtggttgtgggcgcctgtaatcccagctactcaggaggctgaggcacgagaatcacttgaacctgggaggtggaggttgcagtgagccgaaatcgcgccactgcactccagcctgggcaatagagtggaactgtctcaaaaaaaaaaaaaataaaaggtcaggcgccgtggctcacacttgcaatcctaacactttggttcgccgaggcgagtggatcacctgacgtcgggagtttgagaccagcctgatcaacatggagaaactctgtctctactaaaaacacaaaattagccgggcatggtggtgcatgcctgtaatcccagctactcgagaggctgaggcaggaaaatcgcttgaacctgggaggcagaggctgcagtgagccgagatcgcgccactgcactccagcctgggcaacaagagcaaaactccgcctcaagaaaaaaaaaagtaatttactccaaagcaatttaaaaaaaaaaaagatgacagtgtgggtaaggatacagggaaacactgatggaggaggctttaattggtacagcctatttagctggcaacttgtaggtatttattaaaattttaaatgtgcatacccatcccatgcatattatggaaaactatgtaagaatcagatcaaagtttatccacgagtataagaaatgaactctaaaacatactagattttggaatactgaaactatcaattccactttcaggcctgtatcctacacatctgctgagtatatttattgcagcaaaatatgaaaatctaaatatctatcagctaaataaatgtgatcatgcatattatggaaaactatgtaggaatcagaaagatcagggtttatccacaagtacaaagaatgaactctaagacatattaagtgaaaacagcaggctaggccggatgcagtggcttacgcttataatcccagcactttgggaggccgaggcgggtggatcacctgagtttgggagttcgagaccaacctgaccaacatggagaaaccctgtctctactaaaaacacaaatattagctgggcgtggtggcgcatgcctgtaatcccagttactcaggaggctgaggcaggagaatcactcgaacccaggaggtagaggttgaggtgagccaagatggcgccactgcactccagcctgggcaacaagagtgaaactacgtctcaaaaaaaaaaaaaaaaagaagaagaaaacagtaagctatagaatacatacagcatgatctcatgtatgtatatatacacatacaaaatgtactaaagatttgtacatttcattgtatgtaaaatttgcattgaaagaaaaatgtgcctgggcacagtgattcatgcctgtaatcccaacactttgggaagctgaggctcaaggatggcttgagcccaggagctggagaccagcctgggcaacaatgggatgaccctgtctctacaaaataaagaaacaattagctggaagtggtggcgcacaactatggtactagctactccagtgactgaagtggaaggatctcttgacctcagaagttgaggctgcaaggttgtagtgagcagtgataacgtcactgcactccggcctgggcaacagagtgagactctgtctcaaaaaaaaaacaaaaaaaacaaaaaagaaaaagacaaagaaaaaacatgctagccacgcacaatggctcacaaagtgcctgtaatcccagcactttgggaggccgaggcaggcggacctcttgagcacaggagttcaagaccagcctgggcaacatggcgagactccatctctacaaaaaatacaaaattagccatgcatggtggcatgtacctgtaatcccagctatttaggaggctgacgtgggaggatcatgtgagtccaggagacagaggctgaggtgagctgagatctcgctactgcactcgagcctggacaaaaaagaaaaatgctataaacaatattaaactctagataatgataaacatgctcaagtgcttagatgaagtatactaatgtctgcaatttattttgaaatacatcaaaaaatcagattcattgatggagcgatggatagatggacaggcatatgttaaacctagtagtagaaaaatgataatggtaaaatctaggtagtgtgtatatgggtgttcattatatttactaaaattctatcaactttgttgtgtatttggaaattttcttgataaagtcttggaaaaaaacatccacaggttctgaggattaggaaaaaaaaaaacaggaagaaaagccaacaatacaaaccagctcttgagtggaaaaaataagtactataaattgggaaagggatacagacaggtacacttgggaagactctataaaggtaaatattcagctacatcttgaaaattagagatgaattagaacacaggggtatagagcatgaaattaaaatagtaagtttagacttgcaggcaatagttatttacaatctttgccaagtcattcatcccacaaataattagcaagtgcttaagacatgcctggccctgtgcggagggttagaagtccagcactgagccagagatttcctccccgacaacagccaagtcttccatgtatgactgctatcagctgatgtcctcctcgcaacaatcctgtcagataggcagtcccagaaccctttttttttttttgcaatagcataccattatgtccaccaggctggagtgcagcagggctatcacggctcaccgcatccccaacctcctgggctcaagtaatcctcccacctcagcctcccaagtagctgggacataggcagcgccaccatatctaacttttgtattttttgtagagacagggtctcgatatgctgcccaggctggtctccaactcctggcctcaaacaatcctcctgtcttggcctcccaaagtgctgagattataggcatgagccactgcgcccagccagacccctctttttttgagggaaactgatactcaaattaaatgacttattcaaggtcacatacctgactaaaagagcaagaggttaaattcttcctccttggaatatgaacaatctaaagtagaaacattggacaagactgtaaaaccacgcttgcagaggggtacagtgtaattctagaatataaagaaagccaaacgatggaaccacaaagtcagccacaaaagtactgtcaagtcccgcttcagccaacatggttgatctccatctgtttcaaatttggagtttatagtactatcagaactctagtctaggaagacattataaaaagaaaaaaaaagcactttgacgtatagaaactatggagagaagactaaataatggcagcagaacatttaaaggtcacctggtgggcacagtggcttgcacctgtaattccagcactctgggtgactgaggaggaaggatcatttgaggccaggaggtggaggttagattaagcaagattgcaccactgcactccagcctgagcgacagaggaagatcccaaatacacacacacaaaaaaaacacctacaggtcctaaaagtcacctggccatgtgttataataaaactgggcgcggtggttcacacctgtaatcctagcactgtgggaggctgaggcaggcggatcacttgaggtcaggagttcaaaaccagcctggccaacatggcgaaactctgtctttactaaagcacgaaaaacaaattagccgggtgtggttgtgggtgcctgtaatcccagctactcaggaagctgagacacaagaatcgcttgaacccagggtgcggagggtgcagtgagctgagatcgcgccaccgcattccagcctggttgacagaacaaggctctccgtctcaaaaaacaaaacaaacaaaaaaaaaacgggtgggatgctgggtgtagcagctcacatttgtaatcctagcactttgggaggccgtggtgggaggattgcttgaggccaggagtttgagatgagcctgggcaacaaagtgagacaccgtctctacaaaaaaattttattaaaaattagctgggcatggtagtgagcacctgtagtccttgctgcttaggaggctgaggtgggaggatcatttgagcctgggaggttgaggctacagtgagctgtgattatgccactgcactccagcatgggtgatggaataagaccctgtctcaaaaaaacaaaagtctatcctggtcagtttgtttaaatgcatactcttagaacaaaaaataaaataaataaatgcatactcttttttgcttatttttaaatgcatattcttgaaacaatggaaagtttctcttcaaaagcaaacttccatcgcagtattaagtcaatgtaaacttcaacccagtgcaattttgagtagtctaattcaaaatttgtccaaaagtccacctctggttttaaatctgctaagaaagaatctattacagaatgaaaggcactctatttagatttcatatattgattagaattattgcttggaaaaattaacaaccagctcttctcaaaagacaccattagatctaatatccaagcctcctttgaactcagtttttatattcttctaatgcagtggtcctcaactaggggagattctgcctcccaagggcacatgtagtaatgatggaagacatttttggttgtcacaactcgggaagatggaatgctactgatatctcacagatagagtaaaaggatgttgtcaaacatcctacaatgcacacgacagtctcctcacaacaaattatttggcccaaaatgtcaacagtgtgtgaagactgagaaacctaagtttaatcataaccccaactgtcacatatcttttttttttttttgagacagagtcttgctctgtcacccaggctggagcgcagtggcgtgatcttggctcactgcaagctccgcctcccaggttcatgccattcttcggcctcagcctcccaagtaactgggactacaggcgcctgccaccacgcctggctaattttttttttgtattttttagtagagatggggtttcactgtgttagccaggatggtctcgatctcctgacctcgtgatccgcccacctcagcctcccaaagtgctgggattacaggcgtgagccaccgcacccggccatcaatgcttcttttacggcatatgatacacctttaacccgcattataccattacgcattggccagacactctgacctaaagttttttagaactcttatctttttttacgcctggtctcctttcgtccctctcttaggcttgatctgtaaaactcttctgactcaaaattttagagcttttctgataccataatgctcattaaatctgtaaaaattaaaaataacgccaagtgtggtggctcacgcctgtaatctcagcactttgggaggctgaggcgggcggatcacctgaggtcaggagttcaagaccagcctggtcaacatggtgaaaccccgtctctactaaaaacacaaaaattagctgggcgtggtagcgggcgcctgtaatcccagcaactttggaggctgaggcaggagaattgcttgaacctgggaggcggaggttgcagtgagccaagatcacgccaatgcactccagcctgggcaacagagcgagactccctctcaaaaataaataaataaataaataactttaaaaaaaccccatatcgttattacttactattttaacaagaatgtaagtagcaaatttgtttttttttttgagacacagtcttactttgtcacccaggctggagtgcagtggtgcaatctcaactcactgcaacctctgcctcccaggttcaagcaattcctgtgcctcagcctcccaaagcagctggaattacaggtgtgtgccactacacctggctaatttttgtatttttagtagaaaaggggttttgccatgttggccaggctgttctcaaactcctgacctcaagtgatctgcccgcttcagccacccaaagtgctgggattacaggtgtgagccaccatgcccagccttaagtagcaaatctaaatttttattccgtactttcctggacactgggagatataaatatccaaaatgtgcaacatcctttaaaatgcaaccaagtactcatcaaatgtcatgcatgaacttggaacacagccattctataaattttttgtttcttttaagaaacaaggggtcgggcgcggtggctcatgcctgtaatcccagcactttggaaggccaaggcaggcggattacgaggtcaggagatcgagaccatcctggctaacaaggtgaagccccgtctttaccaaaaatacaaaaaattagccaggcgtggtggcaggcgcctgtagtcccagctgctcgggaggctgaggcaggagaatggcgtgaacctggaaggcagagcttgcagtgagctgagatcgcgccactgcactccagcctgggtgacagagcgaagactctgtctcaaaaaaaaaaaaaaaaaaaagaacaagaaaaagaaacagggttggccaggtgcagtggctcacgcctgtaatctcagtactttgggaggccaagtcgggtagatcacgtgaggtgaggagctcaagaccagcctagccaacatggtgaaaccccatctctactaaaaatacaaaaaaattagccgggcatggtggcgtgtgcctataatcccagctactcaggaagctgagtcagtagaattgcttgaacttgggaggtggaggttgaccgagatctcgccactacactccagcgtgggcaacagagccagactccgtctcaaaaaaacaaaaaacaaaataaaaaaaaaacagggtcttgctctattgcccaggctagagtacagtggcatgatcatagctcattacagactgctgggctcaaacaatcctcccacctcagcttcctaagtagctgggactacagagtggctaataagaaaaaaattttttttagagacagggtctccctacattgcacaggccggtcttgaactcctggccacaagcgatcctcctgcctcagcctcccgagtagctggtgtataccactacacttggcttccactctgtaaacaggtacacaccaccacgcttggcttccattttgtaaattttgattccaggtttcaggtacagctctagtaaggttctagcttatcacctctgggtctttttttccctttctgcccatcaaatgaaatactttgaaaactcacttcataattttgttggagagaacagtcatcttctttgctccataatcataagcattctcatttttagactaataaatgtcaatcagaatgaacaatccaggctgagcgtgtggctcttgcctctaatcccagcactctcagaggccgaggcgggtggatcacgaggtcaggagattgagaccatcctggctaaaacggtgaaaccccatctgtaccaaaactacaaaaaattagctgggtgcagtggcacgcacccgtagtcccagctactcgggaggctgaggcaggagaatcgcttgaacccaggaggcagaggttgcagtgagcaaagaccatgccactgcactccagcctgggtaacaagagtgagactctgtctcaaaaaaaaaaaaaaaaaaaaaaaaaaaaaaaaactgattttttttttcatttttacataatttttccttctaaccatctttatacatatacgtaactttggcacctgtccacttacaaactgcatcaactaagttttggtgtacaaatatcttgaaagatgaaagaatactatcatacatctttttggcaaagtgcagtggttttgattgtttttttttttcatttcttaaaaatagaaatggggtctcactatgttgcccaggctggtctcgaacgtctgggctcaagcgatcctcccacctcagcctcccaagaaggtgggattgcaggcatatgccactgcacccagcccagttctgattcttataaaaagaaaatcacattctagctggatgcctatagtgccagttacttgggggaactgaagcaggagaacagcttgagctcaggaatttaaatccagcctgggcaacatagtgagatagatcccatctttaaaaaaaaaaaaaaaaaaaaaaaaattcaccgctgggcatggtggctcacgactgtaatcccagcactttgggaggccaaggcaggtggatcacctgaggttgggagttcaagaccagcctgaccaacatggagaaaccccatcttttactaaaaatacaaaaaattagccaggcatggtggtacatgcctgtaatcccagctacttgggaggctaaggcaggagaatcccttgaacccaggaggcggaggttgcggtgagccgagattgtgccatggcactctagcctgggcaataagagcaaaactctgtctcaaaaaaaaaaaaaaaaaaaaaatcacattctaaactcatctagggtacagtcacatatgtatatgggtggagacagaatcttgctatgttgcccagcctggttttgaagtactgggctcaagtgatcctcccatctcagcctcccgagatgctaggattacaggtgcacgccaccatgcctggctgaagactcttattttacaacttggtttatataactttaccgtcatcctaacagtctagagtactactgtcacacagcattcatctactagttcctctgaaatgtcttctgtagtcagttttcttctctttgccattataggaggaagatgaaaaactatggatttttaaatatgtccaatgaaagcttaaaagttgaaaaatagtataaaaattaccatgtactccttcacctagattctccaaatgttaacatcttacataatgtttaagatggtatctcccaacttcttttatactttcttgaaagatgctgtaggctgggcatgctggctcatgcctggaatcccagcactttgggaggctaaggtgggtggattgtttgagcccaggagttcgagactagcctagacaacatggcgaaacgttctctctacaaaaaaaatacaaaaattagccaggtgtggtggcacatgcctgtagtcccagctacttggagggctgaggtgagattgcttgagtctgggaggcgaaggttgcagtgaactgagattgcgccactgcactccagcctgggtgacagagtgagaccctgtatccaaaaagaaaaaaaaagttgctgtaagttttgggaaaagcaataagaaaactgaagggctgcggtgcacacctatagtcccagctaccgaggatgcttaggagggatgatcacttgagcccagaagtttgaggctgcagagagctatgatcataccactgcccttcggcctgggcaacaaagcgaggccccatctctaaaaactgaagtgtaaaactaatgatttatttcactactgcatatccttttaagcaattctataattctccctttgtcatattattttagtcctctttagcatatttgagaattgatgagtaatgatgaaataattcctaggatgatgaaataccaaaacatttcaatatacaggaaaaataagatcagtaaaactccacaacattgtttcgatgtacaagtggtaatagctaaaatgagtttattcctttggaaaaaaaataaattttcaggctgggcatggtgactcatgcctgtaatcgcagcacttcgagagataagaagtttgaggccagcctggccaatatggtgaaaccccatttctactaaaaatacaaaaattagctgggtatggtggtacacacctgtaatcccagctactcgggaggttgaggcaggagaaccagttgaacccaggaggcggaggttgcagtgagccaagatcgcgctactgcactccagcctggggatggaacaagaccgcatctcaaaaataaaattaaaaataaaaataaattttctctttgctgttttgaagacctccaataaataaaagtcatgaaatatacatctttacaagtagttagtactgctttaaaaaaaaaaagcaaaactcaaaaactaaaattgagtccagaccaggtgcagtggctcaggcctgtaatcccagcactttgggaggccgaggtgggcagactgcttgagcccaggagtttgagaccaatctgggcaatacagacttcggtgacactgatgttacccagacatttcttactactgtaggtagaaaatgaacagaaatttagttaaattcaaaatgtattaataattgttatcaatgttgattttctgatttgatcactgtattgtggttttaaaagatgcacttggggaatctaggtgaagattatagggctattatttgtattatttttgcaactctctttgaagtctaaaattatttccaaagaaaaagttttttaaaaattaagtattaggccaggcatggtggctaacacctgtaatctcagcactttgggtgtctgaggcaggtggattgcttgagtccaggaagaccagcctgagcaacatggtaagaccctatctctatttaatataagaaatataatctttcaaaatatctataaggccaggtgcagtggctcatgcctgtaatcccagcacttcgggaggccaaggcaggtggattgcctgaggccaggagttcaagacaaggctggtcaacgtggtaaaaccctgtctctactaaaaatacaaaaaattagccaggcatggtggtggcgcctgtgatcccagctactcaggaggctgagacaggagaactgcttgaacctgggaaggggagattgcagtgagctgagatcgcgctactgtactccagcctgggcgacagagcgagacactgtctcaaaaaaaaaaaaaaaaaaaaaaaaattagccaggcatggtggtgggtgcctgtaatcccagctactcgggaggctaaggcagaagaatcacttgaacccaggaggtggaggttgcagtgagctgagattgtgccaagccgagattgcaccactgcactccagcctgggagacagagcaaaactccgtctcaaaataaataaataaataaataaatagctgggtgtagtggcgcatgcctgtaatcccagctgctcgggaggctgaggcaggagaatcacttgaagctgggtgtgtgtatgtgtgtgtgtgcaatgagccgagatagtaccactgcactctagcctgggcaacacagtgagaccttgtctcaaaaaaaagaaaaaaaaaaaaaaaaaagaaagaaagaaaagaaaatagagcattacaaagaatagaacttgagatagttcttgaaaggacaggtggaagtgtcactcacatctcacactgcttttatcacattagctcttctgctcccacacaaacatgggcacataacatctttaaccatctatgtatcctctaccatgctcagcatactgctttgtcttgtctgtggtggaaaccaaatcattcattcatgtatacattctctaatatctactgagcacatactatgcaccaggtgttttaggagctggagatacaacggtaaacaaaaatctcttccctcaagaagcttatattttagtgaaagatgacacaatagacaaagtataatatttagaatagtaggcagtgacaggtatcaagaacaaaaggcaaggaagagtttttgaaattgtagataagaatggtcagataatacctactgataaggtaacttctgagtaaaggaagtgagggagctagtcatgcagaaattagtggaggaagccttctaggcagaggggacagcaaccgcaaagaccctcatgtctttgtgagggctcacatgtgcttgacatgttccaaaacagcatgaaggctgggtagctgaagaaaaacgaaagaaggactagtcagaaatgtagtcagagaggtactaggataagggtggcaggcagagggtacatcagatttgttcttacaggtgtttttttattttttgacacagggtctcattttgtcgtcaaggctggggtgcagtggcacagtcatggctcactgcagcctcaagctcctgagctcaagcaatcctcctgcctcagcctctcaagtaactgggactacaggcacgcgccagcatgcttggctaatttttaatttttttatagagacagggtcttgttatgatgcccaagctggtctcaaactcctggactcaaacgatcctcccacttgagctcccaaaatggtgaaattacagacatatccttttttttttcttttgagacagtctcgctctgtcgcccaggctagagtgcagtggcacgatcttggctcactgcaagctccacctcccgggttcacaccattctcctgcctcaacctcccgagtagctgggactacaggtgcgtgtgccaccatgcccggctaactcttttgtattttttttagtggagaccatgttagccaggatggtctcaatctcctgacctcgtgatccgcctgcctcagcctcccaaagtgctggtattacaggcatgggccaccgcgcccagctcattacagacatatctaaataaggactcaggtttaatactcagactgaaatggaaagccactggatggttttaagcagagaagtgacacggtatgacttaggtttcaaaagaatcacttgggttgctatgttgagaacacatttaagagccgcagtaacaaaacaaggagaatagaatccaagctagagatgcacaggcactgactagggcagtggagatgcagatcctaagtggtctaattctggatagtattttgaatataaagcagtaaaatttactgatggaccacatatgaaaaagacacagaagagtcaacaatgtctcttagttatccaagaggagacatcgagtggagaccttgagtgggccactaaacatattagtctatggtagagggagagatccccgttagagtcatcagcattgtttggattttagaaaggtaatatggtacatatactgtatcatctctctctcccagctagggctgagtagctccccataatcaagcagtcacatttctgcatcatgcaggatagcccaggtcaggctgtaccccaaaactagttgtggaactagacttaccaaaaaacaaaaactcttgcatttcagaactgcaaataaaggatgtggacctgcatatcctccaatagcccatatgtcagcaagcctagccctggaggacaccaagaagactcatgaagggtccactgtcatgctgagaaatatgggtaacatacaagcatacaagacaaaaagtgggtagggaaaacaaaagcaaaaggggcaaataagaaatacatcaggtagaaattgccacccatgaccgggcacggtgactcacgtcttaatcctagcacttttgagaggctgaggcagaaggacctcttgagcccaggagttcgagaccagcctgggcaacacagcaggacttcacctctataaaaatataaaaaaaattagccaggtgcgtggtggcacacacctgtagtcccagctacatgggaggctaaggtaggagggtcgcttaagtccagaagatcaacactgcagtgagctgtgatcatgccactgcactccagcctggtgacagagcgagacttcgtctaaaaaaaaaaaaaaaaagacatgagaaaaaaagacattatgcggccgggtgcagtggatcatgcctgtaatcccagtactttgggaggctgaggcgggcggatcacgaggtcaggagtctgcgaccaacctgatcaacatggtgaaaccctgcctctaccaaaagtacaaaacttagccaggcgtgtggtggcgccccagcttcttcttcgtggaggctgaggcaggacaatcgctagaacccgggaggcggaagttgcagtgagctgagattgcaccactgcactccagcctgggagacagagcaggactccatctcaaaaaaaaaaaaaagtctagtgcctaacacagtatctgtgacacagtaagtgctcaataaatatcagcttttatttttcaaggggcgaggaaggtgtattttgaaaaagcatatactatttatttttttaaaggcctacagaaagtaaagcttaacaaactcttggctggtggattgcccagaaaagagagaaagccatgaaaagcactatgctaaactactgaatgccagggatataacctcttaattccagttaaaattcccaggtactaacatctgccatgcacagctctccagtgtcttgtctgctcccactgaagatgtaaaaagaattatacttcaccaggaatcttgtcaaattactacacacctccttccttaaaaaagaaaaaaagtctttctctgtatgtaaattattaaaaccctcttaattacgaagtgccaatctttctaagctatttatctctgaacaaaattatagtatataaaataattatctggagattatgaagcatttatgaaaatgttcctaatacagcaaaaccaggttcttacttgaatccttatagactcttctgtgttccccagtatacagcactgcaaatcatgggaactatatatgtagcccaaattttcctcaatggtcaatcgttctccactatctctctcagtttatggcatcagaaaaaaccacctggattttttgtctccccaccaattctattacagccatcatttgctaaactaaaatgctattgcttttgcaacttccttagcagagaaggtaggacccacctacccttttcacataaatatagcacagggtaccactcaggccctactaaccaaagcacaaatctagaatttcacttcagataattaaccagaggctcatttagacattactgcataaataaacattggttccatgtttatttttctcatgaaaaatgtgaaaaacattgaaataatttctctcaataggaaaagataatgtatcaagtgaaagcaaaaacctcatctaatgtggttctgctatctaaatctgaaatgccctaaggcaactctccaatacaggctggagggcaacgctacagaagtcacatacagaaggctaccctgatccacaattccaccctcctctgaaataaaaagggcaacaacactgtactatgtagagtataaatagaaagtggtctagatggtctaacataagtacataaaataaaaaagaaaagacttttcacctatagttacctaaatagcaaattctttaggaaaccaagtttttttggttgttttttgaggcggagttttgctcctgtcgcccaggctacagtgcaatggcaccatctcggctcactgcaccctcgcctcccgggttcaagtgattctcctgcctcagcctccccagtagctgggattacaggcgcttgccaccacgcccagcttttttttgtatttttagtagaaacagggtttcgccatgtaagcctggctggtctcgaactcctgacctcaagtgatccacctgcctcggcctcccaaagtgctaggattacaggcatgagccaccgcgcccgtccaggaaactaagtttatatagcagaaccatgtgcacaatgaaagcattcaaaaatacaactgtcagagatatcggagtattttattcaaagtctgagttcttaaaaaaaaaaaacaaaccctactttataaacagaccagttttgagattaaaatgtaaatccaaactttcctgttataaatctcagccttgtaaagaggaggagcttccactgccttttcaaggctaacttcgtttaaagtcctaacgcaccgaaacagacgccaagtctactacccaccacccattggctcaaaggaagccccgccccgtacagccacggtaactgaacatcaagggaaccccagggaaggttttccctccgccacatttctagtctctgatgactccctgcccctcccctaccatcaccaccgcggatctagggttccagcaccagccacgcacgctcctacaagaggaccttgggcacttcgccccaatagttacaaccaagaggggagtgggggtgaccatgctcccactctcctggctgcacggtgccagacacgctgcatggagcaaagcggagaaagcagctccggcacagggcccttgtgcccccaggcagaaggcatgacccagccacaagagtaagtcctgacacctccacagctcccagtcggcgggtgcccctccctccccacggagacatagggcggggcagatctaggcgccgagactcccagccagacccgacagcgggctttccctagcacctcctcattgccaaggaggcggaaacccggggcctgggcggggtgcagggggggacggccaaggggagtggcatcacggatcagtacggcccctccggccaaccggatcccaagaaggcggaggaactcagacttcacgccccctccctgccgcgccctgaatctacacgcgggagacccccccctacccctccccgaccccagcaggccagagcgcggccgccagcccgaggccccgcccaccccaggaggaggggagggggtggtcggccgcaaactgcactcagcgcgaagccggccccgcccctttctccacaatcgcacgcgcgcgccggccccgcctctgagcggcggcgcgagagcccgcccccctccgcgcgcaccgggactacgctctcctccccctcccgcgcggagagctaccccgctccgccccccacccccctcacacaaccacacacctcccgcccgtctgctctacgggaagccgaggaggtcagccccccccccccaaaatacacaccctcgagtccggcgttacccgccaccaggctcccgcccggcccccggcccagcgtgctctcaccgcaaagctgcttcggccgctcgtcactgcgtgtccctctcagcgtgagccgcgagctcagcagggaggccccgagaacggcgcggggcacaggcccgccgaagcggactgccagctacctctccactaacgaagcggtcacaggctccggtgcccagactgggaaggagggagggagggagggagggaaactccgaggggggaaggggaggggggaagatggagaaaccgtctccgccgcctctaccgccgcggccgcttctctgttacccgggaaatcccgcccactcccccgaccccgccccgcagagggaagactcagcttcgttccaatacaggacgcaatacccgcccgtcaaagactcagccaaccaccgaggcctgtcttatgattttcccgccccttccccctcgactggtaggggagggggagccgctctccttctccacgcccctattggcggggagcttccctaactcaaccccgcctattggagacggactgctgaagcccacccccgagccccaacactattggaggaagcagggaagctcttcctgtctcattggaggacaccacataacccgccctgcagcgtctcagccacaggcctaacaagttggctcccgcctccgctggtcatcgcattggaaggctacccctggctctcccaccgccccagtaaggtaagtaaccgatgtggggtaaaatgtctgtaagtgaaacaggctccgcctaccgcactgccgggccaggccccgccccaagagtcggattggatatcttggcgctggtaggaccctccattggccagggcgcccgtctaggaaggagctaattccaccctgcgcgaggaggctgaaccttagcagtccttttgtggaatgtttacactagagactgaagctcggagttccagggcccgagataggagggggagcggagctcatcagcggagactccacatcctaggatttgaaggaaaggcagcccaccatggaggactccctcacaaaaaaaatgagagaatgagaactcatccttccgtccagttatctttacagtttacattctacacactgcgtccttgtaaacacaaatatccggagcagctggcaactcctttcagccaagtagagtacagaactaaggtctggagacctaggcggagaagtaaactccctagagctgaatatgcagtcctaagagggcggagataaccaaaagagaggcgggctctaacagccaccgccctggcaagcctccggaaggcggagcgtgaggcacaaggtactcacgatctcccgggtggatctggaggcatcctcagaactgagaaaggagaggaaaacaccaaaacaggccacggcataaattaacattggggacatgccacactcagagaatggataaaatttccgtagttggggacataagataacggctgttcaccttctccttggccgggagtgttaatagcagttcctgtgccctctctgtgtaggtaacagtgcctcgaacacacagtgagacaaagtgctttcaattcctagtttgcttttatttattcaccaaatagggcgtgggcctgacgctgatcttactttggggggcgctctctcagcgccaggagaggtgacgggattacgttgttaccgctctcccgaataagtagaaccctcctcccagagagctaagaccccaagggacacgcccagggaacccacgcctaggtccaacactgtcctccctctgcaatccagcggaaacggccaggaacgagctctggcagcaggtgggcctgactccagcgatggcttcgagccgcgaaaccacagcagcgaattgtgaactccaagggtagccgacaggtgggagcagcctcgccagtagccaagccctgccccaggacagagctctaaaaataagtcagaccaacgaagcgaccccagggccaaactgctcggaggttaggaggaagcggcactccagcagaactgacccacggctacttttaactttgcgccgccttccaccactagactgagtaccacagggcattcccaccatggtatcaagaactactcagaacccaagccagcattaggccgcccacgacttcccgtgaacacagggtaccacctgcgctaagatctcgcctaagggccccaggccagggcactaggttgtcagagtctcagatacagccaactaaggacagccgctgccatgcctaggaaagaacagacacttgcagcgtctgcagagttctcgagcttaagctcagggaagtcaaggggcacggaaatagccaagcgacagggttagaactttagtacttggccccggccccgaaaggcagatctcaaacccagcagaacctccggagtttcgctcccgaaatccactccgcactgtaatcccctggcttcaccccgaaggctactaggtctcgagcctcggtggaacctttgtgtggcttctcggctctccccgcccccctcgccaagggcgccgagcctaggacttccgggcgggagggcagttcgaaggagctaggcgggcctcacacatgtgcggagcgcgctcaagagcggagggaggcggggagcaagggtggacttcccctcccagctctctccgccggaggaggccgggctacccgccccaccaatcagaggcgggggcgggaccttgcgcctcacgtcatccgcaagaaccgtccctcctccctccgcgaaaaaaaaatcctagcaacttaaactccagcccggcctcccgataggcggagctcgggagaatgtcatccaatccacatccaagaaggagaaaaaaagggagtctcgcctagccagtggaagacaagagaaggcggggcctccgggagagccggaggtgggtgggagagaggaaaggggtccgcccctcagctcccctgcaggcgggttgcacaagccgccggcggagtagatagtaaacagtctgggccgaggagtgcaggcaagggccgcccggcgctcggtggactgggcccctgcgccgcctctcccggcgtcgccccgcccggccgggacggttcccgccggcgccccgcctacccgcccgcggccgccatcccggctgacaggcgcgccccccgcgcccctccccgcccgctgatgcatttccttttcccgattccgagcgtggagactgttttcccagtttccgaccttcactgcccctttcaggccaccccctcgtgggcgcgcacacgcccgcgcccccgcccccgccccatccgcgccgagcggtccgcagcagcacctcgcgggaagggggagcccggcggcggcacggtcgggggaggggaagagagcagcagtcgccgccgccgccttggggtgggcggggaagcaggcagctccatgtttgcaaggggatcagccggggccgcggacgaagccgccgagtttctgggggttttccgcaccaccgatgcgagctccttgctgggtcgcggcctgacgggttccggcaccgaatgctgactcgaccgccacggccagggagtttggagacccggcagctcgcagggctagcggcgaggcgcaggggctctttccggtggcctctcccgcccccggccgcccctcccgcaagtccggtgttgcccccgcccccagagtccataacaaccgcgggcccacagtgcccgcgcctctccggagcgcgcccaccgccccctccaagtttgcgggcaaaaacaaaaccctcggggcggctgccgcccttgtccagcgtgggtagccagggaagccgcgggccccggctcgctcgctaactccagctctcgagcaactccgagcgccgcgagctcagtgggccccgccgaccatgctcgagccgccgccccctgccgagcccgcacgccgcagctccggcccggttctagtcggtgtgcggaatcccccttttctttccagtatttttctttttaaaaaaacggcacaacaggagtcgggggtctcctgcccgccccttctccagtccgccgccaaaacctaccgaaaccgactgctcggtgagataaactaggctacacggccggcgcagggacgaccccaggccaggcccacccctctcccacggctccggccaggctgggaaacacacacactggcgagcgggcggcgccaagagctctccttcctggcctgtccctcgcctacctcggccgcggaactccgagcctcccctcagctcggtcccagggcccgcagggcccacaccacgtcgggccggccagaccgagcggccggcggactagccccccaaacgcctgagattggggggaccaaattaaaagcagctgtttaacataccttccgagccaggcgaggagtcctgaatgggggggaacgccccccacgggctattggctccccggcgctcacgtcagtcaccctgggcccgcctccgcccttcgccccgcctcttccccttcattgaacgccccctccttccaaaaaatataaattaattaattaaactaaacgcgagtgggagacgcatccgtggtagaggcccatatagctccctcgccgccgactcgagtttcttgaggtcctcggactggggggaggccgcctgggactcggagatccgctgggtggacgcggaggacgagccagcggagctacccggccccaacttccttcacacacacaacccatttggaactaggtaggagagaagggtaggagcaccctagtcactggctggagtgggcagactcctgtggctgtgtgacctaaccgtgttcggtccgctctgttaggcgactaaaaatgagtgatgcaaacaggaagccctgcgtccgcgggcaacaggcacttgcctgagcacctactgtgggtgaggcagacattcatacgtacctgctgctgggtgcaattacagactggatgacatgcttactctacccctccaagggctccagattcagccgaggagattctacgtaaggaactaaggcaaggcaggaatgtgtatgaaaataggaatgtgtatgtaaataggagctcagagaagagagattccttttcgctgaaggagaattgggaaaggtttcatgaaggaggtggcattcaagttgggtcttaaagatttcatccagcaaattggaggggcaggtcattttcatcaaaggacacaaaggggtgaatgcaaaaaaggaccttcatatgtggctgtagtaataaaaaaggaggggtggggagatggaacaaacagtttaagacttttagttgagtaaaattcttggacgtgcgcagcagaatgtgcaggcagcacggtcacaaggcccacagacccagaactatagtgtaagatgtttggcaccctggcagaaagatgggttctgacgatgcactgagagagaagtgcctataggcagcaaggggaggcccagaggctgttgtaatactgcgtttggagactgcagaagtgcctcttgtggaaggaatagctggggaaagagaaggcttcttttctctatcaaagccacccaatccgaaagctttccccaccttcagcagccctcaagtcaaagctttgactcagatccttccttgcctcatttgctttatttatcataacttctaaccaaaaggagtttctaggggacagaagccaccccacatgtctgtattccagagagctgagcctagagccagagcacacaatgtgaaacaaacaaaaaaacctgtttgttgaggcattgaggaaaggaagttaatgtggataaggtggggtgtgcagaatgtgaaggaccttggcatccaatgggcagaatgagggcctgctgccagttaggaaattattgggaagtctttcccaataattcaggagacacgaaaggaggattgaccagaacagtgacagtgggtgaaaagaattttatttttttttgagacaaagtctcactctctcacccaggctggagtgcaatagcatggtctcggctgactgcaacctccgcctcccaggttcaagcgattctcccgcctcagcctcccgagtagctgggactacaggctacaggcgtgtgccaccacacccggctaatttttgtatttttagtacagatggggtttcactatgttggccaggttggtctccaactcctgaccttgtgatccacccgcctctgcctcccaaagtgctgagattataggcgtgagccaccgcgcccagccggtgagaagaatattgaaggagagcctgtatttgagaaagactcaaggggagtaggtgagtgattcagtgtgggtagtagagggaaagaagtagcctgtggcctgctgtgtgaagagttgatagagcttgaggctactagttaggtaatctgagttctgcacttagcatggtcagcaactggtgttatagtcttaggcaagtctcttcctccctctgagcctcagtttccctgtgaaatggggttggaaattggaatagaaagatagactcggctggacgtggtggctcacacctgtaatcccagcactttgggaggccaaggtgggcggatcacaaggttaggagatcaagaccatcctggctaacacagtgaaaccctgtctctactaaaaaatacaaaaaattagccaggcgtggtggtgggcgcctgtagtcccagctacttgggaggctgaggcaggagaatagcgtgaacttgggaggcggagcttgcagtgagccaagatcacgccactgcactccagcctgggcgtcagagacagactccgtctcaaaaaaaaaaaaaagaaaaagaaaaaagaaaaaaagatagactctaaggacctcacataggatccaggtgggggaagcttaccactgaggagacagggtaggtgggaagaactactgattttggaagggcagtgggtcaccccaactggagtctggagactggaaaataggcagtagctcagtcaattgaatcactgggtgaaaagtatggagagggaaaggccaggagataaggactatgtgttcagcaggaggcccaccctggcagagccatggagtttgaggttcatcctccctagggtgaggaccaagtttttcttcagaacagagatcccagctgggcaacagagcaagaccctgtctctacaaaatatttaaaaattagctgtgcgtgggctgggcgctgtggctcgtgcctgtaatcccaagactttgggaggccaatcacctgaggtcaggatcacctgaaggcggatcacctgaggccaggagttcgagactagcctggccaacatgaagaaaccccatctctactaaaaatacaaaaaaattagcagggcatggtggtgggcacctgtaatcccagctactcgggaggctgaggcaggagaatcacttgaacccaggaggtggaggttgtagtgagctgagattgcaccactgcactccagcctgggcgataagagtgaaactccatctcaaaaaaaaaaaattagctgtgtgtggttgcatgtgcctacagtccgagctactcgggaggctgaggcaggagaatcgcttgatcctgggaggtggaggttgcagtgaaccgagatcacatcactgcactccagcctgggtgacaagagcaaaactttgtctcaaaaaaaaaaaaaaattagctgtccatggtggcaacatgcctacagtcccagctagttgggaggctgaggcaggagaattgtttgaacctgggaggcggaggttgcagtgagcctagatcgcgccacttcactccagcctgggcagaagagtgaaactctttgagagttttttttgagacagagtctcaaaaagaacccagtcgggtgcagtgcctcacacctgtaatcctagtactttgggaggcccaggtggttggatcacctgaggtcaggagtccaagaccagcctggctaacatggcaaaaccccgtctctactaaaaatagaaaaattagctgggcgtggtagtgggcgcctataatcccagctactcaggaggctgaggcaggagaatcacttgaacccgggaggcagaagttgcaatgagccgagatcatgccatctcactccagcctgggtggggaagagtgaaactccatctcaaagaaaaaaaaaaaaaaaaagaaccaatcccctgatggctggatccccatctcaaattcctgctctatttcttaatttcttaaggggctctagctgaaggcataacagatactgtgtcaaagtgagatgaggcagattggtggagcagaaagaactagtctggaagttgagtcccctggttcccacttagtcccttcttatctgtggatcagcttcctctcctatataagaggataacatagcaatccttgccctgttatgaggatcaaatgtgatgataaagtgtgctttatcacctggtaaggttctgagctgctgtggaagccaaagacccagcatttgacagtgatactaggcagcacgtgttgtgctgtggatgcagttactcatggaggatttgcaactgcaacagttacctccactcagagaaccaggctttgctgacactgcccatggtcctatgtgtgccaccctggtggagacctcctcctgaacacttggcagactgagtttcttgaggacagacacttcgatgcacctctgagtccccagagctcactgcagtcagatacagggggccctttggaaggggtccagtgatggtttctcactcagtatgttgacacctggacagcacggcaagtcccacattctttgggaaagagaacgcttgatttggtgacattgtccctccagctgccagctgcactgagggattacatccatgctactcccctgactaccctatcagtgaagacaaaactaagtggactttgtgaaccaactggtataggtaaaaataataataatgataataattaaaataaaattaagtggatttgggtaagggccctcctaggagaaatcacactggtaggtcaggttctgattcctggaggcccgttttatgtgaaaagtctcatagaccagcctgggcaacacagtgagactgtctctacaaaaaataaaaacaaatttagttgggcatggtggcatgtccctgtggtcccagctactcaagaggctgaggcaggaaggtcacctgagcctgggaggttgagactgctgttagctgtaatcacaccgctgcacttgagcctgggagacagagcaagaccctgtctcaaacaacaacaacaacaaattcttgtagagtttgtgagttagggattattatccttagttatagatgagcaaactgaggctaacagcagtagagtgacttgctcaagtcaaatagcttaagggaagtctgggtccaaagtctaagctttgcctccactcccacacgctgtctttgtgcactccggccagtgacccaggttggggcctggagaaaaacagcctgactcccctgttgctccacactcctcacctccctaacttaaagatcagtttatcctcagacaattctaaatgatttctggccgtttccagaaaattatccagaaaagcaacatttgtctgatgcacatacatacatacatacacagaagacctaaactcgcaacacataaactcaaatctatcacacctcctgacaccctcaatctcacaggtgtctcacatacaccctctctctttcacaaaaaggactcattcaaagttctttagggcacttatggtaggtggtgactgagagacatttagggcctgcacttcagtgactctgccaaggatatcagtgccagcaccctatccacacaagctctgagggctaagactctcagtaatatccaggtaaggaggatatgaggctggctccccagggacccacaacccaaagcatcttctaggttcaaggcaagatgattttggcaaatcatttatcttttcagtttctttatctgtaatctaagaatcagaatacctacttcggtgggaagatgtgagatttaaaattaagtatgcctgccgggcgtggtggctcacgcctgtaatcccaacactttggatcacgaagtcagatcaagactatcctggctaacacagtgaaaccccgtctctactaaaaatacaaaaaaattagccgggcatggtggcacgcgcctgtagtcccagctacttgggaggctgaggcaggagaatcacttgagccggggagccggaggttgcagtgatccgagatcatgccactgcactccagcctgggcgacagagactctgtctcaaaaaaaaaaaaaaaaaattaagtatccctagcattcagtcaagagttctcatatctttttcccctcctttatctcatccctacctccctcttctcctggccattcaaatgcaaagtccgattgagcaatgagccctggagcaggcctagagggccaaataatcccatgatgtgaagaaactccatttctcttgcaaccaggtttagatggtatatattccgtaatttctgatttctgggtggccttggaggctcggaattttttttttttctttgagacggagtctcgctctgtcatccaggctggagtgcagtggcgcgatctcagctcactgcaagctcagcttcccggtttcacgccattctcctgggaggctcggaatgtttgaaggaatttttatgactgctactcactgccttgaaatgtttcccctggctgagcattagtttacccttctgggtcactcagcatgttcctcagtttacctggctttatgttttcaaagtgtttccttctctttaccagttgtttggtggcttttttttttttttttttgagacagagtttcgctcttcttgcccaggctggagtgcaatggcgcgatctccgctcaccgaaacctccgtctcctgggttcaagcgattcttctgcctcaacctccccagtagctaggattacaggcttgcgccaccatacccggctaattttgtatttttaggagagatggggtttctctgtgttggtcaggctggtctcaaactcccgacctcaagtgatccacccgccttggcctcccaaggtgctgggattacaggtgtgagccactgcgcctggcctgacgtttttttttttttttttaaagcaacgagttcctttgttactgctttttaaaaatagaatagcttgccatttgagaatttattatttttatttatttttttagagacggggttttgccatgttgctcaggttggtctgaaactcctggcctcaagtgatcctcccaccttagccccccaaagcactgggattacaggcctgagccactgcacccagcaaggtcctttgttcaaagaaaatcttattcagaagcctaatgtgtaagagatcaaggtgggccttgttttggtttaagtgaggacagcctgggcactgcagtctattccttcacatctctctcatgcagcctccctaacagccacatagtcccttcgaagacttctaatgaacccacatttcagatcttgttcattcgtcccagccactacctacctctcagcagcctgtgacaaagcagcctggctttgtgctcagttacctctgcctgttcattagtatccttcagcagcttttcttcctccgcccattacctaaatgttggtgacatccaaacgtatctcctctcttgccttcctcattctcacttcaaggctcattgcttctgtctaactaagtcctaaactgacatctccagaccagtatctgccctgcacatcagactccagacttccactggatgctggccacagaaaattttttattaaaaatacattttttcacagaagaaaattcattaaaagtcaagaaagagcccccagatgaaatggctgacctttactcaggtgcacatctggccagtcttgaggctttaagacaaactacgcagcagcattagagaagtagtagattataatgtgcggggaggggagacggacgtgagcctggagtctgagaggggcactgtaccgttttttccaacacccccagctaggattctagtggagttagctatgtccaccatggccttagcctgaaaaatatgggcatttaagacttcagcaggccacatttagctcaaacaggaggattttatgacagccaaggtaaagaagggagatttaaacattgtaacaggtttcaaggtgctagattttttttcccccaagaaaacatctccaagtaaaagtgatatatttctatttgtggagaagatcctagtcttctctgtagtcaattatgaacagtgcagtctagaacacttgatattcacaagtgttgtgtaaaggtaactatagggcggatacctcctaagagaaaaagatggttcccaggctgatgggcatttccattcctgcccttggtaggctcacagtggtttgtgggagtaaccaaggccagagagaaatctaaggactaggttgggagctataggacccttggtctgttcatgctttgcctctgagaaaccctgtagaccccacattaagaaacagggaaactttaaaggcctataggctggtcttggagatgacagagacctgacctgcttttcctccaattggaaggccaagggggaagagaactgagggaagctagggaagtagcagcagcttgaaagaagagactctgaaaacacactaaaactggagaggctgggtgtggtggcccatgcctgtaatcctctcactttgggaggccgaggcaggaggattgcttgaggctggagttcgagaccagcctgggcaacatagtgagatcctgtctctagagagagagagagaaaaaaaaaaaaagctgggttcctgcttgagcccagttgttgagactgcagtgagccatgatcatgccactcccctctaacctaggcaacagagtgagactctgtctctgaaagtaaaaaaaatgaaaagtggggagtgctagtgggagccaactcaacccaagtaaaggcctaatagctcctctatgggtgtttgcactgtctaacaaagaactggaccctgacagtcagaggacccatggtaggatcatctagtgtagccccttcttttacagagggaacctaggacttgggtttggttcagtggtaagacctcaaaaccacaaaagagctgggtcactctagagaagcttttctacttggccaatgcctcttggcccaattccctctaggtctctgatttataaaagtttttgtatgtgtgtctgtctgtcccaagagacaggaagcattcctttcagggaaggaaccaaatttccctagggctatgatgctaaatagtccattctcccaagaacaagtcctactctgtcatttacctgcatactgtcacatgaagactgataagggtgggcctccgaggctgaggatgctggggcacccttcgtctcaggagtcccatcctagccaatgaggatgggcaagatgaagggagcaatgggaaaaaggacacagggattatctcatgtttgaaaaattatatagcatgggaatgttagagaaaggtgaaacaaacagccatcaaatcagaagcagaagcctgctttagctcagtgttttcttctttcctgaacactgtctttcttttttatttatttattttttttgagatggagttttactcttgttgcccaggctagagtgcaatggcgcgatctcggctcattgcaacctctgcctcccagattcaagtgattctcccatttcagcctcccgagtagctgggattacaagcacataccaccacacccgggtaatttttatatttttagtagagatggggtttcatcatattggtcaggctggtctcaaactcctgacctcaggtgatctgcccacctcggccttccaaagtactgggattacaggcataaagccactgcacttggaccctgagcattttctcttgctttgttcactaagtctcctgtatgagaaccctgacttgccaaacagattctgggttgcgtctctgccttccctttcctttacctcctcctttaacacctaacacaggtaggttcacgctggtaaaagctacaaacaatggcagtgggaggagttcctctgagttttactgaaaatttaggagacatcaatttgttaactctctatagggtcagaaacatgaactaaatctatggttcccaaacctggataatcctgtcactcactaacaacctactggatgggcccagaaatcagcattttatggagctgaagtgatagataacctcaccagtcttcagatatgcaatgaggaactcatgcataaccttaaattcacagggcagtcgggttacagcctcttcaaataaatgacaatttaaagttacctcctccaggccgtttatcattaatcccatttcttacatgttccaccaaacccctgacctctctggtttctcagatttccaagaatctctgttcacttcttatgtttgtgcactcccaagagaatggaggctcatctggagaaggaactagattaatcttctgctctacacttgagctcctgattatggtaagaaactcgataaaaatttattggcagatcagaagatggatccttagaggaagtctagtgtaagaggtgaaagaagatactttggagtcagatggtctgggatcctggctgtagcaaattaacattcctgtctctcaatttttttcttctgtcaatacctacctcaaaaggttgttgagggtgaatgagatgatacctagaaattactctgaacagtgcctggaatagagtgagcatccagtaaattggctgctatgactattattaagaacaccccaatatttcccagccacaactgccccaactgggcaggccatcaacagccaacaggtatgatatggggagtggtcttccatgtacaaagcttctggttcctttctttctaagagataaatgcaaatgactcaagatcttctcacaaagaccatgtacccatagatatggagtctcctggggagaatgataacccctttggtacgctgcagacatgaggaccctacatcaggaggtcctagctaggacagtcagtcaccaaccctgtcacccttcgcgtctactacatgaagcatgggcacaagaacaacaacctggaatttaagaactttttttactctgaaaggagagctaaacaaacctctgttctccaaacacaagatctccatcttccatgcagtgaagagaccacaggctttgtaagcagaccaacttgagctcgttttagagcaaatcactgtaaccctctggacctcaccttcctcatctatatagaaatgagaaaggggtgcacaggagaagggagagaagataatatctcactgaattgttgtgaggtttgaatgaggcagggtgggggaaaagcacctagcatagtgcttagcacatctcaagcactgaactggtgctggtccctctgtccagagatagggccatggcctacagacaaggtgaactcatagtgtcagaactcaaagtctcagatactgaaggcttgggtccctccctgcctccctcatccctcccagaccagctcctggaccccctccctcatgtcccaggctgctaaattgatgaagctaaaagggttttgatcatgtcggtatatttatatgtaaatacaaaactgtatcactgtaagatattgaatatgaacattacaattattttctgaatcagactcagtccattgatattaaatacaaaatgaaatgattgtaaaaaataataatatacacattcaaagagcttattacagtataaaattattgaggtctgatcagctgccaacctcatcttctgtcacaggggaaggtttaggagttcctgggattttttgggaatgtggagtgctgaggactcttgatttatccctagcacataaggatgagtgggctgggagcaggcagggacaggttgggtgggtaggggacaaacagtgattgcaggggaccacctcactcagccagggggtgaagctttttattgacacagaacccacccagtttgagggtctagcaggctagcaggcaggaagagatgggcatctcggtagacagggccaagctgcataaaggaaccatccagcaaaagaaaaagggccccagctcatcctcccagggaggtattttcttagtggttttttctttctcatacctgggctccccctccttccttctaagattcgtaccgattgcatttggctctggctgctcagtgagttcatctctaccctccgcctcccatccctgggatagtgaaagcaaagagagagtatggaatcacagtggaggtctgttccccaaattggccaagtaaatgtagaaaaatcatcggataagggaaatccatgctgagctaacccagtgtcaccacaaactaatacattcttggctccaacaggtggcaactggaaggagataagtcattacttaaggaaggggccctgtggcaggaacatggaggagatgtgtgtgtgtcctcttccaccactctgtagcctgacaagaggagacatgatcaccaacccaagctagtccaggataaatagtagggtccaagaagcaaggagtcctgaactgcaacacggagccccaggaacttctggaaaggagtatcgtgtgtatatgtatttatagaatacgatcatattatcacatacaatatatattatatacacacgtacatatggacccatacacataagtgcacacacacacacacacagaatgacagaaaggactggaatacacgccctacttataaacgtgcttggcactcaggacgatctctagaatatgtaacttggtcaagctctctggggagaaaggcaaatgctcatcaaacctccccataaaatcctaggaaagggaaggagtgggagacaggagacctcagaaaaagaatggcgggagaaaggaggagggaggttccttccccacttacctcggggaccctagcaaaaatcaatagccacaatttggttttaataaggcacagtttgatagcagatgctaggaattaagaacacattgctactggccctttctagtggcaatttcaccacatttatctagccaaagggaaaggctgccttgcgtgcacacgtgtgctgggagacacaagaaagaagttgatccatggcttcagcgtaactgatggcaacctataggctcagcggtgtccagggtagtttaaggaaggctggccaacaggtaggaggttcgtaggagagttactgactctccacggccagcaggttttggccagaggataccatgccctccttctctgcgaactccaggatggccttgtagcaaaaatagtactgctcaggggtctggatgctgaaggccctctgggtcctcatgcgtgacaccgtctggaacacattaagggtgccaagctcctccagctgtgccaggcagatgtccagtgagcagaaggtacctgaagaaggaaggaagtgatcacatctggtttacctctcttctcttcctccctctaccaaataacccaggcagaactgaatgaatgacttcacaggcaaagtgcctcatggcagaaggccaggtggccttaggcctgaaaggactcaagaaggaggtcacagggagtgttggaggccagagaaatgagaaggcctcttatttctcaggacatacacttggggtaacaggaagtggaaatgggaaggtgacacaggggaacttcctgcttcaatcccagacagacagactgacagcactcccacacctaatttccagagtccacaagtttttcagaggcctaacaaaaacctattctcaactttctcccaaagggacctttgaaatagaaaggccaacatttcctaccatgtacatgcccttaaggcaaaagctgctaactggctccagaatggagaacacagcacagggtggggagtccctccagggagggctggatgggaaggaagcagcagcccagctgagctctctgggatacctgcagtgacagttctaacaggtgacagagtcagcgttatgatggggtgtataaaacatcaacccctagaggacttggcttgtgaaatatatattctggccatcacttggtccaccaaaaggacattagatgagggatttttcacagcaattcaccaccaagggagcaagtgagttccttctccaatcacagatgtgggctaagagctttgtttttcctcgtccacccctactgcccctgcagacaccaagagctgcattaggtgcgttacctgtcctgccaatgcctgcactgcaatggaccacaatgggtggctcagggcactgccctttggagcgtgctcccatgttgctcacagccagactctgctggtttctgaccactctcaagaagtcaatgagggaagctgctgaggaagggacaccatagtctggccagctcaagaactggaagtgggtcacctggcgtttctgccgttccttagataagaaaagaagtaaacgttaacaaggttatttctgcctgcccctagctacctctggcttttccagattctcaacaccctggttatccctaccaccaaggctcctatccaccactgtcaacttttcccataattgcttctttactacaaacccaaaggaagggttggttaattggaaaaggcagaattcctatactgtaagatccagaattttttttgagacaggatctcactctgttgcccaggttggagtgcagtggcacgatcaaacttactgctgccttgacctcacaggcttgtgccaccatgcccagctaatttgttctatgttttgtagagacaggatctcactgtgttgcctagattatcttgaactcctgggctcaagtgatccttccacctctgcctcccagagtgctgggattataggcctaagccattgcacccagccccagatttctaaaattataagctttactcctatttaatgttcctatcgtgctgcagtaatatggctatattggctgtgagttaaatatcctcatcctgtccctagaaaaacagaagcaactcataacttccctggtatcctacctattccctctggagattttcattacagtaattattctccccctgtttcaacaaggtgagaaaaaagaaacctggatttacctctgtgttgtgaatttctagcgttgttttcttataatgattcatgttctccacgcctagattggtcactgtgaggaagccaaatcggatccgagagtctttttctaaaggccagtactggccacactttctcctgccgccttcctcaaagctgaagacacacagagcaaggtaagccttccatcgttcctctccacagcagtaacctggcttccccaaagacctgatatacccccaggcagcaatatcatctcttgcattgcttctaacttacaccattgattctcagcagaaaggaaaggaaacctcttcattctaaacaaatgtactcacagctaaagtttctgcatgtactcatatagcagacagttactgagcacttactacagcatttggtctttttcctaatacgcaatagtacgtctcacatatgtgggataaatactgggtgaacagagacaaaaacagtatagtagctgggtatagtggtgcatgcctgtaatcccagctacttgggaggtttaggcaggagaatcacctaagaccaggagtttgagaccagcctgggtaacatcatgagactccatctcaaaaaagaaaaagaaaaagaaaaaaaaagagtagagaaaatatgaaaatatgataggtcagagagaactctctgataaactgataaacacacatctactggtatgttagcaggaggtttgtgtaaaagcctgaagtcccagcccaggcaacatggaaaccctatctctactaaaaatacaaaaattagtcaggcatggtggtgggtacctgtagtcccagctacttaggaggctgaggtaggaggattgcttgaatccaggaggttgagactgcagtgagctgagatggcaccactgcactccagcctggatgacaaagtgagactctgtctcaaaaaagaaaaaaaaaaaaaaaaaaggcctaggccaggcgcagtgactcatgcctgtaattccagcactttaggaggccaaggtggcggatcacctgaggtcaggagttcgagactagcctggccaacacggtgaaaccccatctctactaaaaatacaaaaattagccaggcatggtggtgggcacctgtaatcccagctacttgggaggctgaggcagaatagcttcaacctgggaggcggaggttgcagtgagctgagatcgcaccacttaaggttgcagtgagctgagatcgcaccacttaactccagcctgcacaatagagtgagactcttgtctcaaaaaaaaaaggcctaaatctaccttgccaccctccagtggccccaaagtattccaaggtagaacttctcccactacctcctctccaaataagtggtggttataacagtgctaaggaagggaatttaacattcacattcatttttttccttcctcatctgaaataggttattccttaaatttgccagatttgtagaccaaaatttcaaaaatattcctttcattaaaatcttccggccaggcgcggtggctcacgcctgtaatcccagcactttgggaggccgaggcaggcggatcacgaggtcaggagatcgagcccatcctggctaacacggtgaaaccccttctctactaaaaatacaaaaaattagccgggcgaggtggcgggcgcctgaagtcccagctactcgggaggctgaggcaggagaatggcgtgaaccccggtgggggcagagcctgtagtgagctgagattgcgccactgcactccagcctgggcgacagtgagactccgtctcaaaaataaaataaaataaaataaaataaaataaaaataaaataaaatcttcctggccaggcgcagtggcccacgcttgtaatcccagcactttgggaggctgaggcaacagatcacgaggtcaggagttcaagaccagcctgaccaacatggtaaaaccccatctctactaaaaatccaaaaattagctgggcatggtggcacgttcctataatctcagctactcaggagaatcacttgaacccaggaggcaagggttgcggtgaactgagatcgagccattgtactcccacctgggtgacagagcaagacaccatctccaaaaaaaaaaaaaaagatattagccaggcgtggtggcacatgcccgtaatcctagctattcgggaggctgaggcaggagaattgcttgaacctgggagacggaagttacagtgagccaagatcgtgccacactgcactccagcctggtggcagagtgagactccatctcagaagaaaaaaaaaaaaagtagcaacaaatggagagcaaagggaatctggtaattcaggagtcaggaaggcagcacccctctggaaatagggaacagataaaaggagaattgtcccatgtttcccagaacttcctttagtggataaggccaggacctcaaaatagggtataactggcacagggttgccagagccagggattaaagctttaacaagttagatctattcatctccaccatacccgggttgtggattagctaagagatatctcaaaatctttgccctggctttcctaatcctcaatttttttttttttaattgagacagagtctcgctctgtagcccaggctggagtgcaatggcgtgatctcagctcactgcaacctctgcctcctgggttcaagtgattctcctgcctcagcctcccaagtagctgggattacaggcacgcaccacaatgcccggctaattttttgtatttttaatagagaaggcaccatgcccggctaattttttgtatttttaatagagacggggtttcaccaggctggccaggctagtctggaactcctgaccttgtgatccgcctgccttggcctccctaagtgctgggattacaggcgtgagccaccgtgccaggctgaccctcattatttctaaaagctaaacttccctctttaatcacccatgcctagggacagagtggaggtggagacctttggaaaaaagggattaactcaccgggtggtcatgacaatcaccaagactttttgctcccataccatgagccagaaatcacgataggtattctccaaaggacctgaaataaaaggagaagacaagaaacatgactctgggaaacactttttttcttttgtaggcgcttctgttttactccccaatggtaactccaaaccatagatggttagctccctgctcatctttccacatccctgctattcagtatagtccgtggaccaatcacaccagcatcgtatgggagagtgtaagaaacatgaatctgcatgtcaacgagatccccaggtgagtcgtaggtaggtttgggaagcactgctacataccctctcagagtcttaatcatcagaacttcagccatcacatccaggctgacagtgtcaaactgtaagaatctctagctgttttcatctcacctaagcttcagttttataatcacagattgcttactaaaccattaaccttctgtttcccataatctcagatccattatgtctgtaactaagtctcctccttcaaaattagctttatcttggccgggtgcagtggctcatgcctataatcccagcactttgggaggccatggcaggcaggttgcctgagctcaagagtttgagatcagcctggcaacatggtaaaaccccatctctatgaaaaatacaaaaattagccaggtgtggtggcacatgcctgtagtctcaggtacttgggaggctgaggcacaagaattgcttgaccccgggaggtggaggttgcagtgagccaagagcgcaccactgcactccagcctgggcaacagaacgagactctgtctcaaaaaaaaaaaaaattagctttatcttgcaactttcttatctctgttaacaatactagcattcttaaatcattcagtcttaaaaaggtgaagtcaacactgacttacccatttccttcatctcccagaagcagtcagtcaccaaatcctagagattttttacctttgaaatgtttttggtttttattcttttgccctcatcttctccccatcctgttcttcctgctcgatttcactgacacaaagaccacgtcatcttctaagttactgtaacaccctcttagtctacttttttgaataggcctttttcccttccaatctactctgggaaaccccaccagtttaatctttcttaaaaattacttcatcagaacatagacacaccatgctcactttggcctctattctttcgctcaagctgtctccgtcacctccaatgctattcattttctacccattttcaagtgccacctcttccttgaagctttctctgaccaccgcattccttgtgaagcttcttctcttttgcttttgatggcacagctggatctatacaggttgaccatttaatttatatactcttccatccattattttactttgtgggaattaatgatatctcactaaacatggtcctaaggacaaaggattacaggtgtgagccactgcacctggccaaattctcctttgcacagggctgagcactcagggctgagcactcagcaataactttgaagatacttgtgggctaccaactccactttgatcaagacagtaaccggccggcggcagggctcacacctgtaatcccaacactttgggaggccgaggcaggtggatcacttgaggtcaggagtccgagaccagcctggccaacatggtaaaaccccgtctctactaaaaatatgaaaattagctgggcacgatggcaggtgcctgtaatcccagctactcgggagcctgagttaggagaattgtttgaacccaggaggcggaggttgcattaattgcattaaaccaagatcgcaccattgaactccggcctgggcgacagcaagactccatctcaagaaaaaaaaaacgtaacaactcaagataattccttatactttctgggtgtttctttcctctctgctttcaggaaagcagggcagtactaatggttaattttggtctagaagtctgctggttctactacccttattgctaagtcttttagcaagcactaacatgatactggaataccctctctgcagaagtggatgatgtcaaaaacgtgagatcttagaaatacactaaatatccaataagagaggattaattaaattatgacgtatcaggtggggtgcagtggcgcacgcctgtaatcccagcactttgggaggatgaggcaggcagatcacttgagcccagaagtttgagaccaacctgggcaacattgcaaaaccctgtccctacaaaaaatacaaaaactagccaggtgtagtagcacatgcctgtagtcccagctactcaggagactgaggtgagaggatcacctgtgtgtgcctggagaggccaaggctgcattgagccatgatcgtgaaccatgatcataccactctgtcacccagcctaggtgacagagtgagaccctgtctcaaaaataaataaataaataatagcataccataatttatacagtctataaagttgatgttgtaagagctgtattttttgctatggaaaggtattcacagataccattaaatgaaacaagagatagtatagaaagagcacatttggttaaattaaaagtttagttttgttttttttgagaccgagtatcactctgtcgcccaggctggagtgcagtggcgtgatctcagctcactgaaacctctgcctgccgcgttcaagcgattctcctacctcagcctcctgagtagctgggattacaggcatgcaccactacgctcggctactttttgtagttttagtagagagggggtttcatcatgttggccaggctggtttcaaatacctgacctcaagtgatctgcccgccttggcctcccaaagtgctgggattacaggcttgagccaccgtgcccggcctggttaaatattttgtatgcctatatctgcatgtatgcatagataaaggtctaggaggagatgctgtaaaatgttaacattatctctgggtcctagggttatgagggattatttttgttttctaaatgttctacaatggacatgcattaccctagtatacacatcaagaagacagtaaggacaccttttccacatctctgaccctcagcctcatccacatcctactctcctgcaccacagcaactctcatatacttcattttccacattcagaccactggcagaattggagtactgagcagtcagagcatatggtaactcagttaccagactggggctgggcaaacttctcacaggctcaagagagatactaagaagggaaagttgtacttcccagcttagaccctttaacagtaaacttctctcaagaaataaagtcagcagtttatactgacataggtgaaacaatccacagacatggcttgtaaaaacttctgaaccaaacaaacatgggttcaaaccctggttctgccacttactagctgcatggtccaaggtcacgtaaacttttgggtttcagtttgctcatctataaattaataaacctcccttgcagagtctctataataattagatagcatttatgcatctgatatataataggtcttctcaatagatgacatcattaatagaaatataggccaggcgtagtggctgatgcttgtaatcccagcactttgggaggccgaggtaggcagatcacttcaggccgggagttcgagaccagcctaggcaacatggtgaaaccctgtctctaccaaaaatacaaaaattagccaggcatggtggcaggtgcctgtaatcccagctacttgggaggctgaggcaggagactcgcttgagccctggaagtggaaggtgcagtgagccaagatcatgtcactgcactccagcctgggcgacagagcgaaactccatctcaaaacttaattaattaattaattaaaaataaagaagttgcagacattatgatattttattcctaaatacttgagcacttactaggaaaacaaggacctcctcctatagaacattaccattatcaccttaagcatacattaaacatggatacaatgttggctaaaaaaaatctccaattgtctcaatagtttgtcttcaatagatttttttctcccagttgaggatctaatcagatactctttttttttctttttttttttttttgagacagagccttcctctgtcgcccaggctggagtgcaatggcgcagtcgcagtccactgcaacctctgcctcccaggttcaagcaattctcctgcctcagcctcccgaatagttgggactacaggcacccaccaccacacctagctaatttttgtatttttagtagagacggtgtttcaccatattggccaggctggtttggaactcctgaccttgtgatccgcctgcctcggcctcccaaagtgctgggattacaggcatgaaccaccacgcctggccgatcctctttttttttttctttttgagcgcaatctctgctcgctgcaacctccgcctcctgggttcaagcgattctcctgcctcagcctcccaagtagctgggattacaggcatgtgccaccacgcccggctaattttgtatgtttagtagaaacgtggtttctccatgttggtcaggctggtctcgaacttccaacctcagtttatccacctgcctcggcctcccaaagtgctgggattacaggtgtgagccattgtgactggccctttaatttatttatttttgagacaggatcttgctgtgtcagccaggctggagtgcagtggcacgatctcggctcagagcaacctctgcttcctgggctcaagtgatactcccccctcagcctcccaaagtactggagttacaggcgtgagccactgtgcctggccatggttctctttagtctccctttaatctagaacagttctctgcctttttgttttttatggcattaactttggagagtctgagccagttttcttatagtatgtcccacaatctggattgtttcccatgactagattcagattttaaaactggcaatacacaatgcaggtgatattcatttctcaatgcatcatatcaggaggtgtacataatgtccctttgtcctttactggtgatactaagtttgatcacttgattaaggaggtatccaccgtatcttgctctgcagtggtcaaagggccttacgcccatctgatggtctgttgtctttctgtattatgatttcctcctaccatctttgaaagtgacatgatattcttgagatggagaggccaggtcaggaagagtactaggatcataggaacatttatagaaactccacctgaaatcctcctagaggctgggcatggtggctcacgcctgtaatcccaacactttgggaggccgaagcgggcagatcacgaggtcaggagttcgagaccagcctgtccaacatggtgaaacccagtctctactaaaaatacaaaaattagccgggcgtggtggcacacacctgtagtcccagatactcaggaggctgaggcaggagaatcacttgaacccgggaggtggaggttgcagtgagtggaggtcgtaccactgcacaatagcctgggcgacacagcaagcctccatttcaaaggagaaaaaaaaatgagaaatcctcctagagctcagtattccactgtcagacttattagcacatactatctatgtcagaacatttgctggagtgctctgtgatggtataggaaccagcctaggcctattaggacagcaatactcattcctagattggactcaatctctgggaagtccactgctattcttggcctctcactagacaggaagagcatgaagagctcactggctgatgcattctgatgccctacacccttgccaatactaagaaatagccccaaaacttgcaggcagtagtgttatgtgtttaaatctccagtttatctctatgcggtgagtttccaggcacacctggtacagaaaccccaaactacttatttgcttttctcaaccaccacccatctttataaaaggccaggatctagtggccaaaacctccactcaagttaccattcgtttaaaaattatgctatcatttggcacaaggaatcataagtagatggcacaaaatcaacatgggagggacggaccagcttaccttgtgtgccaatgtaagcattcttctgcttgtagccatccatgaaactggcattgatgtaatctgtctaatgataaaaaggagacatcactatagctacacagaatacaccatttgggtcataaaatgatgtactcagtaagtaaaacccaaggtgtgaatattctcttcttgttgagcagaaaatgaggagtgaaatggccagctcaaaccctcacttcaataaatggtgctgggacaagtagatatctacatgcataaaaatcaagctgactccttcctcacactgtaaaactgactcaaaatgtatcacagaccaaatgtaagggattaaaactattaaaactctcagaataaaatataagagtaaatctttgtgaccttgggttaggcaaagctttcacagatatgataccaaaggcgtaagtgacaaaagaaaagagataaattggactatattaaaattaaaaacttatgccaggcgcggtggctcacgcctgtaatcccagcactttgggaggccgaggagggtggatcacgaggtcaggagatcgagaccatcctggctaacacggcgaaaccctgtctctactaaaaatacaaaaaaggtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcctggggcagtgcggagccgggacagtcgcggcgctgacgcccgcgggccccagctgcagatatgaagcggagccgctgccgcgaccgaccgcagccaccgccgccccacagccgggaggatggagttcagcgggcagcggagctgtctcagtctttgccgccgcgccggcgagcgccgcccgcgaggcagcggctggaggagcggacgggccccgcggggcccgagggcaaggagcagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccctctgggaggtgaggagcgtctctgcccggccgccccgtctgagaagtgaggagaccctctgcctggcaaccaccccgtctgagaagtgaggagcctctccgcccggcagccaccccatctgggaagtgaggagcgtctccgccgggcagccaccccgtccgggagggaggtgggggggggtcagcccccggcccggccagccgccccatccgggagggaggtggggggtcagcccccccgcccggccagccgtgccatccgggagggaggtgggggggtcagccccccgcctggccagccgtgccgtccgggaggaggtgggggggtcagccccccacccggccagccgccccgtccggaggtgaggggcgcctctgcccggccgcccctactggaagtgaggagccctcagcccggccagccaccccgtccggagggaggtggggaggtcagcccccgcccgccagccgcccgtccgggagggaggtggggggtcgccccccgcccggccagccgccccgtccgggagggaggtggggggggtcagcccccccgcccagccagccgccctgtccgggaggtgaggggtgcctctgcccggccgcccctactgggaagtgaggagcccctctgcccggccagccgccccgtccgggagggaggtgggggggggtcagcgcccctgcctggccagccgcccctccgggaggtgagggggcgcctctgcccggccgcccctactgggaagtgaggagcccctctgcccggccaccaccccgtctgggaggtgtgcccaacagctcattgagaacgggccaggatgacaatggcggctttgtggaatagaaaggggggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctccttaagagtcatcaccaggccgggcgcggtggctcacgcctgtaatcccagcactttgggaggccgaggcgggcggatgacgaggtcaggagatcgagaccatcctggctaacacggtgaaaccccgtctctactaaaaatacaaaagattagccgggcgtggtggcgggcgcctgtagtcccagctactcgggaggctgaggcaggagaatggcgtgaacccgggaggcggagcttgcagtgagccgagatcgtgccactgcactccagcctgggcgacagagcgagactccgtctcaaaaaaaaaaaaaaaaaaaaaaaaaaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaatacaaaaaaatagctgggcgtggtggcaggcgcctgtagtcccagctacacgggaggctgaggcaggagaatggcataaacccgggagatggagcttgctgtgagctgagatcgtgccactgcactccagcctgagcgacagagcgagactctgtctcaaaaaaaaaaaaaattcattcatcatcagccatcatggaaatgcaaatccataccacgagatactaatttatacccactaggatggctacagatatcaaagatagataatactgttggcaaggatgtggaaaaactgaaaccctcatacatgtgtaaaccctccttatacatggctagtggtaatgtaaaatgctgcagttactttagaaaacagtctggttgttcctgaaaagattaaacagttaccatatgacccagcaattccactccttagcaaaataacataggtgcatacaaaaacttatacataaatatccatagcagcattattcgtaatagccaaaaatggaaacaactcaaatgtccttcaactgataaatgaataaaagtggtatatccatacaatggaatattatttggcagtaaaaagcagtgatgtgatgatacatgctatgacatggatggacctagaaaacattatgctaaatgatagaagccagacacaaaaagctacatagtctaggattctctttgtatgagatccctagaacaggcaaatctatggagataggaaataaatcagagtgggttagagggaaataggtagcgactgccaagggtgtgaggtttctttgggaaatgaaaaaaatgttctaaagttgtttgtggtgatggtggcacaactctgtgaatatactaatagccattgacttatatactttaaataggtaaattgtatggtatgtgaactgttggaggccgaaagaatgagggtcatgatcaactcagtataccactggaggctacatgagcaaaaaggaaactgttctcatgaaagcaggatgttggcaaactgacaaactgcatctgccgcccagaaggaatgctgagggcagtcacgacccaggcacaagtgtttcttgtagttaggcacatctgaagcctgttagcaataatgtgtacctgtgatcaattaagcagctgaccaatcgttacctcctcctccctgctcttggtacccaataaatacaaagggctgtagaagctcagggctgcctttgctcactagaagcagggagttctcttcttccccatgttacccttcctttagaatagttatttttgtcttaagttttcattgctatgtttatcccccttcattcagtctcctaatgacggtctcaagtaataacaatagtaactgccctagtgacatctcaagcagtaattgtggcagtctgccagagtgaactatataactcaatagaaactgttatttacaagaaaagggtccatcaagacttgcaacactgtagcacaggaccaaatgagaggcaaggcaagcaagtaggaacacctggtccatcctgccacacacaaaaggcaaaatatgaatggagaagaaataaagctacatctcatacttaggaccatcaacagacgagccaaacacctggactccattattacctgaattaatgcaaagcaacttccagtcaaattcaaaggcatctcaatgaacagctcctgactacctctcttccagggtattctcccacctcctaatgtcctcagtcttaattacttcaacatcattttttataaatacctactcaaaagatcctttgatccaggctgataaaagagaaacatcaatcagctgcagttttatgttatagtataactagttgggagttgaatggatagaagcagtggaatggataagggaaggtgtgaagggttacagaaggacaaaagaaaagtttcaatagcaaactagggaaaactcataacccactgcattacagagaggtcagactgactctttcctcaacctatcactcgttctcctgtgggtcctatcactgggtgggcagtctgaactgtcagtatcccatagctaacctcctaagatatctccacctcatggtcaaacccatgttacttggatttgtgttcattagccagtcagtctaccaatttatcactctactatttatttagtcaagagtttcctccttagaaactgtttctttgactaaataaatagtggagtgataaactcggagttttccctcccatagcagctagtattgacctcatacgattactgtcctaccctgactcagacaacttcactgagctaatagaccacctgcagcagacccagcatgctaaaagcctcactcacttccaaacaggcttctcaatccagggtgcacccagtcagccaaagcccatcctctactcaacctggcacatgcaaatggtatacccactcgaggaccaaggggagaaggtatggaaaagcacaaaagatttacctagtatatgccagtcagcattagtaagaacataaggaggaactaacttcatgctttgaaaagaattgtcacttctttttttttttttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttagtagagacggggtttcaccttgttagccaggatggtcttgatctcctgacctcatgatccacccgcctcggcctcccaaagtgctgggattacaggcgtgagccaccgcgcccggccgaattgtcacttctttaaagaagacattatttctttataactaagaattaccagctttagcactggtctctgagctgatttttaattcccagggaattaaatttttaatttcagcaacttcggaagaatcactggatattaaaactgaaggccgggcgcagtggctcacgcctgtaatcccagcactttgggaggccaaggcgggcagatcacgaggtcaggagatcaagaccatcctggctaacaaggtgaaaccccatctctactaaaaatacaaaaaattagctgggtgtggtggcgggcgcctgtagtcccagctacctgggaggctgaggcaggagaatggcacgaacccgggaggtggaggttgcagtgagccgagatcgcaccactgcactccagcctgggcgacaaagcgagactccaactcaaaaaaaaaaaaaaaaacaaaactgaaaatgacccagagataaagtatacacttgggggaaaattggaatagcaggaagaacaaacccggaacactatgttgtgagccattgctatagactgatcatttgtgtcccccataacttcaaatgtgtaatcccaaccccagaccctcaatgtaatggtattaggagatggggcctttagacaggtgattaggaccatgaggacagagctctcacaaatgggattagtgcccttataagacagaagagttctgaagtgctccctcaccccttccccttctgccatgtgaggatgcaatgagtagacagtggtctatgaaccaagaaaggggccctcaccagaccccaaatctgccagcacgttgatcttggacttcccagactccacaatagtgagaaataaatttctgttgtttataagccatcctgcatgtggtatttttgttacagcagcccaaacagattaaggcagccatgttcaacagaaactgggactaatagctttaaaattccagaagcaaatcaagtaaacaattcactaaaaaacctgaatcctccaaataacaaggtattgtatacttgaaaattgcggacagcatattttaagtgttttcaccacaaaacaaggtaaatatgtgaagtaatgcatatgtggtgttttttttttttttttttttgagacggagtctttgctctgttgcccaggctggagtgcactggtgcgatctcggcttactgcaagctccgcctcccaggttcatgccattctcctgcctcggcctcccgagtagctgggactacaggcgcccaccaccacacctggctaattttttgtattttttagtagagacggggtttcaccgtgttagccaggatggtctcgatctcctgaccttgtgatctgcccgcctcggcctcccaaagtgctgggattacaggtgtgagccaccgtgcccggcaaagtaatgcatatattaactagcttgacttagtgtctctgcaatccatacatattttaaaatattatattgtataccataaatatatacaatttctatcaattaaaatttaaaaacaactaaatgtcagaaaacagaatggaaaaatagccccataggtggaaattccatgagagtgttaagtccccaaagctaagtaaataatttttttttttttgctttcggcccgcaaagtaaataatgtcaaaaaaactaaaaactaaaatcaaaataaaataaaaaaaaagcctaaatactccatttactataaaaataaagcctccgctaatgtttcagtaaggagagggactacaaatcagacaatgatcttcatattaaccacaggatgattagaagaatctcccagtacactaagattcactcattcacaaatatgtcctgagtgtctgatatgtggcaggcactgttctaggtactggagacagggaagtcaacaaaatggataaatacaggtatctctgactccagagccccaactcaaccactgtactccactccttcagggcatatacgatgatgatctcagcagtactgatgaatttaccctccagccagccagtctcttagctcaaatgctcctgcaggaaaatcttctccaagggtcctggataggactgtgaattcagtttatgtgcttgaaacaacagggacaagagagttggaaaccatgatcctggggtcccaacccacatgtcatatatgcccaaatacaaggcagtaagttttccaaaaattattccccagaaagagaagggatataacaagtccttataatgtgtgtcatgttaaagaggtactatttaaattactttactgtgtgtcatgttaaagaggcactatttaaattactttactttgccggcgcagtggctcatgcctgtaatcccagcactttgggaggctgaggcaggcggatcaccccaggtcaggagttcaagaccagcctgaccaaaatgatgaaaccccgtatctactaaaaatacaaaaattagccgggcatggtggcatgcacctgtaatcccagctactcgggaggctgagaaaggataattgcttgaacccaggaggtggaggttgcagtgagctgagattgcgccattgcactccagcctggacaacaagagcgaaactctgtctcaaaataaataaataaataaaaataaaataactttactttgaacaacctcagtcaatgctgggttttttttttttatgagatcacctaacaaaattgggtttttcggagatatcacctaataaaattggtatatcagaagggaaaaaaaggaagataataataatttagtcattcatctcaaaattctaaggttggatgttgctgtaaacaagttatattaaaaaggaattatggccaggcacaccggctcatgcctgtaatcccagcactttgggaggccaaggtgagaggattgcttgagcccaggaagaacttaggcaacacagtgagaccctaggtctacaaaaataaaattaaaaaaaatcagccatgtgtaatggcgtgtgcctgtagtctcagctacttgggaggcagaggtgggaggatcgcttgagcccaggagttcaagggtgcagtgagctacgatcaagtcactgcactcaagcctgggtgacagagtgagaccctgtctcaattttctgttttttaaggattttacaaaggaataagtgaatgaatcatattataggggatgcataagatgcaggatgaattaaaaaaccaacttgtcctggccgggcctagtggctcatgcctgtaatcccagcactttgggaggccgagacgggcggatcacgaggtcaggagatcgagaccatcctggctaacatggtgaaaccccgtctctactaaaaacacaaaatattagccgggcgtggtggtgggcacctgtagtcccagctactcgggaggctgaggcaggagaatggcgtgaacctgggaggtggagcttgcggtgagccaatattgcgccactgcactccagcctgggggacagagcaagactccgtctcaaaaaaaaaaaaaaaaaaaaaaaatttgtcctaatgttaccctaacagattttcctggtttaggataaaatttccagtcacaatgccacacacttaaaagtaaataaagatgttgtactctggaaaaccttgttagactgactcaaaaattggcctgtaattccagcacttagggaggctgaggcaagaggattgtttgagcacaagagttcaagaccagactaggcaacatagtgagaacttgtctctacaaaagtatttaaaaattagccatgtatgtggcacacacctgtggtctcagctacttgggaggctgaggtacaagaatcacttgagcccaggaggtcaaggttgcagtgagctgtgatcactgtacctagcctgggcaataaagcaagaccttgtcttgagggagaaaaaaaaaagtggctcaaatgtgacaaagacactaaagttaaaggtgtatgtaaagtgtttgaataaaatgttcattaaatatctctgttaatagattacatatgaggcttttaacatgtagatataatcaaattaatatattaaataatatagtcatttgaccatttcatctctatccctagacatttatgtatacataagttgtccacaatttcctcagatacagatggagaaatcagaggtcacttataatcaaagttgctttgtattgatgcatatatactcaccaaaggaattgcactatatgaccatgactttacaactaaggagtaaaatgataaataatttaacatctatgaagcacctacaatacaacagaccttgcactatcagcattcacataaagaatttcatttaatttccactcaatactgtgagatgggcatttgaggacttgcctatggtcacagactagtatgtagcaaaatataaactcaaacctaatctctctggcctcggagtctactttcattctaccgaagtattagtaagcttcactttggaagaagctctatttcccccagtgcacctaaaaagattacatttatctgtctacctgagtatggccacttcgctttgttagcttcactctagtttggtccaggcagggtacatccccataacggtttttctctaggtttcctggagacctgaaggaaacgaaacaaacaagcaagaataaagaaaaagtggggacagtatgtatgtacaaaatctgaccatgctaaaggggtgtcaattactcttaggggtggagacatggaagcttttcaatttctagcccatacagttccatatcatttaacattttttgtggtaagtacatactacttctaaaagtaaacatatctccattcaaaagagagagggagaccaggcatggtggctcacacctgtagtcccagcactttgggaggcaggaggattgcttgaggccaggagttcgtgagcagtctgggaaatgtaatgagagcttatctcttttttttttgagacggagtctcgctctgttgcccaggctggagtgcagtagcgtgatctcgactcactgcaagctctacctcctgggttcacgccattctcctgcttcagcctcctgagtagctgggactacaggctcccgccaccacgcccagctaatttttttgtatttttagtagagacggggtttcaccatgttagccaggatggtctcgatctcctgacctcatgatctgcccgcctcggcctcccaaagtgttgggattacaggcatgagccactgcgccctgcctaatgagaggttatctctagagagaagtcaaaaaattagccgggcatcatggcacacacctgtactcctagctgctcaggagtctaaggtgggaggacggcttcagcccaggaagtcaaggctgcagtgcgctatgacagcgccactgcacaccagcctgggtgacggagagaaaccctgacttaaaaaaaagagaagctgggtgtggtggctcatgcctgtaatcccagcactttgggaggccaaggcgggtggatcacctggggtcaggggttcaagaccagactggccaagatgataaaaccctgcctttactaaaaatacaaaaattagccaggtgtgatggcacacacctgtaatcccagctactcaggaggctgagccaggagaatcgcttgaacctgggaggtggaggatgcagtgagccaacatcacaccactgcactccagcctgagtgacaaagcaagactttatctcaaaaaaaaaaaaaaataattaaatttaaaaacagagagaaggagtggggatgggagtcccaaatggccaaggcagaaattggtactaagaagtggggtgcttctgtaacaaataactaaaaatgtggaagcagctttggacctgggtaatggacagagctgatagaatttggaagtacatgcagaaaaagcctatgttgccataaacaggcataaaaggcaattctactatgggctcagaaaaagaagagctatagagaaagcctcagtcttcttagagattacctaagtgatactgatcagaaaactggtagaaatatgggtggtaaaatccattttgatgaggtctcagacagagatgaggagcacattagtaaaaagagagagagggagagaaggggagagaaatggggtataccaccaaaaaactccagctgcagataaaaatttctactacttatttgtcaaaagatgttcaaaccaaatctcttcaattccaatttcattttctttttgggacagggtctcaaaggtctccagggtcgcccaggctggagtccagtggcacaatcacagctcacttgcagccttaatctccctgggctcagtcccagatgcacaccaccacgcccagctaatttttaaattttttgtagagaaagggttttgccacattgcccaggctggtctcaaactcctgggctcaagcaatcctcccgcctcagcctcccaaagtgctgggattataggtgtgagtcaccgagcctgaccttaaatgccagtttaacatggtaggttgataacacatattgactgcactccattcatccagtagcttcactaaaatgatgaaaaaggagtattcactacaaacccaaaaagtgacagtggagacatcagcacacaaagagtgttcaactcattttgacagagaaaaagcagataggaggattttggctgacgtggccagacacagaagctaggaccaagggaggtacctatagagagacaagatggcacacccttagaactcccttaccatggaaagcaaggtgaggaacagagctaaaaatgggaataaaatgaaaatctgaatgttatgtagtgaaaatccctgacccattctcattgtcctgacctacactcatatccaagtttggatcccctcagcggatccaaaggacaggagaactcttcactggataaagtaaacagcatcaggtgaaagaattctgtcatttggagaatacccaacaaaaagctagttgtctgatcattataatctgaagctcatccatgcaaaacgagcttccatgcagcttgtttttgtttttgttcatcactgtctgcttttgtaaccatgcagcttttaaggaccataaatgtgaactaaaagccaaggatctcaatgtaattaaggaaagcccttacacaaagactttaatacacaattcaaataacacaattcaggcttgtcacggtggctcatgcctgtaatcctaactctttgggagggccaaggtgggaggatcacttgagctcaggagttcaagaccagcctgggcaacatagcaagaccttgtctctactaaaaattaaaaaaattagctgggcatggaggtacaaacctgtagtcccggctattcaggaagctgaggtaggaggatcacctaagcttgggagacagaagctgcagtgagctatgattgcatccctgcactccaccctgggtgacaaagtgagaccctgtctcaaaatcaaacaaaaaataaacaaacaaaaaaacccataattcaaacacatgggggctacagaagtttaaaaaaaaagatagtcaataagagaaaagtaacctctaaaaggctatcattaatatcctcaaagagaaaatagatgatacaattatacataaaacaagaagagagtgcaatgaaaaaggaacagagaagaaaagctcttggaaattaaaaataatatccaaaataggaattttaatagacgagataaaagagaaagttgaggaaatttccagaatacaaaacaaaacaaaaaaagtgatgaaaatatgagaaaaactggccaggcacagtagctcatgcctgttatcccagcactttgggaggctggggtggacggattacttgaggtcagaagtttaagaccagcctggccaacatgttgaaactcgtctctactaaaaatacaaaaatcagcagggcatggtggcacacgctttgtagtcccagctactcgggaggctgaggcatgagaattgcttgaacacgggaaatggaggttgcagtgagctgaaattgcgccactgtactccagcctgggcaacagagcgagactccgtctcattaaaaaaaaaagaaagaaagaaaaagaaaatatgagaaagatgaagaaagttaagagaatcattctgggacacaagtcagcaaactatgccctggccacttgtttttgtaaatgaagttttactggaacacagtcaagcccatttatttctgtactcactaagtatatattgacagtgttgagtcagtaaactatgccctggctacttgtttttgtaaataatgttttattggaacatagtcaagctcatttatttctgtactcactaagtatattttgacagcgttgagtacttgtaacaaagactgtaaacctcacaataccgaaatatttactatcttaccctttaagaaaaagtttatcaatcccatatatatatatatatatatatataaaatctatatatttacatatagagagagagcgcgagcgagaactaacataatacaaggaaagaaatcatttaaaacacagtgtaataagaaaagccctagaactaaataacaaaccttcagattaaaagaatctatcaagtaaccaatgtaataaattttaaaagaggacctacactaaggcacatcattgtgaatctttttttttgcagggggtggacagagtctcgctctgtcccccagactggagtgcagtggcacaatcttggctcactgcaacctccgcctcccaggttcaagggattcttctgcctcagcctcccgagtagctgggattacaggagcctgccaccatacctggctaatttttatatttttagcagagacggggtttcgccatgttggccaggctggtcttgaactcctcacctcaggtgatctgccctcctcagcctcccaaagtgctggggttacaggcttgagccactgtgcccagcctctctcaatccttttaaatgatctattgtttttctttttccttccctgggcattttaaagataatttctttttctgtttaagaaatttagactgggtgcaatggctcactcctgcaatcccagcactttgggaggccaaggagggcagatctcctgaagtcaggagtttgagaccagcctggccaacatggtgaaactccgtttctaccacaaatacaaaaattagccaggcatgatggcacacgcctgtagtcccagctactcaggaggctgaggcaggagaatcacttgaacccagaaggtggaggttgcggtgagctgagattgtgccactgcactccagcctgggtggcagagtgagaccccatcttaaataaataaataaataataaatagattgagaaagaataagatcagacaattcacagacagcatcactagtaattggaaaggcattgccttaaaaattctgagataaagttatttctaacctagagttctatactccagcaaaatagaataaaagaaagaagatggtctacaattaggaaacaagatccaacaaaggaaagagggaaaactgcaagataaaaactgaggaacaagcctagagaataaccaaccacagtttagactagaatgaaagaaaaagttctgaaagtgaggtctcaggaaaaaaaaaatagatgcaattgattatctgatacattcaatcacttggaaactaatgataacactgtaaaataaatctgattgggcatatagaaaaataatgaagggccaagcacggtggctcacacctacaatcccagcactttgggaggccaaggtgggcagatcacttgaggtcaggagttcgaaaccagcctagccaacatagtgaaaccatgtctctactaaaaataacaaaaaacattagctgggcaaggtggcaggtgcctataatcccagctactcaggaggctgagatatgagaatcgcttgaacccagggtgtggaggttgcagtgagccgagatcgcgccactacactccagcctgggcaacatcaaaacaacaaccacaacaacaaaacaaaacaacaacaacaacaataaaaaacaaaagaaaaagaatgaggaacatatacagaaaactaaaggaaatgaaaaaatctggtaattaactccagaagaaacaaaaaattgaattgataagatcattaggccaggtgtagtggctcattcctgtaatcccagtattttgggaggctgaggcaggtggactgcctgagctcaggagtttgggaccagcctgggcaacatggcgaaaccccatctctaccaaaaatacaaaaaattagccagacgtggtgaagcatgcctgtggtcccagctactctggaggctgaggtgagagaattgcttgagtttgggaagcagaggttgcagtgagctgagatagagccactgtactccaacctgggtgagagagtgagagcctgtctcaaaaaaaaaaaaaaaggctggacgtagtggttcacacctgtaatcccagcactttgggaggccgaggcaggtgaatcacttgaggccaggattttgagaccagcctggccaacatggtgaaatcccatctgttctaaaaattaaaaaaaaaaaaaaaattgttaatatatttgatcatttcatagtagcccatgtagctctccagtaaaaataatttacatagtcataataatgtacaatgacgattcaatttaagaatgttacatataattattggaagagtagtcaaaatgaaagtggagacatagtataagagctaaatgagcacctacaataaaagtcactaaaagtattattaacttttttttttttttttgagacagggtctcgctctgtattccaagctggagtccagtggcacaattttggctcactgcagcctcaacgtcccaggctcaagtgagcttcccacctcagcctcccaagtagctgggattacaaacacacgccaccacaccaagctaatttttgtaatttttgtagagacagggtttccacctgtctctacatgttgctcaggctggtcttgaaatcctaggctcaaacgatctacccacctcagcctcccaaagtgctgggattacaggcatgagccactgtgcctggcatattataagcattttaatttagaattagggatgaaataccaggggaaacagctacaagagttgaatacatgattataggtaatggaactgagggtaaaataggaatttgctatttattttgtcattgcttgtcttctttagaactgtttggttttgaaaaaaattatttgcatatattaactgaaagcaaagaaattacaaaggtcacacatataaaataatactctatattgttcatgagtgcttatgcatatataacagtataaacaaaatcaactagaaagaaatatcatattcatactagtagctgcttatgatgagtggggagaactaaggatgcggattagaaggaatttcaactttataataaattctttctctcatataataattaaaaagacagctgggcacagtggctcatgcctaaaatcctagtgctttgggaggctgaggtgggagaatcacttgagcccaggagtttgagaccagcctgggcaacagagcaagactccatctctacaaaaacttcaaaaaaattagcaaggtgtggcaccccatacttcttgtcccagctactaggaaggctaaggcaagaaaatcacttgagcccaggaggttaaggctgccataagctatgacagtgccactgcacctgcactccaacctatgcgacagagcaagaacacatgtctctcttaaaaagaaagaaaaaggccaggtgtgggggctcatgcctgtaattccagcactttaggaggccaaggtgggtggatcacctgacgtgaggagctcgagaccactctgaccaacatggcgaaaccccgtctctatgaaaaatacaaaaaattagctgggcttggtagcgggcacctgtaatcccagctacttgggaggctaaggcaggagaatcgcttgaacccaggaggcggaggttgcagtgagctgaagtcacaccattgcactccagcctgggcaacaagagcaaaactctgtctcaaaaaaaaaaaaaaaaagatgaagcaaatataacaaaatattaacaagagtcagtgttgattctgtggtaggaacatagttgtctgtaaaatcttaaaaaatttcagcccagcgcagtggctcatgcctgtaatcccagcactttgggaggctgaggctggcggatcacctgaggtcaggagttggagaccagcctagtcaatatggtgaaaccccatctttactaaaaatacaaaaaaaaaaattagctgggcgtggtagcaggcacctgtaatcccagctacttgggagactgaggcgggagatcacttgaacccatgaggcggaggttgcagcgagctgagatcacgccactgaactccagcctgggcgacagagcgagaccacatctcagagaaatatatatatatatttctcccttcctatacgaatatgcctagtgaataaaaccaatcctaaaagattacatacagtatgtatgtaatttttttacattttatgtaatgttacttgatataacaacaatttggaaaggacaaaattagagaaatggagaatagattagtggttgcaggggttaggaatggggaggtggtgggaaggaggtatatgtttactatagggcaatgaggctgggcacggtggctcacacctgtaatcccagcactttgggaggccgaggtgagtggatcacctgaggtcaggagtttgagatcagcctggccaacatggtgaaaccctgactgtagtaaaaatacaaaaattcgtcaggcatggtggtgcacgcctgtaatcccagctacttgggaggctgaggcaggagaatcgcttgaacctgggaggcagaggttacagggagctgagattgcaccacagcactccagcttgggtgacagagcaagactctgtcttaaaaaaataagtaaataaaaataaaaatattgatcgcttctcagtcttttggctaagatcaagtgtaaaataaaaataatgaagggcaacgaggggagccttgtggtgacagaactctgtatcttgattatggtgacagatacacaaacctacatgtgtgacaaaactgcacagaactaaatacacaaaaatgaagtaaaactggggaagtctaaatcagattggtggattgtatctatattaacattctggctgtgatattacactatagttttggaagatgttatcatgggataactgtagaaagggtacatgtaatctgtctccattatttcttacaactgcaggtgaatctacaattataagaaaaagtaaaaagagaaaagggaaagaaagtctcttggtccaggggaatcctgggcaagagtgaatatacactgatagccacttcataatccagaattccaagggagacacagtttgttctttgtaagtagctctactgggagttggtgtaagtcagaggcttggagctgatgaggattctaggttctaaatcataaagtggggaatcagtcattcaataggcaagactaggaagtcctctcattagatgagagatctgttctctgattgtcaaatggtagctggtttggatgatggcaacaagacgatctaaacccacttttttttttttttttttttttttgagacagagtcttgctctatcgcccaggctggagtgcggtggcatgatcttggctcacagcaacctccgcctcctgggctcaagtgattctcctgcctcagcctcccaagtagctgggactacaggtgcgtgccaccacacccagctaatttttgtattattagaagagacggggtttcaccatgttggccaggatgttctcaatctcttgacctcgtgatctgccagcctcaacctcccaaagtgctgcgattacaggcgtgagccaccgcgcccagccaaacccacttttttaatggaggaggggagactccatagtagaaatgacatctcaagggcctcacagcagctggtagttgcaaaagcaccgagagcaaggtgaagaatccccaggataagtgtgcatcctcttagatcagcctagcatgcctccctgctccaacatatttccttgattcaagactgcaagggaggctgggcatagtggctcatgcctgtaatcccagcactttgcagggctgaggtgggcagatcacttgaggtcaggagttcgagatcagcctggccaacatggcaaaaccccatctctactaaaaatacacaaattaggccaggcatggtggctcacgcctgtaatcctagcactttgggaagccaaggaggacgaatcacccgaggtcaggagtttgagaccagcctggccaacacagtgaaaccccatctctactaaaaatacaaaattaaccgggtgtggtggcacacgcctgtaatcccagctactcaggaggctgaggcaggagaattgcttgagccgggagatggaggttgcagtgggctgagatcgtggcactgcactctagcctggccgagagtgagactctgtctcaaaataaataaataaataaataaacaaacatacatacacacacacacacacacacacacacatatatatacacacacaaattagttgggtgtggtggcacacacctgtaattccatctacttgggagactaaggcacagaatggcttgaacccacaaggcggaggttgcagtgggccgaaatcataccattgcactccagcctgggtgatggagtgagactgtctcaacaacaacaaaaaagactttaagggaataactgttctgtttgcaaaagagattggatataaacagggagtctggtagttgggtataggtagcacccataattccagcactttggaaggctgaggcaggaggatcacttgagcccaggggttcaagaccagcctgggcaacatagggagactctacaaaaaatttaaaaaattagccaggcatggtggtgcatgtctgtggtctcagctactcaagaggctgaggcaggaggatcaattgagcatcaagagatggaggctgcagtgagccatgatcatgccactatgcgccagtctgggggacagagcaagaccctgtctctaaaaaaaataataataataaaataataaatacaataagtaaaatgaaataaaaattaaataaaaataggggtctggagctggtagggaagaaacagagctgtatgagagaaaagaataatttcccttgttgatatatggtctgtgtcccctttttctcctcttattttcctttgcattcttgatctgattgacttctttctcaagtgcctcttatctcttactttccctatctcattattttccccaactcattattttccctctttgctttgctaaaagactctatccctgcatcttattcagaacacactgactacactggacaggagttacaagagagaagaggtactcacagaatcctagatttctaaaacatttaagctacaaaggtaggtgaatatcagagtccagtagtcacatattatacagaggaaaaccaaagtgctgagaagggaaataacttgtgtcactcacagagggaatttttggttaagttggaatatgaggctgggacccactaggatggcttccctcattttctttcttttttttttttcctcttcttttctttctttctttttttttttttttccttagacaaagtcttactctgtcacttaggctggagctcagtggcgtgatcataactcactgtggtcttgacctcccgggctcaagtgatcctcctgcatagctgggacaacaggagtgtgccaccatgcctggctaattttttcgttttttatttttgtagaggtagggtcttgctatgctgctcaggttagtctcaaactcctgggcacaaatgatcctcctatacctttactcccaaagtgctgggattataggcatgagccactgcccccagccctagtttctgtagttttcaacagtcacagctcactagctggagagaaagagatttctggggcagccaattaaaacatggtaagagaaatgacagcaacatggtaagagaaataatctgaccaggtgcggtggctcacacctgtaatcccaacactttgggaggttgaggcaggaggatcacttgagcctcggagtttgagaccagcctgggcaacatgccaaaaccccatctcttcaaaaaataaaaaatgagctggacatagtggcacatacctgtagtcccagctactcaggaggctgaagtaggaggatcgctttaacctaggaatttgaggaaaagaaaaggataaaagaaaagaaaaggagaagagaagaagaaaagaagagaagagaaaaaagaaaaagaggccaggtgcggtagatcatacctgtaatcccagcacttcgggaggctgaggcaggcagatcacctgaggtcaggagttcaagatcaacctggacaacatcgtgaaaccctgtctctactaaaaatacaaaaattagccaggcatggtggtgcgcgcctataattccagctacttgggagggtgaggcaggaagaatcgcttgaacctgggaggcggaggttgcagtgagccgagatcgtgccattgcactccagcctgggtgacagaacgagactccatctcagaaagaaaaaaaaaagagagggagggaggaaggaaggaattacaggtgtgcgccaccacacccagctaatttgtgtgtgggtgtgtatatatatatgtatgtatgtatatatagttatcaactagttacgagccagagttataaactagcgagatggttttgtgataggatttgagtagaatgaaaatctcaaggggttaaagtcctatgaggcaactgtactctctgactgtggattattttaagtgtaccacatacccctcctcaagaagtaatgttataccataaatgttatggggagaaactgcccaaatgaacagaccagcactcacactgagtactggaatagagagtagcctattttgaacctactttttttaaaaaaaacttgcatttcagaaaaatatccaaaaatatgtccaacagggttatcctgttggtaccaaagaccttcagaaatttcagagcataggatgttagcaagaagcacccaatggtgcccaggctggagtgcagtggcgtgatctcagctcactacaacctccatctcccagccgcctgccttggcctcccaaagtgccgagattgcagcctctgcccggccaccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgcctcttcccggcagccatcccatctgggaagtgaggagcatctctgcccggccgcccatcgtctgagatgtggggagcgcctctgccccgctgccccgtctgggatgtgaggagctcctctgcccggtcgcgaccccgtctgggaggtgaggagcgtctctgcccagccgccccgtctgagaagtgaggagaccctccgcccagcatccgccccatctgagaagtgaggagcccctccgcccggcagccgccccgtctgagaagtgaggagtccctctgcccggcagccaccccgtctgggaagtgaggagcgtctccgcccggcagccgccccgtccgggagggaggtgggggggtcagccccccgcccggccagccgctccgtccgggagggaggtgggggggtcagccccccgcccggccagccgccccgtccgggaggtgaggggcgcctctgcccagccgcccctactgggaagtgaggagcccctctgcctggccagccaccccgtccgggagggaggtgggggagtcagcccccaacccggccagccgccccatccgggagggaggtggggggggggtcagccccccgtccgggagggaggtgggggggtcagccccccgcccggccagccgccccgtccgggagggaggtgagggggggtcagccctccgcccggccagccgccccgtccgggagggaggtggggtcagccccccgcccggccagccgccccgtccgggaggtgaggggcgcctctgcccagccgcccctactgggaagtgaggagcccctctgccgggccagccgccccgtccgggagggaggtggggggctcagccccccgcccggccagccgacccgtccgggagggaggtggggggatcagcaccccgcccggacagccgccccgtccgggagggaggtggggaggtcagccccccgcccggacagccgccccgtccgggagggaggtgggggggtcagccccatgtccgggagggaggtcgggggggtcagccccccgcccggccagccgccccgtccgggagggaggtgaggtcagccccctgcccggccagccgccccgtccgggaggtgaggggcgcctctgcccagccgcccctactgggaagtgaggagcccctctgccgggccagccaccccgtccgggagggaggtggggggctcagccccccgcccggccagccgacccgtccgggagggaggtggggggatcagccccccgcccggccagccgcccggtccgggagggaggtggaggggtcagccccacgtccgggagggaggtggggggggtcagccccccgcccagccagccgccccgtccaggaggtgaggggcgcctctgccctgccgcccctactgggaagtgaggagcccctctgcccggccagccgccccgtctgggagggaggtgggggggtcagccccccgcccggccagccgccctgtccgggagggaggtgggggggtcagccccccgcccgggaggtgaggggcgcctctgcccggccgcccctactgggaagtgaggagcccctctgcccggccagccgccccgtccgggagggaggtgggggggtcagccccccgcctggccagccgccccgtccgggagggaggtgggggggtctggccagccaccccgtccgggaggtgaggggcacctctgcccagccacccctactaggaagtgaggagcccctctgcccagccaccacctcgtctgggaggtgtacccaacagctcattgagaacgggccaggatgacaatggcggttttgtggaatagaaaggggggaaaggtggggaaaagattgagaaatcggatggttgccgtgtctgtgtagaaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaatttaaaaaaaaaagaaaaaaaaaaagaagcaccaaagcagaaagtacctctttctgcatgcgagaaaccatcatttatgtgagagtgatgttccctaacataaggaagggtctctgctaagcaagtgaggggtggaaggagctgttgccagagcctaccagaagcatcctggtaaccagctgctggcccaaactttttctacttacatggaacagtggaaagtgccaacagggttctcacgacgaatgtcttcatattcctcatagattccttgcttttgcctggcattaacatagtccaccaactcttggatggtcatagcatggggacctggaacatgtactgagtcccagtctaaggcaggagggagggagaacaggatgatctcatcgaagggatctgggtggccgttcacctggggtaggaactggaaattccaagtggcgagatcaattttgacgtacccacccaggttttctggaagacactccctgggcagatgctgcgtgacctcagatgtctttaatatttgaatctggaaggttagaaagaaccatgtgagtatgtgggaggagggaaaggcatatagagtgacaaagaataaatgtatttatatcaggtttggaggatgggataagattttcttgaaatacaaggtatacttgtaaaagtagtagactacatttcatctgcctgagatttaagtcctatgaatttgccagataaaagtgtgaactcccagaatgtatataaaattcactcctggaattagggacactgttatacatcttctgaaaggacgatgtagtgaacaaaagctttatattattaacaaggcttcccagcatcgctgcatgctggtactctttttttggccactaagaatgcataggtagtagttatttttgtcaaccccatactcagacaaccaattctaaggcctgttagcttgtattttactcagcttggtataactgttcacaaagataggattctatgaaagcaagacacccagaggcagggtagcccaggaaaaatgtgagataacactttttttttgagacagggtctcactttttcacccagcctggagtgtagtggcgtgatgaaggctcactgcagcctcaacctcctgggctcaagtgatccttccacctcagcccctcaagtagctgggaatacagatgcacacaaccacgcccagctaattttttgtagtaaccataaaacttaattctgctctctgcttggacatagccatgctggaactaattagcttaactggttctccttaggatctctgtggaatggggattctcttcctcctaaaagctcatctcttttgctgtcgcctcttcttggaatgccttcctttcctcctctgcctcttcatggaccagcacagctcacctcttctgtgaagtctttcctgactgcctgaggccatatgctcctctgcgttcctgcagagccaaagtcctcctatgtgtatctctgtgttccctatcaagaccatgagctccttgagggtagactgtctcacttaatttttaattatcaggaaccagtgcttcgactacaaaaagtgcttaatatattttgagtttatacatgcatgtataattcctataattcaagtgcaagaacttgcctatggattcctctcaaagagttaccttagaaaagatctctccagctggcacggtggctcatgcctataatcccagcactttgggaggctgaggcaggtggatcacctgaggtcaggagtttgagaccagcctgtccaacatggtgaaaccccatctctactaaaaaaatacaagaattagctgggcatgttggcaggagcctgtaatcccagctacttgggaggctgaggcaggagaatcacttgaacccgggggacggaggttgcagtgagccaagatcatgccattgcactctagcctcagcgacaacagcaaaactctgtcgcaaaaaaaaaaaaaaaaaaagaaagaaaagatctctcctggctgggcacggtggcttatgcctgtaatcccagcacttttgggaggctgaggtgggtggatcacgaggtcagaagatcaagaccatcctggctaacacagtgaaactccgtctctactaaaaacacaaaaaattagccgggcgtgacagcacacgcctgtagtcccagctactagggaggctgaggcaggagaatggtttgaacctgggaggcggagcttgcagtgagccgagatcgcttcactgcactccagcctgggagacagagcgagactccgtctcaaaaaaggtggctcacgcttgtaatcccagcactttgggaggctgaggtgggcggatcatgaggtcaggagttcgagaccagcctggccaatatggtgaaacaccgtctctactaaaaatacaaaaattagctgggtgtggtagcgtgcgcctgtactcccagctactcaggaggctgaggcagaagaatcgcttgaactcaggaggcggggctgcagtgagccaagatcgtgccactgcactccagcctaggcaacagagtgagacactctcaaaaaaaaaaaaaaaaaaaaaaaaagaaaagctctctcctactctgcgtcattaggtctctaagcagcttccacagaaccaaatgttttcactttcatgtcctgtcttttaattgctgcaatcagtaactgagaccataaatcttttaatcatggaacacgcaggagattataacagaattaaagtttctggttttattgtggcggcggggtctcactgtgttgcctaggctggtctcaaactcctggcctcaagcgatcttcccgccttggcctcggactcccaaagtgttagtattataagcatgagccattacacttggcccagaattaaagtaattttgaacgcttttgaaattgggaagcaacaaggtattctgagaaaaaaaaatgccaggaataaatgtagaaagagacataacgaaaaactttcctccacaaccctggtggtcaagggattgaatgatgtttccagttgaacaaattctaatgccagttcaactaatgcagttatattacaagctgttaaatattaaaggcctatgcagcactaggataaattttggaagtagcagctatccctaagttacctccaggacacgttccttcagtactatcttatgcaaggtgctatagaaagtgagaaccagataaactgtgtttagttttgaacttcaagaagctcgtaggacagtaagagaggcagtctgtattgaactgactaatgcatcaggtagagaatataagtgaatgcactaacagaagcagaacaggctctagaagacacgccaggaggattttttgaaggtagaaaattaattggcaggaattcactgtatctattcacctccagataaaaaagggcaagcttgccttaccctctcccggactttgtccttcaggaggagactgatgatggaatagggcactcggaaccatatgggtgcccccacaatcagcaccttcttcaaacgagctggaaatgctccctgtggagaaaacacatgaggatttaagtgtaatggaacctgtgactcttcaagcccaagtttaggttttctgctcttctccccattcttacccagcagggggagtctacagcctaattcaggtttgatctcagcagctagaggaaaagtggttaaacaaactgaagaaattagaagctgatttacctttaaaaataacaatgttaagttcttgtctaccgtaagctttatggatcaaaaactattctgacttctcatctcaacagatatcctacacataccacacatcagcatacatatatgcctcttaaaaaagttatgttattaaaacttgaaggaaaaatgagatcatgaataaactgaacattaaacatttctcgaccaggtgcggtggctcatgcctataatcccagcattatgggaggccgaggtgggtggatcaccagaggttgggagttcaagaccagcctggccaacatggtaaaacccatcactactaaaaatacaaaattagccaggcacggtggcagacacctgtaatcccaactactcagaaggctgaggtaggagaatcacttgaacccaggaagcagaggctgcagtgagttgagatcaagccattgcactttaccctgggcaacaagagtgaaactctgtctcaaaaaaaataatatggctgggcacagtggctcacgcctgtaatcccagcacttctggaagctgaggcgggcagatcacttgatgtcaggagtttgagaccagcctggccaacatggtgaaaccccatctctactaaaaatacaaagattagccgggcatggtggcatgtgcctgtaatccctgctactcgggaggctaaggcaggagaatcgcttgaacccaggaagtggaggttgcagtaagccaagatcgcaccactgcactccagcctgggcgacaagagcgaaactccatctcaaaattttaacaataataaataaaaatttaaaaattttaaaaatttctctttcataacttttcattcagtctgatgtatgcataatctttttttaatctattcattcatctatgtatttaccaatcaataatctaatgtgcactatggcaaatgagatctaaaaaaaggagatatcctcatccacacaagatataaagatgaaaaaatcattcattcctaatccacagtgcttagtttttttgtttgcttggctgctctgtttttgttttgtattgtttttgagacaggatcttgctgttgcccaggctggagtgcagtggcacaatcgccactcactgagtcctgtacctcccaggctcaaatgatcctcccacctcaggctcccaagtaactgggactgcgccactacacttggctaatttttgtatttttagtagagacagggtttcaccatgttggccggctggtttcgaactcctgatctcaagtgatcctcctaccttggcatcccagagtgctgggattataggcattgagccactgctcctggcgtgaagttcttaattttcaaatggttaaatgtattactgttttcttttctggttagtgtgttgtgtgtcttaaatccttttctattttaatgtcagaaaaagtacttttttttttttttactgctgtaccaccgattccaccaatgtgtattaatttttctaatttggttttttattgtaaaatatacacaacaaaattgaccttttaaaccattttaagtgtacaattattggcgttaagtatgttcacaatgcagccatcaccactattcattttcagaactatttcatcatcacaaacaaaaaccctgtacccattaaataacatctccctattcccttctccccctagtccctagtaaccttggttctactttctgtctctatgaatttgcctattttaggtcctcgtattattggaatcctactatatttgtccttttttgtcttgtttatcctacttagcataatgttttcaaggttaatccatattgtagcatgtctcagaattacattgctttctaaggctgaataatatttcctcataaatataccacatttttcttatctattaatccgttgatggacatttgggttgtttccacttgtacacattggttgtttccacttgtccagatttgaggagctattttccacattgtttccacttgtccacatttgaggagctattttcttttaaaaatttaaacttttgtttttgtcctttttttttgagacaagttctcactctgttgcccaggctggagtacgatggcaccatcatggctcactgtagccttgaccacccaggctcaagtgatcctcctacctcagcctcgcaagtagcatgtgccaccatgcctgtctaattttgtatttttgtagaataaaaatacaaatggtttcatcgtgttgcccaggctggtttcaaactactgggttcaagcaatctgcctgccttggcctcccagtgttgggattccaggtgtgagcctccatgcctggcctgtttttgctatttaagactttaacctatctgaagttgatttttgaacatggtatgagatgtaggaatctgacatttttttctatatgggtagctgttttgttttccacctttacatattaaaaagtcccgtctttccccaacttagactttctatttgtcagttttaacaaagtcacaatatcctggggaataaatatgacataggtaatttaattaaccatgtaaccatcattctgattattcagtttgttttcaggcctaaataatcctgatatgctcattttatcttttccttttaattttttttttgagactcactttaatattttttttttttttagtctcacttggtcacccaagctggagtgtagtggcacgatatctgctcaagggttcaaccaattctcctgcttcagcctcccgagtagctgggattacgggcgtgtgccatcacgcctggctaacttttttgtatttttagcagagatgggttttcaccatgttggccaggctggtctcgaactcctggcctcaagtgatccgcccatcttggcctttcaaagtgctgggattacaggcatgagccactgtacccggcctccttttaaattattttaagaagctgtttctaagactgggattatttggctaaagattatgaatattctttttttttttttaagacagggttttatcaactgggctggaatgcaatcatatgatcatagctcactgcagcctcatatcctgggctcaagtgatcctcctgcctcagcctcctgggtagctgggatgataggcacacaccaccacatgcagctaaattttgtacagtcagggtcttgctacgtggcctagactggtcctgaactcctggccttaggcaattctcccacctcagcctcccaaagggctgagattatagatttaagtcactggagccagcttaaggtattatttttaattatctaaaataaatgtgcagtaaatactctttttatattttcctgattgtttccttagcatataatctcagaaatacaactgatcaaagggtatgtgcatttttaaggatttataatgccagatgccttccaaaaggtgttaacgacttactgaactgacagtatatgagggtgctatacagtcatttatttatttgaaaaacaaacaaatctttattgtctagaaatatatatttttaaaatcccccagaaaagacgctattctctcatttccccatcctcttcctcttccacacctctgagacaaaggacattattatactttagtaaaacttcatccagatgtccagacaataccccaactatgtattcttctgtatttgcaagctacatgttcttatagatacatctgtagatctggttcatctacagataccagttagcctttgtaatccattcgccacttaagtttcactgtcactggcttttctgttaatcccttgaggaaaggtttgggattgaggggtaaatcctttataaccacaggagaatgctgcaggctattcgctgctgaccaagctgccacccatccctggtgactgcagcaggtacccccagacagtcatgtaaatagactaggcccaggtctgcagttctttgctctgaaaaaagagacgtaatagcttctactttttatttatcattttgtggaaataacaggtgttttcctagaatggtttttgatttgctggtaaaaggaccttggacatttaggtcctgaaataaattgttgcatctttgaaggaaaagatgaaagtagtttatcacacttcagtgaagaggcctttggagaagtttgttctagatgctgtatattctccatagaggagtgctggggtttctccaaatcagtagaactaaagggtaactgaagagaacagagtgacatgtcagattgagaatcagtcttttgaggctgggcgtggtggatcacacctgtaatcccaggactttgagaggccaaggtggatggatcacttgaggtcaggagttcgagaccagcctggccaacatggtgaaaccccattgctactaaaaatacaaaaattagccgagtgtggtgatgagcacctgtaatcccagctgcttgggaggctgaggcaggagaatcacttgaacccgggaggcggaggctgcagtgagctgagatcaggccattgcgcttcagcctgggggacagagagagactccatctcaaaacaaacaaacaacaaaaaagaatcagtcttttgaaagtggcaaaaagggctgggcacggtggctcacgtctttaatcctagcactctgggaagccaaggctagtggatcacctgaggtcaggagttagagtctagcctggccaacatggcaaaaccccatctccactaaaaatacaaaaattagctaggtgtggtgacgagcacctgtaatcccaactacttgggaaattaaggcaggagaatcgcttgaacctgggaggcggaggttgcagtgagccgagatagcaccactgcactgcatcctgggcaaaagagtgaaacactctgtctcaaaaaaaaaaaaaaaaagaaagaaaagtggcaaaaagaataggctagaagatactagctacaattcctctttttttttttttcttttggatttctcaggaatgatttcttcctagttagaccgccagtgttgcatggtaaccacacccatgaaaagggccggaatattgaaaaactgcatgaaactaagcgctgtgggtcgggcacagtggttcacgcctgtaatcccagcactttgggaggccaaggtggctggattgcttgagctcaggagcttgagaccagcctaggcaccatggtgaaactccatctctacaaaagatacaaaaatcagttgggtgtggtggcacatgcctgtaattctagctacttgggaggttgaggcatgagaactgcttgaacccaggaggtggaggttgcagtgagccaagatcgtgccactgcactcagccttggcaacagagcaagacctggtcttaaaaaaaaggaacttctgttagtcaaagagcttcataaaaagtgaaaaaacaagctataaattaagagacagtttactgtgcgcacacattatatgtgtgtgtgtatatatgtatcttcatggattagaataatatattaaaaactattaatttctaaatggacaaatcataaatagacatttcacagaagaagaaaaaatatatagctaacgaatatatgaagatatagttaatttcactaataaaagaaacgcaagctataccacaagataccatctcatatccatttgattgggaaaaaaattaagaagtctgacattagtaagtgctggagaggatgtagatcaatggaaatcttcacacatggcaagggggtacgactgctttgaaacacagtttgacattgtcttataaagttaaatcttcacagactttaggacccaacaatctactcctaagtgtataccctagagcatgcattctcaatgggggagatatcacctcaccaaaggggtaaaattagtaggagagcagggtgaggtgagccagaataaaaaaaagaaatcgggccaggtgcagtggctcacgcctgtaatcccagcactttgggaggctgaggcgggcagttcacaaggtgaggagatcgagaccatcttggctaacatggtgaaaccccgtctctacttaaaatacaaaaaaattagccgggcgtggtggtgggcgccgtagtcccaactactctggaggctgaggcaggagaacggcgtgaacctgggaggcggagcttgcagtgagccgagatcgtgccactgcactctagcctgggcgacagtgcgagactccgtctcaaaaaaaaaaaaaaaaaaaagaaatcttacactttttatgtatacagagtacataaagaggccaggcacagtggccaacacctataatcccaacactttgggaggccaaggaggcggtactgcttgagcccaggaattcaagaccagcctgggcaacatagcgagactctgtctctatttaaaaaataaggccaggcgcagtggctcacgcctgtaatcccagcactttgggaggccgaggcgggtggatcaccccaggtcaggagtttgagaccagcctggccaacgtggagaaaccccgtctctaccaaaagtacaaaaattggccgggcggggtggcaggcgcctataatcccagctattcaggaggctgaggcaggagaatcatttgaaccgggaggtggaggttgcagtgagccgacatcgcgccaccgcactccagcctgggcgacaagagcaagactccatctcaaaaaacataaaaataaaataaaataaaacaaaataaaataaaaaataaattttaaagagtacatagagatatgcagtatgtttatggtattaaaatttcattagaagaggaattattaggggaaaaaatatttaaaaaggctccttagtgaggcaacaatgaaaaaaggttgagaaacactcccctagagaccctcttacacatatgcaccagaaaacatgtttaagaatgttcataacagcaccattcataacacaggttgggtattccttatccaaaatgcttgggactagaagtgtttcagattttgaatttttttcagattttagaatatctgcatatacataattagatatcttggggatgggacccaagtctaagcaggaaatttatgtatgtttcttcttttttttttttttttttgagacgaagtctcactgtgtcgcccaggctggagtgcagtggcacgatcttggctcactgcaagctccgcctcccggattcacaccattctcctgcctcagcctcccaagtagctgggactacaggcgcctgccaccaggcccggctaatttttttttttttttgtatttttagtagagacagggtttcaccatgttagccaagatggtcttgatctcctgacctcgtgatccgtccgcctcagcctcccaaagtgctgagattactggtgtaagccaccatgcctggcctaaatttatgtatgtttcatacacaccttatacacataagtatgcctcagattcccaaagtgctgggattacaggcgtgagtcatggcacccagcccatcccacttttatgactcagaatgttcctgtgcttttttttttttttttttttttgagacacagtctcgctctgtcgccaggctggagtgcagtggcacaatcccggctcactgcaacctctgcctcccaggttcgagcgattctcctgcctcagcctcccgagtacctgggactataggcacgcgccaccacacccagctaatttttgtgtttttagtagagacagggtttcaccatgttggccaggatggtcttgatctcttgacctcatgatccacccacctcggcctcccaaagtgctgggattacaggcatgagccatggcgcctggccgttcctgtgcattttttacccgaattcctcccatttcacttttaagatcatttcttgttctaaggaagcagagagtagtcatcatttacagatgacctttacattgaacataatgtctgaagtttgcatctttcctaaatcttttcccaaagaattaaaaaaatatatatatcccaagcattgaaggaaacttgagagggccctccatagccttaccttcagcaggtttaggactttcttgccaagatccagctcaaagttggcataattagaaccacacatgtcatagataaacaccagtccattcctctgagtttcaaagctgtaaatcaaccattgaacaaaaacatttgtaagtaagcagatggatgaggcaggttgaaagcctaatgccaaaacaaaacctgagagtatgagacacatctaggatcaaaacaactgcctgactgcacactggtcttacaaaaagatctcttatctttggtatctgctatgtttattaaggcagatttatccagatgtaccaaatgccaaactcgtaggttgagaatgctctacagcaactaagttatcaaaatctgaactgttttctcccacccctctgaatctacctacccaaatcatataacatattccgtactcaaccccaaagtttcctcttccatgaaagtttccctgataactgtaatcaaacatgctaccaattgttttttcccttaaagccccataaatctttctgtggatttttcttgtggccttaataaactctgtatagccatctgattctctcctaaaggacaagaacttgttgttccactcattacgcccaacaatccctagcacagcccttaaaaataaatggtcactgaattgtaattcagtagactggaagcccatctctaagaaaatatttcagacctgtgaaaaactgtgtagaacaaaactgcctctaagctcattgatagtaaatttgtctcttatgaccccatggaggaagagaacaaacccataaatggcctttggaaagcattcctaaaaagtagattaaggctgacatagtggttcatgactgtagtctcagtactttgggaggctaaggatggtggatagcttaagcccaggaatttgagaccaggctgggcaacatgacaatacctcatcatgtagtgacctatagtctcagctacttgggaggctcaggtgggagggtcacttgagcccaggaggtcgaggctacagggaggtcatgccactgcactccagcctgggagacagcgtgagatcttgtcttaagaaaaagtaagactgggcgcagtggctcacgcctgtaatcctagcactttgggaggccaaggcagctggatcgcttgaacccaggagttcaagaccagtctgggcaacatggcaagaccctgactctatttaaaaaaaaaaaaaaaaagagggaaaagaaagaaaaaaaagtagattaacaggtattaatagtaagccatggctgggtgtggtggctcacacctataatcccagcactttgggaggctgaagcaggtggatcacctgaggtcagcagtttgagaccagcctggccaatatggtgaagccccatttctactaaaaatacaaaattagctgggtatggtggcacatgcctgtaatcccaactacttgggaggctgaggcaggagaattgcctgagcccaagaggcagaggttgcagtgaatcgagattgcaccactgcactccagcctgggcaacagagcgagactccatctcaggggaaaaaaaaaaaaaaaaaagtaagcctattcccagaccaaactgaggaacatttgaagatacagaaagtattcctcagtccaatttcccagatttataaagatttctcaaagatgtactcttccaccaagccagatccgtacttatatgtgatctgcagacccaaatggtcattaggataaattatttgattggactactcacagatgacagcaagagttttcacatctatttagaattgagaaaatgtttggcacaaaactcattcctgaaatcaggagtctcaaagttattgttttttgttttgagacagagtttcactcttgtcacccaggctggagtgcaacggcgggatctcggctcactgcaacctccgccgcccgggttcaagcaattcttctgcctcagcctcccgagtagctaggactacaggtgcccaccaccacacttggctaatgtatttttagtagagacggggtttcgccatgttggccaggctggtctcgaactcctgacctcaggtgatccacccacgtcggcctcccaaagtgctgggattacaggcgtgagccactatgcccagcctcaaagttattttgtatcttactatttttgcaccagcacctcctgggaacctccatatcttcatccctttaacaaattccaaggcagaagcacccgcccatgagctaacatttcaaaaatgtctaattctgaggtacatgaaagtttctccagcagacttagtttcaactggcacctaatgtgttacattagtgttaaatctttactcctttttcttatttatttctttacttattttttaatttttagtagagatggggtttcattatgttgcccaggctggtctcaaactcctgacctcaagtgatctgcccccctcggcctcccaaagtgctgggattacaggtgtgagtcactgcgccctgcccttgactcctttttcacaaccccagagagactatgatccacaaaggtccaagatgctgttaaaatgtgtggcacaggacaggtccagtgactcacacctgtaatctcagcactttgggagactgagatgtgaagactgcttgaggccagaagttcgagaccagcctggtcaacagagtgaaactccgcctctacaaaaaaattttaaaattggacgggtttattagtacgtgcctgtggtcccagctccttgggagacagaggcaggaggatcatttgagcccaggagttgaggctgctgtgagttatgatgatgcaactgcacttcagcccgagcaaaagtgagaccctgtctcttaaataaaaagaaacaaagaaaatgtgtggcacaattattgaataggctatccagatctagatactttctatttctccatgagctcctcaagggtcaaattcaaattatgggctttcccctcatgactccaggttgtggcaggggactaaaacaaaaacaagtcagtgagggggcaaagagaatttaaaaaaaaagaagcttggatgcataatgaatgatccaggttctatattcccagatcaaagtgctcatcctgtgaaggcacataaaacatgaatgcagtaagattttcacactttagggtatagaatagatagatagatagatagatagatagatagatagatagatagatgtgtgtgtgtttatatatgtgtgtatatatatacatatacttttttttttttgagacagagttcgcttttgttgcccaggctgaagtgcaatagtgcgatctctgctcactgcaacctccgcccaagttcaagtgattctcctgcctcagcctctcgagtagctaggattacaggcacccaccaccacgcctggctaattttttgtatttttactagagacggggtttcaccatgttggccaggctggtctcaaactcccgacctcaggagatccacccccttggactcccaaagtgctgggactacacgcgtgagccaccagaatatatatatttttaagacagcattttactctgttgcccatgctgtagtgcagtggcacaatcatggcgcactgtagcctcgacctcccagggctcagatgatcctcccagggctcaggtgatcctcccagggctcaggtgatcctcccagttcagccttccgtgagtgtctgggactacaggcaaataccaccatgcctggctgcctaatttttaaactttttgtagagacgaggccttgctatgttgcccaggctggtctcgaacttctgggctcaagcgatcctctcacctggcctcccaaagtgttgggattacaggcatgagccactgcacccagtttaagatttacaatgggccgggcacggtggctcacgcctgtaatcccaacactttgggaggctgaggtgggtggatcacgagctcaggtgatcgagaccatcctggctaacaaggtgaaaccccatctctactaaaaatacaaaaaaaaaaaaaaaaaacgggcgtggtggcaggcgcctgtagtcccagctactcgggaggctgaggcaggagaatggcacgaacccgggagtcggagcttgcagcgagctgagatagcgccactgcactccagcctgggggacagaccgagactccgtctcaaaggaaaaaaaaaataaaaaaaatatttttttaattcttgagctacatgttacagaaaacaccaagaagtttaaaatacagtccctgacattggttttaaaaaaacggagaagccagatgcaatggcttatgcttgtaatcccagcattttgggaggccgagatgggaggattgcttaagtccaggagttcaagactgcagtgagctacaatcatgctactgcactccagcctgggtgacaaaccaagccctagtctcaaaaaacaaaaaagaaagaaactgaggataggagatccatgaggggctaccaatgaaacaagactgttacagatcactttgaagaagacggatgatggatatgtggatgttcacgataccattctctctcaacctacagagattcggatgttaaaaagaaagtttcctgccctcaagaagcgagtggattcatcatgttgcccagggctggtctcaaactcccgggctcagacaatctgcccatctcagccaaccaaagtgctaggattacaggcatgaatcaatgcgcctggcctcaatatagcacttctaatccggaggaccagccaaagatgtcgagagcagtaagaaactgtaaattacaagcaccagggaaaaaggaatagcagaacaacagcatgggaggacagaaataactctgcccaagagtgaagaaaccaggatcttagaaccagctggactaacatatgatgactgtaaaaaacttcttggggcttgagtttaattgtcaattgaattgtaacaataccaattaccttagcaggaagagagtgatgacctgagctggttctttatgcttatgcacctctttttattaaggatggtttttgcttaactttatacttctgggcttctccctgaatgtttttttgttgttgttgtttgttttgtgtgggcttttttgtggggttttttttgagacaggtcttgctgtgtcacccaggctggaatgcagtggcgtgatcatggctcactacagcttcaccattctgggctcaagtgatcctcccacctcagcaacctcccccacctcccccaagaagctgggactaaaggtgcacgctaccacacccagctaattttttgtattttttatcagagacagggtttcaccatgttgtccaggctggtctcaactcctggcttcaagcaatccacctgcttcagcctcccaaagtgctgggattacaggtgtgagccactgcacccagccctcccctgaatgttgagtctcaaaatcctctgaactaaacggcattattcctgttatgcagacaaagaaactgaggccttagaggttctgatatgagcaaaaagaaccagcacaggtcatctccccctcattcttttccaataagtagttttccatacactgaagattgccgataattgactttctcagcttctgttttcctgacatagagccaaggtggtaaagagaacgcccaccatcttgatagtgcctgcaaacatgccgagttctaaaggacatggattgttttctattcatagcattgcccagggcacatcctaggagaatggcgaaggcactgctgaatttaatcaagtaaaaaactgtcactttcctacctgcatgtagaatacctaaaaaataatctcaatgcttacctatccacagctctgtctagcaagtaaaacagagcctgaagtaccacatgttggactgacttgtggggatgatgcaacctggcagtaaagagggcaatggaggctcctgttgggtcccgaacattctaaagcaaataaaacaagaaacattaaaaaaatcaaatagaaaatcacagcaattactaagacttatatactggataagggtttgatacatgtagaaaacagatgctaacaataattccctgacttcaccaattgctgtccaaagggaagagtgttaatatcatcctttgtctgattctcccaggactccctggaccatatttctgtggtaagaaaaaaaaaacacattctctttgctcttcaactacagacagatcaaaggatggctgtgcactggcttcctagctaacttccctggcagaatggcaaaagaaacaagcagcaggagagaaccagggaacaggaccatgatttccaccctctgccttaaaagtgccattgtatgtttacttgaaaggctgaggtctcaactaagtggagagcttgcgttaaatatggaagcatgggtgtctgacacattgcatatctctcccaaagaccatgactaaccttaatggaccaactgaagaaacttttctaagtctactgtacaactgattttccataattcaattattcaattatcattagtaactctaattactagaaactattagtaattcaattgttactaaaataattttataccaaactgcatggctgtttcacatctgctcctaactgtggagactctctagattcaggataaggtatataggaacaaagtccaaacagggggggatggaggagggatagcattaagagatatacctaatgctaaatgacgagttaatgggtgcagcacaccaacaaggcacatgtatacatatgtaacaaacctgcacgttgtgcacatgtaccctaaaacttaaagtataataataataaaattaaaaaaaaaaaaaaaaaaacaaagtccaaacaggacaccagttaaaaaaggaagtaataaggccctacaagataggtccctaaacactcactaagatggtgaattttccactgaggatctcagaacgaagaggttcctcatgaggtttcagctttacaatgccttccttccttcgagtttcctaaaaaggaagcacagcaaaatgtattaatatgaaaatactgtatatccaggacagcaccatgtaaccaccaaatctcagagataaggtggttatcaatgaatgaatgaattataaatttcataactaaataaattttgtaactaatttcataaccaattctacttcatttagttgaattagaattcaattaaatgggccgggcgcagtggcccacgcctgtaatcccaccactttgagaggccaaggcgggcaggtcacctgaggtcaggagttcgagagcagcctggccaacatggtgaaaccttgtctcggctaaaaatacaaaaattagcctggcatggtggtgcgcgcccataatcccagctactcaggaggctgaggcaggagaatcgcttgaacccagaaggtggaggttgcagtaagccaagacagcaccactgcactccagcctgggtgacaaaatgagactctgtctcaaaaaaaaaaaaaaaaaaaaaaaagaattcagctaaatgaataatgaagtcaactaaatgaattatgaatttctttgtaacctgcctccaagccagtcaagcattttcggaattcctgtccaaagctactttatcagcccctcaggtagggtatttttctctgactcagtaagaaccctaaccctgaagagtaaccagtatgttacattcaggtgcaggatcaaggttcttaaacacgcagcagcactgacatggtaccaggacactaaaatatggacctcaaaaatgtctggatgcctacgttctcacatattttctaggtttaggcctctcctatgtttaaataggagccttctctccacctgatattgtctccaacagcagctaccatgacttcattttcctcaccctgatggccagattctttttttttttttaattgagaccaagtctcacactgttgctgaggctggagtgcagtggcatgatcttggctcactgcaacctccacgtccaagagattctcttgcctcagcctcctgagtagctgggattacaggcacgtgccaccatgcctggctaatttttgtgtttttagtagagacggggttttgccatgttgcccaggctggtctccaactcctgggctgaagcgatccacccgcctcggcctcccaaagtgctgggattacaggcatgagccaccgcgcccagcctcttcagttctcctcttaaatgacaaggttgaccacctacacttcctttttccggagacattctctacctttatataccgataacaaaaaaatattatcttggtttgtcttatttcatcaaccgcttgttttaaacctcttaggctgggcacggtggctcatgcctgtaatcccagtactttgggaggccgaggtgcgtggatcacttgagctcaggagttcgagaccagcctgggcaacatagcaaaaccccgtctctactaaaaatacaaaaaattagccaggtatggtggtgcatgcctgtggtcccagctactcgggaggctaaggtgaggtgggaggatcacttgagctcaggaggcagagatctgcagtgagctgagatcatgccacttcacttcagtctgggagacacagcaagactctgtctcaaaaaaaaaagtgcttccacagaatccagtgctgccttatcataacatttctacaactctttgtttattttctctttcttttttttttttttaaacagtctcactctgttgcccagactggaatgcaatggtgtgatctcggctcactgcaacctccacctccttggttcaagtgattgtccctcctcagcctcccgagtagctgggaatacaggtgccactacacccagctaatttttgtagttttagtagagatgcggttttgccattttgttcaggctggtctcaaactcctgacctcaagtgatccacctgccttggcctcccaaagtgctgagattacaggcatgagccaccgcacccagccctagtctctctttctaaatagtaatctctgcacctggaacacagtaagtataaaataagtatctgttgagtaaatgaatgaatattgaatgagctggtccacaagacagatgtaaccaaacttcagttaagctaatcctagtgcttgttatcccaatttttttttttagggagattttgtatttctttagaaggattctgaccccaaagtaacatgctgtatagtgttttatcaaagacactactaactgagaaagcaaacaagcacaaaaccaaagtctatgccccctcaaaaaacaaaaatcaaaacaaagtaaaatcctgatgccgctacatttgcataaagatactttaagataatggacctagctaatacacagttgctcttcttttccagtgttaaaacttcccttcctgaactgcccactaagctcatcattcatctgaatggcaagtttctaaaagccttagacaacctgaaaaccaagattttcatgtggccagaggccaatgaaaagagctaggattaaaactctaggaagggtgaacccctatcctgccaccaggatgctgtcaggctacttcctccgtctcaatcattagatgtggcatcctggtctacgatcaaaacttaggtacaaaagtagtgccttccagtagctgccttgcccagcttcagctctcacaagggctcctggatatggatccattttttatgaaagtgaggaggaacacttagagaaccaatgtgtgtgtcgagcatgacagggacaacagcaacacttaacccaactgccacaggtctggtctacccctgagccacatactctgtaggagtggaacaattctatggcacggagcacatcaaacttccttgccatgaggaacttgacagccacattccaagacagcggggaaacattgtactgaactgtccacttgttaatctcttcgagaaactgcttggtagcctgtttgacaaagaaagaaagaataattagtaagaagagagcatatttatggagtcaaaaaacaaacaagtgaaaactatcatcccttctccaagcaagtctgaacccagtttgctacagggagcagggaaagacaaacaaaaaggtagaaacaggtctgaaaccagacatagttaaaatttgtataattcaatgaggccagaagccagatctaggttcagaaaacaggacttagtgcaggtatgcatgaaaaaatgaggggggagaagagggatcctaaatgagatgcaaattactagtcccaaagcaaaaaataaaaaaatttaaaaattttgggaggccacactttgggaggtagaggtgggaggatcacttgaggtcaggagttcaagactagcctgaccaacatggtgaaactccatccatctctactaaaaatacaaaactagccggatgtggtggcgcacgcctgtaatgtcagctacttgggaggctgaggtaggagaactgcttaaacccaagaggcagaggttgcagtgagctgagatcatgccattgcactccagcctgggcaacaagagcgaaactgtctcaaaaaaaaaaagaaagaaagaaaaaaaaagaaaacaaaaagaaaagtggccaggccttccgaaggattattgcctaatgcagtgtagtatagcagtctcagctgctgctttggtcccacaagccaaatggacacagcaaaagaatcagaaaatggttttggctttggaatttgaggccagtaaaattattaagaagaacttagccaatcaaaagagcagctattctttgtgctaactgaccccactggacctcttcatgctttatatggcaaccccaaaactggatactagtacccagagtcaataacagcccctctggatagtggttttggaaaggggaggaaaattttcatttttactgtctgacccaggctggcaagatgcctgcttccagaactgtttctatctctcaactaattcatgttcttttatgcactctcatcctatttctccttacattataaccaatttcctttttagacaaactacttttctgtttcttcattttagaatgatttaaattgggatttttttttttctttttttgagacagggtctcactctgtgacccaggctggaatgtagtggcacaatcttggctcactgcagcttcgaccacctgggctcaaacaatcctccagcctcagcctctcgagtagctgggactataggcatggcatatgtcatcacacccagtaatttttttctttgttatttttagtagagacaaggtctcactacatagcccaggattggtctcaaactccggggctcaagcgatcctctcatgatccctctcaaagtgctgggattacaggcatgagccactgccctcagcacattttttttttttttttttttgagacaatatctcactctgtcacccagcagactgcagtgcagtggcacaattactgctcattgcagcctcaaactcctgggctcaagggatcctcctgtccccgccttccgagtagctgtgactacaggtgcacaccaccatgcctggataatttttttgattttttgtagagacgaggactccctttgttggccaggctggtcttgaactccagtgctcaagtgatcattccatctcgcattcccaaagagctgggattgcatctgtgagctaaattggaattttttttttagatagtctcactctgtcacccaggctggagtgcagtggtgcgatcttggctcactgcaacctctgcctccagggttcaagtgattcttctgcctcagcctcccgagtagctgggactacaggggcacaccaccacgcctggctaatttttgtatttttagtagaggcaaggtttcaccatattggccaggctggtctccaactcctgacctcatgatccgtccgcctcggcctcccaaagtgctgggattacaggtgtgagccaccgcacccagccaggaataatttttttgtaggcattctacactactaaaagcttcatgcatggctattctgtcccttccatccagaaacttttctcagctgtttgtctgcaatatgacgaacctgatgagaattctgaattttaaccatacctctattcccaatcaacccacagttatgacttatttattcatatttaataagcacctgttatttgttaagctaatacttgcactgaaaggtataacgaataaaaaaatgaggtttgcttcgaaaggtataaaactagcctaccatgtgaccatggacacggtaattctgtctttgctaatttttcaattgaaaaataaagggaggaccgggcacggtggcccacaactataatcccagcactttgggaagccaaggcgggtggatcatttgaggtcaggagttcgagaccagcctggccaacatggtgaaaccctgtcactattaaaaatacaaaaatcagccaggcatggtggtgcatgtctgtaatcccagctactcaggaggctaaggcaggaaaattgcttgaacccaggatgtggaggttgcagtgagccaagattgtgccattgcactccagcctgggtgacagagcaagactctgtttcaaagaaaaaaaaaatggctgggcgtgttggcttatgcctgtaatcccagcactttgggaggccgagggcagatcacgaggtcaggagctcgagaccagcctggccaatatggtgaaaccccgtctctactaaaaatacaaaaattagctgggcatggtggcatgcgcctgtgctcccggctagtcaggaggctgaggcagaagaatcgcttgaaccaggaggtggggttgtagtgagccaagatcgcaccactgcactccagcctgagcgacagagagagactccatctcaaaaaaaaaaaaaaaaaaagaaaagaaagaaagaaagaaagaaaaagaaagggagggctaggcacggtggctcatgcctgtaatcctagcactccgggaggccaaggcaggaagatcacttgaggccaattcaagatcagcctggccaacgtagtgagatcctgtctctataatagatatatatattacattatatatattacatattatattattatatattatattataatatataatatattattattataataaaatatatattataataataaaaatatatattataatatattatattataatatattataatataatttattatataatattattatattataatatattatatattattatattataatatactataatatatattattatattataatatactataatatatattattatattataatatactataatatatattattatataatatactattatatatattattatattataatatatataatatatattattatataatatatataatatatattattatataatatatataatataatatattattataattattataatataatatataatagaatatattataatatatcataatataatataatatatattataatatattatatattatgatatattatatattacgatatattatatattattatatattatattatatattataatatatatttttattattataatgtatattttatattatatataatatatataagaaaaataaagagaaaaagcataatagcaatgacctacttcggagtcttggcaacaagtcctaccttacaaatacaattcaaattgctacacactatttaaacaactggcaaactaaaatcccaggagagtcagcaatacctcataacagagcatctgattcatcccccaatttctaggaaaggacaaaagtactttataaaccccaggaaagtctaaacggcctgaggctgcacctgagctttagagccttacgattaaggcaacatagcttacaccattggagaaggaaagaaccagcaaaaccaatcaggcaaagtgcatgaaaagagccaagaaataaaggccatgaagaaaagctttcagaagatcattctggcctggaaccagctgaagccacgccagagaaatgagtcccagagaagacaacaggacaaacttagaatgctccttcagaaaatagtttgaattgcctctgtggagtgagtggccagcatcaaaatgaggaaagatggaaggaaaaagaagtgagcacagaaagatcccagaaataaaactctagccagtcagtaaattccccaggagacatggtacctgtttttgttttttgttttttctgctttttttttttcttttgagacagaatctcgctctgtcgcccaggctggagtacagtggcgcaatcttggctcctggcaagctccacctcccgggttcacgccattctcctgcttcaggctcccgccaccacacccggctaatttttttgtatttttaatagagacagggtttcaccatgttagctgggatggtctcgatctcctcacctcgtgatccacctgcctcggcctcccaaagtgctgggattacaggcgtgagccaccacccccggccgagacatggtacctgttttttaattaacctattatcctttaaatacagttctctagtgggcctctctgatgttgcttatagaataaaacaccagaataatagaacatatttttcctgctacttagctgggtatacaatttctaataaaaaataatcaacggataaatcaatgtataagtagaagtggaaaatgtaaatgaccaagaggtgatatgaactcatcacatatccatctgttaagataaattttcattttttggctgggcacagtggctcgcccctgtaaacccagcactttgggaagccaaggtgggcagatcatgaggtcaggggttcgagaccagcctggccaacatagtgaatgaaaccctgtctctactgaaaatacaaacaattaacagggtgtggtggcaggtgcctgtaatcccagctacgtgggaggctgaggcagtagaatcgcttgaacccaggaggcagaggttgcagtgatccaagatcgtgccactgcattccagcccaggagacagtgcgagactctgtctcaaaaaaaaaaaaagataacttttcatttttcataaataaaccatgtcctaataagagaaaggcatgcaggtttcacacacttccttcaaagtacatcttgccttcctttttattaagctcagttcctccaaggtccttaatgttctgtagctcccaagagctgttgccttgagctgacctctgtccccctgctggtcaggatgttattcttggctttaagcacaggaacaattcctcctggtttggcctgaccaggccttgcatgtagagtccagtgtactataaacagtgatgtgatatttacagatacaaatacacatgcgtagcacctgctctgttcagcctcagattcaccctcctgcacacccatccctctggtggaagagatgaacctctaaaaggagtcagaaagaatggcctcatcttcaacaaccttcctttagacagttaatcagatttctccctctgcttacacataggtttaacatgaccactgagtacaaagtaatttgtagctctgctggttaccagaaaaacaagtcccagcaactttaatcagcaacacagtcttcagaagggataattgaaattctcaaaattaaaactcagtttatttcctagtgaaagaaagaatgagccaaaagatgagtcacagcttagaaaatattttaactccaggacaatggtttgaatctatctatgcttatgaaacacaagttgttaacacctggcagctaaggaagagctggagttcaaacagctctggtcttcctttgggataaggtctgaattgatatatggagaaactaacattaccacttacaaccctccttaaccagtttttcaggtaagggtaagatttgttttgttttgcttttttgagacaggttgttgctttgtcaccgaggatggagtggagcaatcatggctcactgcagcctcgacctcctgggctcaattgatcctcctgcctcagcctttccaagtggctgagactacatgcacacgtcaccatgcctggctaatttttgcattttttagtagagatggggtttcaccatgtagcccaggctgatctcgaactcctgggctcaagaaatccacctgcctcagcctcccaaagtgctggaattacaggcatgagccaccgtgcctggcctcaagggtaagatttgttcctgcatagtcaaaaagcatactataattatctacttctcccacaaccatgtttaaataaataaaaacaagtttcttgactatggccatgaagataaagatactagagaacctgctataaaacagctgagaaagctgtcaattaagcagggtacaccctggacacaattcattagtgttgaaataatggtatcagagagaataaaaccaacaacatagcctccatgttacatcaaactcccaagagcagctataattttgagatgagctttgggcaaggaactagccactcaagaggacaagaataatgtgctggcactctcagttccacaggtagtaccttaaatcctatatcccaagacaacctaggagagtgaagagccagacctgtaagaaacctgctcttgaaataaacaaaaaacttctgtctcctgaaatatcagttacctagcaacaaaggagaaagtttagtgtggttttggggattataaagaaccaatccatcttcttattcactactgtgtgttatttgggcaagtcatttaacctctctgagccacaatttcctcaccttgaatgagaaacggatggaagagcacccactaccatacctagcacttggtagtctctgaatggatgaatgttcattctcttttttctttactctggtcatttcacactaaaacttctttcaacaaagatagaatttcttagaatcatatgacctctgttgcttccctttagtctgtatcaatgcaatctctctaatccattttatacaaaaccatacatttaaactagaaatatgtgttcaggctgggagtggtggctcacatctgtaatcccagcactttggaaggccaaggtgggaagactgcttgagcccaggagttagagaccagcctgggcaacatggtgagaccccatctctacaaaaaaatttaaaaattagccatgcatggtggcacatgcctgtggtcccagctactcggggggctgaggtgggaggagtgcttgagcctaggatgccaaggctgcagagggccaagatcataccactgcagtccagcctgggtgactgagtgagactctatctcaaaaaaaaaaaaaaaaggccaggtgcaatggttcacgcctataatcccagcaccttgggaggccgaggcaggtggatcacctgaggtcagaagtttgagaccagcctggccaacagggtgaaacctcgtctctactaagaaaacaaaaattaaccaggtgtgctggcttgcgcctgtaatcccagctactcaggaggctgatgcgggagaatagcttgaacccaggaggcagaggctgcagtaagccaagatcatgtcattgtactccagcctgggtgacaagaaagaaagaaaaacaaaagaaataaacattcaactgaaaacgattttttttttttttgagacagagtctcactctgttgcccaggctggagtgcagtggcgtgatctcggctcactgcaagctccgtctcctgggttcacgccattctcctgcctcagcctcctgagtagctgggactacaggcggccgccaccatgcctggctatttttttgtatttttagtagagacggggtttcactatgttggccaggatggtctcgatcccttgacctcgtgatccacctgcctcggcctcccaaagtgctgggattacaggcctgagccaccgcgcccggcctcaactgaaaacactttttaaaggaccaattattccttattcaaggctctgtggctataaagaaaaagctgaggccagaagtatttagacttcagttcccatctttttgtccctactctcagacttctctggcagctccagagattaacaatgccatcctaggcacaagctccttttaacagcgcaaactatggagaggtctcaatacaataaagaaacaggtgttgattacaggtgttgtgcagaacaaacaccatgaaaaaatgcagtcagtcatcctgcaatgaagacctaaataaggaaagtgattcaagataagatgcaatgtctggcttttaacaaatttgaagatacttctgtatttcaacaaatatgccatttctccattatttcagtgatggatgcattaatgaactaccttcctctcatgacctgtttcccccctctctccttcattgtgattactgcctttttatatctattgatctcttcagcccatattaatctgctaggtgagactctgagcaaagacacactggtttgctataaggcagcaagaggtttgatgaatttccaaactaaaactacgatttttccataagcactttgttaatgtaccaaaaaaggaaacaaatccagtccctttaatatttactggtttatctcaaatattttccacttctcaggaaaacattgccttttcttaaaatgtgattttaaaagagataatgctttcttaaataggctcttactgcatttgggaaaagttttaagtatattttctgattttatcgtattataaaacaatgtaataacaaaaatttgcaaaaagtaaaaggccagtcataatctgtgcacacacacatttaaagaaaaacttaagggaaggggaaaagaaaggattagtcaaacattcacaacaaatatttgctgagggcccattctgtgctaatcagtacagtagttgttgagaagacacaacatagatcgcttcttggcctttcgctaagatcaagtgagaagacacaacatagagacataaagaccctattccaagcagtttacaatcatttaactatggagacagatgtataaatacatctttaccacataatgtaataaattctaggaaggttctatgaacagaatgctatgggattcaaactctctctatggatataaaaaaaatttttttaggagtgccttgaaggatgagtaggaatctgtcaggcagagaaaagtattctagtcagagaacaaaatgtttcaaatcagggtcatgaaagaacagggcttattggggatatcatatagctagtgtgtccaatgtgtatgagggagaatggtgggagatgtgtgaacaggggggctgaaccagactgggaaggcccttgtatgctgtacttcaaattccagacatgatcctataaacataaaagattcaatagagatctttaagcaaagggatgagatgatgagtttggttcccctctcccacctcaaaaaaataactataagcagtggggaagtcagactgaaaggaaaaaaaatctagcaacagggaggtaagttccctgaagacagggatcatatctattttattcacctagttcctagcactgtgcctggcacaaagcacttacttaataaatatctatgatgaatgaatgaattaattattgaagtctcaatattattaacatttagagggcagacagaagatgaagaacaaaggaacttttacaattttcttttagaaatactagtgattgcaggccaggcatggtggctcacacctgtaatcccagcactttgggaggccaaggcaggcggatcacctgaggtcaggaattcgagaccagcctgaccaatatggcaaaactccgtctctactaaaaatacaaaacttagctgggcatggtggtgggcgcctgtaatcccaactactcaggaggctgaggcaagagaattgcttgaatccaggaggctgaggttgcagtgagccgagatcatgccattgcactccagcctgggtgacacagtgagactccgtctcaaaaaaaaaaaaaaaaaaaaactagtgattgctgaaaatcaaataaatggtgatctaaacaaaaacaagaggaatcgtcaaatatcttccctaaaaaaaaaaaaaaaaaaaaaaaaaaaaggccaggctcggtggctcacgcctgtaatcccagcactttgggaggcttaggtgggtggaccatgaggttaagagatcaagaccatcctggccaacacggtgaaacccccacctctattaaaaatgcaaaaaacttagctgggcgtggtggtgcgcacctgtagtcccagctactcgggaggctgaggcaggagaatcacttgaactcaggaggcggaggttgcagtgagccgagatggtgccactgcactccagcagggcaacagagggagactccatctcaaaaaaaaaaaaaaaaaaaaaaaggccaggcgtggtggctcacacctgtaatcccagcactttgggaggccaaggcaggcggatcacctgaggtcaggcgttcaagaccagcctggccaacatagtgaaaccctgtctcttctaaaaatacaaaaattagctgtgtgtggtggtgcctgcctgtaatcccagctactcaggaggctgaggcaggagaatcacttgaacccaggaggcagaggttgcagtgagccaagattgtgccactgtactccagcctgggagagagagcaagactttgtctcgaaacaaaacaaaacaaaacaaaacacacacacacacaaagcttcacagtaaagatagctctcacattacaggcttctccgaggaatgtaaagacttggtttaacatcaggagatctatcaaagcaatttttatgttaacaggaaaggaaaaaaaagtatataaccttctcaacagatgctgaaaatgcactgcgtaaaatccatcacacataggccccgtaatttttttctattaaagatgagaaggccagcaggtacctgctattaccaccactatgtaacattgcactgaaggtcatacctaacagaagccaaaagatgcgtaacaacctgatgcaaaaagacaggaattttaggccaggtgtggtggctccaatctataatcccagcactctgggaggccgaagtgggcagactgcttgatctcaggagttcgtgaccagcctgaggaacatgacaaaaccccgtctctacaaaaaatacaaaaattcgcccagcatgatggcacacgcctacagtcccacaagtgggaggatcacttaagcccgggaggcagaggctgcagtgagctgaaactgtaccactgcatggccccccagcctgggtgacacagccagaccctgtctcaaaaaaaaaaaggaatgttaaagaagagaataaaattcagaaaccacacagtgtatatctaagtatacagtatatgaaacaagtaatatgactattagtaagcaaaaagtattataggaatttagatatgcacataaatatttgtaggatacacaaaaaactggtaataatggtcacctctggggagagaaaatgaactggggctgggtgtaatgcttcacacctgtaaccccaacactttgtgaggctgaggcaggaggatcacttgaatccagtagttccagaccagcctaggcaacaaagcaagacccagtctctataaaaaaaataaaaaagaaagaaagaaagaaagaaagaaaatgaactgggaaacagcattggaagataactataagcaacctttaaaaaatttttttttggccgggcgtggtggctcacgcctgtaatctcaggtgtttcaccattttggccaggatggtcttgatctctcgacctcatgatccgcccgccttggcctcccaaagtgctgggattataggcgtgagccactgtgcccggccagtgatttatctttagtaaacaaattacatttactatcttctctctgaaggaagttggtatttagaagattttttttttttttttgagatggagtctcgcactgccacccaggctggagtgcaatcgcacaatcttggctcactgcaacctctgcctcccaagttcaagtgattctcctgcctcagcctcccaagaagctgggattacaggcgtacctgcctactttttgtgtgtgtttttagtagagacggggtttcactacgttggccagactggtctcgaactcctgacctcatgatccgcccgcctcagcctcccaaagtgctgggattacaggcatgagccaccgcgcccagcctagtagagaagatttaattggaggaccacgaaggtagaaatgttcacccatttgaatatgtgaacttttttattgttgttttttgagatagaatctccctctgtcacccaggctggagtgcagcggtgtgatctcggctcactgcaaccttggcctcccaggttcaagtgattcttctgcctcagcctcctgagtagctgggattacaggcgcgcaccaccacgccaggctaactttgtatttttagtggagacggggtttcaccatgttggccaggctggtctcgaactcctggcctcaagtaatccgcctcaagcaactcccctgacctcccaaagtgctgcgattataggcaagagccgccacgtctggcctgaatgtgtgaacttctaaattatatgtcacgttttatttattaggaagtgtgaagtatagaattccttatggctaagacctataaaggtatcattaaaaaatttaaagacataaaatacccctcagtttctctgcctttttgaaggaaagcatcagaaataaaaaacaaaagtgaaactgacttttacaaaagtttagtccattgagatagagcaaataaataggcacaatgaaagaaaagggaatagagtcaactaagtttgagtgcactgtaaatacttttttaaaaataatgtgtggccgggcatgttggctcacgcctgtaatcctagcactttgggaagacaaggcaggtggatctcaagagttcgagaccagcctggccaacatggcaaaactctgtctctactaaaaatacaaaaattagccagacgtggtggcacatgcctgtaatcccagccattcaggaggctgaagcaggagaatcgcttaaacccaggaggtggaggttgcagtgagctgagatcgcaccagcctgggtgacagagcaagactctgtctctaaaaaaaaaaaaaaaaaaagaaagaaagaaagaaagaaagaaaaatgtgaatcaggtctgattggaagcactacttctgctgccttcctgtttgtacttttcagttgctgcaagaatgatccaggcggctgctaggtgaggtgacacataattccagcattttgggaggctgaggtgggaggattccttgagaccagcatggataacatagtgagatcctgtctctatttaaaacaaaaaaaggatgatccaggtgggacgagatgactcatgcccgtaatccaagcactttgggaagctgaggtgggaggatcgcttgagcccaggagtttgagaccagcctgggcaacacagggaaacctcgtctctaaaaaaaaaattaaaaattagccaggtgtggtggtgcacacctgtagtcccaggtactcaggaggctgaggtaggaggatcacttgagcctaggaggtccaggctgcagtgagctgtgatcacaccactgcacttcagcctgggtaacagtgaaaccctgtctcaaaaaataaaaaaataaaaaataaaaaaaaagagacaggatcttgctcttgcccaggcttgagtgcagtggcatgatcatagctcagtgtaaccttgaagtcctaggctcaaatgattctcctgccccagcctccctagtagctggaactacaggtgtgtgccaccacatctggctacttttttaatttttgtagagatagggtctcaccagccgagactggtgtcgcactcctggcctccagtgatcttcccccattagcctactgaagcgctgggattacaggcatgatccaccacacctgccctcattttattattattattattaattaattaattaattttttgagacagagtctcgctctgtcgcccaggctggagtgcagtggcatgatctcggctcactgcaagctccgcctcccaggttcacaccattctcctgcctcagcctccccagtagctgtaactacaggtgcgcgccaccatgcctggctaattttttgtatttttagtagagacgggatttcaccgtgttagccaggatggtcttgatctcctgacctcctgatccgcctgcctcagcctctcaaagtgctgggattacaggcgtgagccactgcacctggcctttattattttttgtttttgagacggagtcttactctgtcacctaggttggagtgcagtagtgcgatctcagctcactgcaacctccacctcccaggttcaagcagttctcctgcctcagcctcctgagattgagaccatcctggaacatggtgaaaccccgtctctgctaaaaatacaaaaattagctgggagtggtggcgtgcacctgtagtcccagctactcagaggctgaggcagaagaatcgcctgaacctaggaggcagaggttgcagtgagccgagatggtgccactgcactccagcctggtgacagagcaagatgccatctcaaaaataaaataaaataaaataaaataaaatataaatcattaataggtctactcccagcaatctggataaatgtatattgggaactcagaaccaactgcttaaaactacatgtggcacagaatctttcacaatgagtttacaaacattttcttcctttaaaagataacccatattatcaggtctctttattctgatatccacatgttgcaagatagaaagtctttcttgttcatccgttaagggactatgtgcacttcaaactcaaagccctacaaatctcatcagaaagggtaaggccaaataaccatgaagaaaggcctaacacccatctgcctaatgaaaccaaataggatggttctgaaaccatgggactcttccatctaccacatcaagcattatgcaagaacccaagaagaaaaaaagctaactgctattaaaggattaatatcccactgggaacggatcaacaggaaaccagggttgaccaagtgaagtttcccatctgagtccaaagcttcaggcaacactgaggggccagagttaactgaactgttaaacacgaaaagctcctcagtgttaatgacttcctaccagcagaagtgaagggctaaggtttatcagcactccaccagccaagtgtgacagccccagatcaggaatagtttgtctccaatacctgatgagcagaaaatgttctattccttttcaaatgctatttctgtctcctttggctcatggttcctttgtacacataagacagcattagtcacatattaaagaaggcaattcaatcccttcattttttttttggctttttttttttaattatacttttaagttttcgggtacatgtgcacaatgtgcaggtttgttacatatgtatacatgtgccatgttgatgtgctgcacccattaactcgtcatttagcattaggtatatctcctaatgctatccctcccccctccccccaccccacgacagtccccggtgtgtaatgttccccttcctgtgtccatgtgttctcactgttcaattcccacctatgagtgagaacatgcagtgtttcgttttttgtccttgcaatactttgctgagaatgatgttttccagtttcatccatgtccctacaaaggacatgaactcatcattttttatggctgcccttcatttttctagagcaagattttgcccctcccagttcacacagaccaaagagcaaagtcctgcaagaaatcacagtagtagtaaccatgtgtgaagcatttaagatataccagagaaggaaccatactacatcatactcaacactgacaagctaggtattattaaccgcataaagaaatcaaaggctcacagagccgaagcaaactgtccaaggttactcaaccaataaatggcagagctgaggttttgagcactgaatccaagtcttttcaaatccttatagtctttccacttcactaaatgggcatgagacatacaagacacatatcattcatcttattgggtaatatatatgtcatttgtttgttgatctatgcacaaaattactctggaagaataaataagaaactggtagcatcagctgtctcagaggagaactaggtagctgggagacatggtgagaagattaatattttccatattcctttctgtatctttttaagtttaaatcgtatgactatattatccactcaaaaaaataacaataaaacatattagttttatatagcctttaactaaaatatacataacaggaatttttgaacataatatttttgaaactatgccaccaaacaataataagtttgttggtaatcttcatttcagggccaaaaaaatgagttagggagctctacacaggggtaaaggatgacagctgtttcacgaactgctagccttagatggggatgcttcaacgaggagtgtgccactctcactttcctgctggaggcatttgccaatagcatatttactaaacacaagctggcatctctcctctcaggtttaaaaaacacttgccaggccaaagttatcaaagaggatgaagaattcccagagacaacagaggaaataggtaaacaaggaaaacaaggaagtaaacaattctaaattgtcataggagaaaattcatgttaggaggttgagaggcagaatataacacagaagagaaacggaaaaaaacgaaacctgccgagtaaacaagcagctcctggccaggcgtgggggctcacacccataatcccaacactttggaggccaaggcaggaggatcgtttgagcccaggaatttgaaaccagcctggacaacacagggttatccaatctccacaacatatgaaaataaattagccgggtgtggcagtgtactgctgtggtcctagcaggaggctgaagggggaggatcacttgagcctgggagtccaagtctacagtgagctgtgatgatgccactgtgttccagcctgggtgacagagcagaacctgtctcaaaaagcaaaacaacaacaaacaaacaaaacacacacacacaaaaacaagaagctcctcatccaccaacaagagcaacatcatctaggttcccagagggaggtaacagaggtagctggtcacactctccacaagaacctgtagacagcttgccaactgccactcatgccgctaaagagtgagtgaaccacacaaccagaagaaacctgtaaagtctttctgggggaaaaaaaaatttaaagagcttggtaaacatagagagtgggaggggcctttggtaacattttttttttctcttcttccaactgatagcttagactttaggaaagaaaggaggaatgtgaatggctgtgaggaaattgaagttggctttccagatcatgctaaaacattcttacccttcctctactcccaaacctggcttattcctatttctccttcaggtcagcctaaatcctacttcatcctataaatttctactgctttccagccaagcactgaccaaacagtattataaagcatgttattgtctatctgctcccactaaactgtaagcttgggaagatgcaggggccaagggttctgtgccacaactgcatactcaacaccaagcatagtgacaccattctgataagtaaatgtgtcaatggtgatgggctcttggcctgctaaaagagtgtggttcagagagtaggaagaacacatttgaacacttgccaatctgattatgggaacttaaaatttaaaatacaggagagggccgagcatggtggttcacacttgtaatcccaacactatgggaggctgagatgagtagaatgcttgaccccaggagttcaagaccagcctgggcaacatagtgagacccccccatctctagaaaagatttaaaataaagtaaaacaaaacaaaacaaaataaaataaagtaagaggacagcaaaaaattcctaaataaaactgggaaagaacatcaggaaaataacatgagaagaaaagcaatgaaagaggtgactattaaatcacagaagaaactatctggaaattagatatcttaattccctgccaatatcttaacgtcagacatctataataggatatacaaaataaaataatttaaaataaatttatggccaggcgcggtggctcatgcctgtaatcccagcactttgggaggcggaggcaggtggaatcacttgagatcaggagttcgacatcatgacaacagcctggccaacatggcgaaaccccgtctctactaaaaatacaaaaattagctgggtgtggtggcgcacgcctgtagtcccagctacttgggaagctgaggcacgagaattgcttgagccagggatgggaggatgcagtgagccaagatcacatcactgcactccagcctgggtgacagagcaagattctgtctgaaaaaatagattaaagtaaatttatggattttgtaaaataagtaagacatggtctctacccataaaaatctgagtctggcagaactgtgaacacaatacaccaactaatgggcaaatggaattcaaatctttattatttttacttatttatttttgtcttttacaaacaaaagtaagtaattcagatctcaagaggggaagtggaatgacagcacatcccaaaatgatattccctggagaaatccacaaaccacagtagaaaatttctgaatgaggataaaagagagtaatggacatgatacagctactgggagaccccttcaaacttctcaataacagaaaatatagattgttttcttgactcagatcccaaaattgtcagggtgataatggtgtatagaaatagggaacttcagccaggcgcagtgcctcacgcctgtaatcccagtactttgggaggccgaggcgggcagatcacgaggtcaggagttcaagaccagcctggctaacatggtgaaaccccatctctactaaaagcataaaaaataagccaggcatggtggcacatgcctgtactcccagctactcaggaggctgaggcaggagaatcgcttcaacctgggaggcagaagttgcagtgagccgagatcatgccactgcactctagcctgggcgacagagcaagactctgtctcaaaaaaaaaaaagaaatagagaacttcattaaccttgacatttgctggatatcacatttaacttaaaaagggtgggtgggcacagaaagcctgataaattcttgtggacagtttcatcctaaaatgataagagaacgactacactggacattatccagactaaggagaaatactagatgaaaaattgaaagggtttcaagaagaaagtaaccacataatccttaacagtgtgatagccaacaactaagtgttgtcaacaggaggcagttaagaatgcaagttctagacagagcactagtcaccctacattaaagacccagttctgccacagcagaactctcactcaggcaagtcaaaaaccacctgtgccaggccaggcacggtggctcatgcctgtaatcccagcactttgggaggcctgggtgggtggatcacctgaggtcaggagtttgaaaccagctggccaaatggtgaaactttgtctctactaaaaatacaaaaacattaccagatgtggtggtgtgcacctgtagtcctagctactagggaggctgaggcaggagaatcgcttgaacacgggaggcagaggttgcagtgagctgagatagcaccactgcacttcagcttggccgacagagcaagactctgtctcaaaaaaaaaaaaaaaaaaaaaaggccaggcacagtggctcacaccggtaatcccagcactttgggaggccaaggcaggtggatcatgaggtcaagagttcaagaccaccctggccaacatggtgaaaccccgtctctactaaaaatacataaattagccaggcgtggtggcagacaaaacaaaacaaaaaacaaaacaagacaaaaaaaacctctgtgccatacattttctcatccaaaaaaggaaacctgcctatgctgtctcgcatgatcaaataactggctatccttgaaggcattgtgtaaaacttaactacactgcattaagtaacaccagaccttaacaatagctaatatttactggatatagggttctttttttttttttttgagacgaagcctcgctctgtcacccaggctggagtgcagtgactcaatcttggctcactgcaacctcggcctcctgggttcaagcaattctcctgcctcagcctcctgagtagctgggattacaggcatgcgccaccacacccggctaatttttgtatttttagcagagatggggtttcaccatattagccaggctattgtcgaactcctgatctcaagtgatccacttgcctcagcctcccaaagtgctgggattacaggtgtaagccaccatgcctggcccctactgggtacagagttctaatcacaagtcagagactaagatttagatagattatcaaattctctcaatagcccttaaagattgatactattattatccctatattacagttgagaaaacagatttcgaactgttaggtaacttgtccaaagtcccagaacaagaaaagtggtagagcctgaatcagaacacaggttttctgactctagagaatccacattataaccactgtattacagtgctttcaaaatgcagatttaactaaattaaaatatcataatataaacttcttctttttttttttttgagatggaatctcactcttgtcacccaggctagagtgcaatgggacgatctcggctcactgcaacctccacctcccaggttcaagctattctcctgcctcagcctcccaagtagctgggattacaggcgcccaccaccatgcccagctaatttttgcacttttaatagagatagggttttgccatgttggccaggttggtcttgaactcctgatttcgtgatctgctcacctcagcctcccaaagtgctgggattacaggcatgaaccaccacgcccagactaatatcataatatgaacttctaaagagaagacagatggtggtattgcttttttgttttaatttttgtttttgttttttcctttagagacaaggggaaatttttttttttttttttttgagacagagtcttgctctgtcacccaggctggagtgcaggggcgcgatcttggctcactgcaagctctgccaccagggttcacgccattctcctgcctcagcctcccgagtagctgggactacaggcgcccgccaccacgcccggctaattttttgtatttttaatagagacggggtttcaccgtgttagccagaatggtctcgatctcctgaccttgtgatccgcccgcctcagcctcccaaagtactgggattataggcatgagccaccacacccagccaaaaatttcaaaaaaagaaaaatagaaacagggtctccctctgtaaccaaggctggagtgcagtggggcaatcatagtccactgtaatttcaaactcctgggctcaagcaatcctcccatctcagcctcccaaagtgctgggattaacaggtgtgagccaccacacccagccagatgctggtgttttttaaagaaatccttaaaagtgagataatatgaattatgcaattaattataaattattccaatttcatttttttttctttgagacaaggtctcactctgtaactcaggctggattacagtggtgaggacatggctcactgcagtcttgacctcccaggtgcaagtgatcctcctgcctcagcctcctgagtagttgggactacaggggtggaccaccacacttggctaatttctgtattttttgtagagacgaggtttcaccatgttgcccaagctggtctcttaactcctcagttcaagcgatctgcctacctcagcctcccaaaatgctgggattacaggtgtaagccaccacatctggctaatttcaaatttaaaaagggaacaatctgaagagactagcacaatcgaaaagcattcttgagtacagatgttaaaaggccactcacaaacacgtacaaaaaacagaaggcatagttaaaaaaaagagtggtggctctaacctaaaagaaaagtaacagcccataatgaggcaaggcttgttaataaagctaaggataacaagaagggttttgtgagaactgtctagaccttggaaggctggggcggaaggattgcttgagaccacgggttcaaaaccagcctaagcaacatggcaagccctcgtctctactaaaattaaaaaattagccaggtgtggtaaagcatgcctatagtcccagctactcgggaggctgaggtgggaggattgcttaagcatgggaagttaaggctgcagtgagccatgactgcatccctgtactcttgcctgagtgaccgagtaagacccttgtctacccccacccccaccaaaaaaaaaactgtcttgataaactcctttttccgtttctctatcaagtacaatgttcagtttgaagtgggaaaaaataagccctgtaaatagagagaaatgaatttcaaaacagcagagaccctaacaatctgacaatcctgagaactccaaggcagcctgataaacccctgtggtagttttttttttttttttgagacagagtcttgcttcttcacccaggctggagtgcaatggcgctatctcggctcactgcaacctccacctcccggattcaagcgattctcctgccttagcctcccgagtagctgggattacaggcacccgccactacatccagctgatttttgtactttcagtagagacggggtttcaccatgttggccaggctagtctcgaactcctgacctcaggtgatccacctgccttggcctcccaaagtgctgggattacaggcgtgagccaccatgcccaaccagtggggtcaattttaaaggacataaaaaataaaaagattggctgggtgcagtggctcacgcctgtaatcccagcactttgggaggccgaggtggacggatcatttgaggtcaggagttccagaccagcctgtccaacatggtgaaaccccatctttactaaaaacacaaaattagctgggtgtagtggcgcatgcctgtaatcccaactattagggaggcagaggcaggagaatcgcttgaacccgggagaaggttgcagtgagccaagatcgcaccactgcactccaacctgggcaaaaagagtgaaactccatcttggaaaataaataaataataaaaataaaaagtttttttttcttttttgttgagcagggtctcactgtgttggccaggctgctcttgaactaggctcaagcgatcttccttctttggccacccaaagtgttgggattacaggcatgagtcaatgtgcctggccaaaaattaaaagattttaaaggaaaagcctggaaggagagagacaaacagaccaatgtttactgagtgcttatagtgtgctgggccatgaggcaagtactttacatccatgttttattcaacctttccaacaggcccatttgtagatattaagacttttaaaaaaatttttttcagacatgaaatctcactgttgcccaggctgaacttgaattcctgagatcaagggatcctcctgcctcaggctccagtgtagctgggactacaggcatgcaccaaccaccctgccgagggctgttaagacattttaaatatgaggaaatgaaggcccagagaagttaggacttcaccaagtcacattgcttcccatgatacaaccaagattgcaaaaccaagtctgactctaaaacccacgctctttttctttttgaaacggagtctcgctctgtcacccatactggagtgcagtgccacaatctcagctcactgaaacctctgcctcccaggtgggttcaagtgattctcctgcctctgcctcccaaatagctgggactacaggcatgtgccacaaagcccagctaatttttctatttttagtaaagagggggtttcactatgttggacaggctggtcaccccatgcatgctctttccattaatttactctgtatctgtctctggcctagtcccattgatggcaatgagcacattacagaggcgtagcatcccaaacaaggaggcttactagacctcatctgtaatatagacagtccccaatttatgatggtctgacttacaattttttgactttagccaggcatggtggctcatacttgtaatctcagcactttgagaggctgaggtgggcagatcacttgaggtcaggagttttgagaccagcctgaacaacatggtgaaaccccgtctccactaaaaatacaaaaattagctgggcatggtggtgcacgcctgtagtcccagttacttgggaggctgaggcagaagaattgctggaaactgcctgggaggtggaggttacagtgagctgagatttcaccattgcactccagcccgggtgacagagtgagactccatctcaaaaaaaaaaaagaaaaaagaaaaaagaaaaaaaaatttgttttgacttaacaatggtacaaaagtgataagcactgccgggcacggcggctcacgtctgtaattccagcactttgggaggccgaggtgggtggatcacctgaggtcgggagttcgagaccagcctgaccaacatagagaaaccccatctctactaaaaaaaaaaaaagtagaaaattaacggggcatggtggcgcatgcctgtattcccagctactcgggaggctgaggcagtagaatcacttgaacccaggaggcggaggttgcggtgagccaagatcacaccattgtactgtagcctgggcaacaagagggaaactccgtctcaaaaaaacaaaacaaaacaaaacaaaaaaacagtgataagcattcagtagaaactgtactttgaacacccatacaaccattttgtttttcactttcagtattcaataaattacatgagatactcaatgctttattataaaatcacctttatgttaaatgatcttgcttaattctaggctaatgtaagtgctctgagcatgtttgcggctcagatatgagctgaacatcataggataagctatgctcagtaggttaggtgtattaaatgcattttcaacttatgatattttcaacttacgatgggtctattgggacataaccccacagtaagtcaaaaagcacctaggctgtcttcagttctgagtgctgaactttaagagagtcaccggcaaactagatatggtcccataaaagatttagataagggcactgggtcatgctgaccatacagaaggagggcctttagctaagagaacaaatatatggtaaaaatagaacacaaatccaaaagatcaaaactggatggtgcaatgggctagaatggtactaaaaagcaacggcctttagagtcagacagccaagggtttgtattccagattctatcactcactgtttagaatccaggcaagttacttaacttctctgaaccttaatttcgacatttataaaacgggggtaatactacacaaaattgcaagaggggagaaaaggtaatatttgtaaaattcttgggacataagactcaacaaatggtagtgcacattaaatctaacaaaatgaaatttaaggatatgtgcaagtaaatcaattttagaagcaccagatgaaacttaacaggagtacataagaaaagaattaaagatcttagtagacttgaatctgtgaatcaacagcttgctaagactgccaaaaattattgtgaatttggagaccattacagaagcacagtgtccaaaacaaggagtcctatcagacttcattcatgatactgtctttagtcctgagtgctaaactttaagagggtcaccggcaaattagaatcaatccaggacagatgagaaaagttagtagctctgaaaacacagtaacttgcctcttcttcctggctctatattccctccactccatccaaccaaagctacctgacaactgcttctatctctatgccccagtaacacattcatgctcatatatccccccacaacatattcacgtccctcaattttgccccagttccaaagccccaaatggatctgacagagtgacttgttcacttctagtccaaaaatctaggatgaggcatgtgagacttgctgctaatctggccctgacctgcagattatacttgatgctaatctgcaccaaatctaactggcccctgcattcttcctgaggctgagacccaaccctgtaccctgggtaactgaattaatcctgagtctgagtcacatactcaagaaagtaggactcttcctgaatgtctccttgacccacagctccattactcccttaaagggatgaagctggtcagaagtatacaattagacaatgtcagtcatctcagccatttcaaacctgctagaccaatactttctttcttttttttttttttttttgattttttttaagacagaatcttgctctgtcacccaggctggagtattgcagtggcacaatcatgggtcactgcagcctcaaccttacaggctcaaatgatcctcccacctcagcctcccaagtagctgggactacaggagtatgccaccatgcccggctgaaaaaagaaaaaaaaatttttttttttgaaatagaatttcgctcttattgcccaggctggagtgcaatggtgcaatcttggctcaccacaacttctgcctcccgggttcaagcgattcttctgtctcagcctcccaagtagctgggattacaggcatgcaccaccacgcccggctaattttgtatttttagtagagacagggtttctccatgttggtcaggctggtctcaaactcccgacctcaggtgatccgcccgcctcagccttcccaagtgccagaattacaggcgtgagccaccacgcctggcctttaaaatttttttgtagaggcagggtctccccatgttgcccaggctggtctcaaactcctggactcaagtgattttcccacctcagcctcctaaagtgctggaattacatgtttgagccaccatgcccggcctagatcaatactttcaaatccaaaaaggccctcagataaactcaggaacaaacgtatatattctcacaaaatggtacaagttgatcagcttattgtacctaagagactatttgcaaacctacaaagaatgaagtcttaaatagctgcctgtaatctggatgtcctcactgcagtgaggcatcagctccccagcagaacccagacagtaaaatctgttaactcacatgtccagactctcagggcaactaacactggagtaacatgagcttccccctatggaatggtcttgtcaaaactggcaggttttcctggctgaatcagaacagcctgggtcttgtttcattcaatactcccttggaagccaagcatctctctagggaatgccatctgcagtggacatcaggtatctcaatgccctctttgcaaccatgcaaatatcctggttccatttctatatctcaagagactctgctctttcttcagatgagaaaaatcatgataaatgctagtctttgagaagtctgccttgctgttcctcttccagggaacagttcagttctagtccagaaccaaatgattcctggagctttcatccagttcagactgcttctatacctagttccagagccaatttataaattcaagacttcccttcctcaactgtacctgaatgtctaaattcacttctagatgtttccttgatcaacaacagcaccctagatattctctggatcactggttgtcagactttgagtatgcatttagagacgttaaaatacatattactggatcccacctcggagtttctgattcagcaggcctagggcaggacttgaaaatgtgcatttttgttttttatttacttttcattttattattattattattattatttttgagacagtcctcgctctgtcacccaggctggagtgcagtggtgtgatctcagttcactgcaacctccacttcccaggttcaagcaattcttgggcttcagcctcctgagtagctgggattacaggcgtgcaccaccatgcccagataatttatgtattttttgtagagatggggtttcgccatattggccaggctggtctcgaactactggcctcaagtaatccacccacctcggcttcccaaagtagtgggattacagttataagccactgcgcccggccaaaattttgcatttttaacaagctcccaagggatgctgatggtggtggtcagggaaacacactttaagaaccactgctctagccaggtgcagtagcctacacctataatcctagcactttgggaggctgaggcaggatgatcccttgagcccaggaaatggaggtggcagtgagctatgactgcaccacttcattccagcctcgatgacaaacaaagcgagacccccgtctcaaaaaaaaaaaaaaaaaaaaaaagagagagaggcactactctagatcaacaattttttttttctgtcgcccaggctggagtgcagtggcacaacctcggctcagtgcaacctccacctcccacgttcaagcaattctctgcctcagcctcccgagtagctgggattacaggcgcccaccaccacgcttggctaatttttgtatttttagtagagacggggtttcaccatgttggccaggctggtctcgaactcctgacctcgtgatcccccctgcctcggcctcccaaagtgttgggattacaggtgtgagccactgcaccggccttttttttaattattattttattattattattttgagacagggtctcgctctgtcacccaggctggagcgtagtggcacaatctcggctcactgcaacctccgcctcccaggttcaagcaagtctctgcctcagccttctgagtagctgggattacaggcatgtgccaccacacctggctagtttttgtatttttttgtagagacagagttttgccatattgcccaggctggtctcaaactcctgagctcaagtgatccacctgcttcagtctcccaaagtgctgggattcaggtgtgagccaccacacctggccgcattttctttattgtggtaaaatatacctaacaatatttatcatttttactattcctaaatatgcaattcagttgcattaaataaattcacattgctgtgtaactagcacctttctataacccaaaattgttttatcatacccagcaaaaactctgtacccattaaacaataattcccccttcccaactttccacagcctctggtattctactttctgtccctatgaatgtacctattgtaggtacctcaaacaagtggaatcacaacagttgtcctcctgtgtctggcttatttcatgaagccgaatgtttccaaggtccatcatggtatatagcatatatcaagactgccttccttttaaggccgagtaatattccattatatgtatatacaccattttgtttattcttctgttgatggacacttgggttgttccacctttggctattgagaatagtgctgctgatcagacgcagtggctaatgcctgtaatcccagcactttgggaggttgaagtgggcagatcacctgaggtcaggagttcgagaccagcctggccaacatggtgaaaccccgtctctactaaaaatacaaaaattagctgggtgtggtagcgcatgcctttagtcccagctacttgggagtctgaggcaagagaatctcttgaacctgggaggcggaggttgtagagggctgagatcacaccattgcactccagcctggtcgacagaatgggactctgtctcaaaaaaaaaaacacaaaaaaacaaaaaagagaatagtgctgctatgacatgggtgcacaagtatctctttgaggctctgtttcaattcttttatatacttaggagtgaaatttctgggtaatatggtagttctacctttaatctttagagaaactgccaaagtgttttccacagtggctgtaccattttatattcctaacagcaatgccaacacttgtttcccattttgttttgttttacttctaaccatcctggtaggtagggcttagctattattattatcacaagttttgatatgggcttttaccaatacttgtagcactgtaaagatagcatgacaacatgagaggttctgactattttccagcttcaaatggtttagcagttccattcaaaagacaagttttcacgattgcttctaattttcttgaaaaatcacctccaaggctagcatttacctagcttcaggttgactaagaaagaaaatgggctgggcgcggtggcacacacctgtaatcctagcactttgggaggccaaggtgggtggatcaccagaggtcaggagttcaagaccagcctggccaacatgccaaaacctcatctgtactaaaaatacaaaaattgaccaggcgcagtcgctcacacctgtaatcccagcactttggcaggccaaggcaggcggatcacgaggtcgagaaatcaagaccatcctggccaacatggtaaaacactgtctctactaaaaatacaaaaattagctgggcgtggttgcttgcacctgtagtgccagctactcaggagcctgaggcaggagaactgcttgaacccaggaggcggaggctgcagtgagccgagattgcgccactgcactccagcctggcaacagagtgagactccatctcaaaaaaaaaagaaaaaatagaaatacaaaaattagctgggcgtggtggcacacgcctgtaatcccagctactcggaaggctgaggcacgagaactgcttgaacctgggaggcggaggttgcagtgagccaagactgcaccactgcactccagcctgggtgacaagagtgagactctccctctccctctccccctccccctctccccacggtctcccgatccctctcttgccacggtctccctctgacgccgagccgaagctggactgtactgctgccatctctgctcactgcaacctccctgcctgattctcctgcctcagcctgccgagtgcctgcgactgcaggcgcgcgccgccacacctgactggtttttgtatttttttggtggagacggggtttcgctgtgttggccgggctggtctccagctcctaaccgcgagtgatctgccagcctcggcctcccaaggtgccgggattgcagacggagtctcgttcactcagtgctcaatgttgcccaggctggagtgcagtggcgtgatctcggctcgctacaacctccacctcccagccgcctgccttggcctcccaaagtgccgagattgcagcctctgcccggctgccaccccgtctgggaagtgaggagcgtctctgcctggccacccatcgtctgggatgtgaggatcccctctgcccggctgccaggtctgggaagtgaggagcacctcttcccggccgccatcccgtctaggaagtgaggagcgtctctgcccagccgcccatcgtctgagatgtggggagcgcctctgccccgccgccccgtctgggatgtgaggagcgcctctgcccggccgccccgtctaagtgaggagcccctccgcccggcagccgccccgtctaagaagtgaggatcccctctgcccggccaccaccccgtctgggaggtgtacccaacagctcattgagaacgggccatgacgacgatggcggttttgtcgagtagaaaagggggaaatgtggggaaaagatagagaaatcagactgttgctgtgtctgtgtagaaagaagtagacatgggagactccattttgttctgtgctgggaggaattcttctgccttgggatgctgttgatctgtgaccttgcccccagcccgatgctctctgaaacatgtgctgtgtccactcagcgttagatggattaagggcggtgcaagatgtgctttgttgaacagatgcttgagggcagcatgcttgttaagagtcatcaaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatggtcaacaaaaaaaaaaaaaaaaagaagaaagaaaatatttggggtggctgaagaaaagaaaaaaatgaatatttttttctttttaaaaactttctcactgggcacgatggctcatgcttgtaatcccggcactttgggaggccaaggtgggcagatcatttgaggtcaggagttcaagaccagcctggccaacatggtgaaaccccatctctactaaaaatacagaaattagctgggcatggtggcatgtgcctgtaatcccagctactcaggaggctgaggcaggagaattgcttgaatctgggaggcggaggttgcagtgagctgagatagtgccactgcactccagcctgggcaacagagcaagactccatctcaaaaaaaaaaaaaaaaatttatctgataacttaattccataataacgttgttttacccataaacaaaatggcacacactggcattcagtttccggaaatgtctaatggtttctctagagcatttagaaattaatctagaaaggttatttttgaaaacaaaagtatgtggaaaatcttgtatattttaatcttgctggctacaccacttctaagtccctaacctagccagaaataccattttttcttcatttttggggttttcaaggcatggaagagctagagcctccttagtgaggcaaatggtcattcccaaataaaactgtttaattgtcctcatatattacatttaagtcttcaggcctttctctcagtaactcttttccttcatgattccaagaaaaaaatcaggaaaatatagaaagtataaaagagcagtaaaaataacttcctggctgggtgcagaggctcacacctgtaatcctagcactctgggaggccaaaagaggaggattgcttgagcccaggagcacgagaccagcctgggcaacacagtgagacacccatctatattttgttgctgttgttgttaattactttaaagccaggcgcggtggctcacacctgtaatcccagcactttgggaggccaaggcaggtggatcacaaggtcaggagttcaagaccagcctgaccaacatggtgaaacgccgtctctactaaaaatacaaaaagtagccaggcatggtggctcgtgcctgtaatcccagctactcaggaggctgagacaggagaatcgcttgaactcaggagtctgaggttgcagtgagctgagatcacaccactgcactccagcctgggtgacagagtgagagtaaaaaaaaaaaattactttaaaaagccaggcatggcggcccatgcctgtaatctcagcactttggaggccgaggcaagtggatcacttgaggtcaggagttcaagaccagcctgaccaacatggtgaaaccttatctatattaaaaatacaaaattagcccggcacggtggcgcatgcctgtaatcccagctacttgggaggctgaggcaggagaatcgcttaaacccaggcgatggaggttgcagtaagctgagatcacaccactgtgctccagcctgggcaacaagaacaaaactccatctcaaaaaaaaaaaattacttaaaaaagaattccgttttttggaaaattttcttcctcaactttcttacatttgacccaagttgaaaaaaaatctagcttaaaaacagaaaaggaaaaaaaaaaatgggcaaaacgaaagtatcatggaaaaacaatttcaaaagctgttgtcccagatattgataggcaagtatatgaaatatactttcccattatactcactgtggtacttgagagattaaactgtatatatataagactgtggctccagctggagtgcagtggcatgaccatggttcattgcaaccttaaactcctgggctcaagtgatcttcccacatcagccaacaacagatatgtgccaccatgcccggctaatttattttttattttattttttattacttttatttgagaaagagtttcgcttttgttgtccaggctggagtgcaatgacacgatctcggctcaccacaatctctgcctcctggattcaagagattctcctgcctcagcctcccaagtagctgggattacaggcatgtgccaccatgccaggctaattttgtatgtttagtgagatggggtttctccatgttggtcaggctggtctcgaactcccaacctcaggtaatccacccacctcagcagcccaaagtgctggcattacaggtgtgagccaccgcacccagctaatttattattattattattacttgtgtagacatggggtcttgctgtgttgcccaggttggtctcaaactcctggcctcagatgatcctctcgccttggcttcccacagtactgggattacaggcatgacccactgcgcctggccaagatggattttcataaaggcaaagagcagaccttctattctgagagctacagccagaggcttatatgaactccccaacttcattaacctcattaaatcatataatttctgtcatacgtaaatgtacattaaacagtgacatcttggaacaataaataactgggaacaatgtagccacacctctacagggaaacttgtgagtggctgaaaccaggaatgttgaacccacaaatgtccagggagagctatctctggggtgtgtgtgtcatacacgaacatacatggttaaaggcagaggaagtgcactggagacagcagttaaccagaagagtgagtctcagcgcttctactgaaagcctctgaatatcatccctatatcttaaagacaatcatcctaggccgggcgcggtggctcacgcctgtaatcccaacgctttgggaggccgaggcgggtggatcacgaggtcaggagatcgagaccatcctggctaacacggtgaaaccccatctctactaaaaaatacaaaaaattagccgggtgtggtggcgggcgcccgtagtcccagctactcgggaggctgaggcaggagaatggcgtgaactgcactccagcctggatgacagagcgagactcgtttcaaaaaaaaaaaaaaaaaaaaaaaaagacaatcatcctaagcaaaacaatacctgcttcgtaggctatgtgaagaataaacaatttcaaaaaagtttcactcattctttagcaaacatattttagtttgttttctgtttttctttccatcttttattttaggttcagggggtacatgtgcaggtttattacataggtaaattgtgtgtcacagggtttggtgtacagattattttgttacccaggtaataagcatagtacacaatagacagctttttgatcctcgccctcctcccactctccacactcaagtaggcccaggtgtctattgttcccttctttgtgttcatgtgtacttaatgtttagattccacttataagtgataatgtatggcattttttttctcttttctttttgagatggagtctcactctgctgcccagtctagagtgcagtggtgtaatctcggctcactgcaacctctgcctcccgggttcaagcaattctcctgcctcagcctcccaagtagctgggattacaggcacctgccaccatgcccagctaactttggtatttttagtagagaaagggttttgcatcttagccaggttagtctcaaactcttgacctcaagggatccatctgcctcagcctcccaaagtgctgggattacaggcgtgagcccacacccctggctggtatttggttttctgttcttgcattagtttgcttagcataatggtctccaactctatccttgctgagaaagatatgatcttttttatggctcggtagtattccatggttggtgtatatgtaccacattttctttatgcagtcaactgctgatgggcactaaggttgattctatgtgtcagcaaacatattttgaaccctccaaaatatactaagaattcagaagttcgagtccctgtcctcattgcacgtaacaagtcctcctccttgacaggtactctatagtttaataactgccttcaaagaactagaaagcaattcctcaaggatagagagctccaaccttgctatacaaggacctggcacataccaacagataattcaaatatagtttgaatgaacaaactatatttctgcttatgatctaaaaaaaatcctcagttgacattaacacgataaagaattgataaaaaataacactgtgtggtgattatcaggggaacagagacacttcagggcaacactcagaaacatttggaggtatacatgtactgaaacatcacaatatgtataattattatgtacattatgtctttttttttttttaatagagataaggtctcactttgtcacccaggctggagtgcagcagcaaaatcatagctttgtaaactttgtaacctcaaattcctgggctcaatcgatcctcctgcctcagcctcccaaagtgttggaattacaggcttaagctaccatgcctggccaaaaacaataattttaaaaaagagaaacacttgaaggggaaaaataaaaatgacaccacattggccaggtgcggtggctcacgcctgtaatcccagcacttctggaggctgaggcgggtagatcaggaggtcagaagattgagaccatcctggctaacacagtgaaaccccgtctctactaaaaatacaaaaaaaattagccaggcgtggtagcgggcgcctgtagtcccagctactcgggaggctgaggcaggagaatggcgtgaacccgggaggcggagcttgcagtgagccagaatcgcgccactgactccagcctggccgacagagtgagactacgtctcaaaaaaaaaaaaaaaaatatgacaccacattatcatgccatggcaaagctcagtagtgttctctcatgtaaaatccctccatctggagtgcagtggctcatgcctgtattctaacactttgggagggcaaggtaggaggatcccttgaggcaaggaatttgagaacagcctgggcaacacaacaagaccctctctctattaaaaataaatacataaaaataaattttggctgggcacggtggctcacgactgtaatcccggcactttgggagcctgaggcgggcagatcacgaggtcaggagttcgagaccagcctgaccaacatggtgaaaccccgtctctactaaaaatacaaaaattagctggcgtggtggcacgtgcctgtaatcccagctactcaggagactaaggcaggagaactgcttgaacccgggaggcagaggttgcagtgagccgagattctaccactgcactccagcctgggcgacagaaaaagactccgtctcaaaaaatatataataataataataataataataataataataataataattttttaaaagctaaataaaatccctccacctctgaaaacccctgcaaagggtgtggaaatggctcattttacccctatgatggttatgctataaaacaattggttttagactagagcttttcagtatgagaagtcaattgctgaaatcagtatttggtgacacatattttcataaacactaaatgtgttgagcaaagacctatctttaactttaaagtgaaaacttcaaactgttcctaactacaaaatttttcagagataaaccatggtttctcaactctggcactactgacattttgaccagataattctctgctgtagggagctgtcctatgcattagaggatgtttagcagcattcctgacctctatccactagatgccagtaccacctcccacagtcatgacaactaaagaaatttctagatattgacaaatgttctggggggaggatcatactgatagggaaccagagataaacaatggaatgataattttcttcataaaggctgtttaaataagatatggaagataatacaaactatcattctttgcactcatttgcgaatcatttttaggtcatcagatgaccttttaatattttatctgaaaagcagcagcagaagcagaccaccaccaccagtgcacctaaaggtaatgtgtaacctagaaagaagaaatgaaccaatgaaccaatggatgatgcaaaaagtcttaacagtaaaaaatgagctaaggtagcctcagtactctgctatgtatattactcatgcatggtaactgttagaattcttaggctatcttgaaatcttttatttcaatgctacaaagtcagactcttcatttttcttcctattcttatctgaaaaagaaaagtttcctgtatcacagagatcaagaatacttaccactatttattgagcattttgtaaatacaagggattttacttaattaagcagatctccaaaaaacttaaggaaataagacaaaacagattcaggaacgttaaataaaacaccgagagccacaaaggaagctgagggattcctgagatctaccaaagggtcatcaccatcacatcccaaaaggcctaggttttacttataaatcttctagtttataaaaaggccagatttgcaataatattaaaaactgagatctcagcatttaatagcataatcttaaacgtgtaaagaacacatagtacttttcagaaagtgttatttttcattataaaagaaacgtaagtggcgggacacagtggctcatgcctgtaatcctagcactttgggaggccgaggtgggcagatgacctgaggtcaggagtttgagaccagcttggccaaaatggcaaaaccccatctctactaaaaatttaaaaattagctgggcatggtggcaggcacctgtagtcccagctacttgggaggctgagacagaattgcttgaagccaggaggcggaggttgcagtgagctgagatcgcaccactgcactccagcctgggcgacagagtctcactctgtctcaaaaaaaaaaaaagaaagaaacatatgggctgggcacagtggttcatgcctataatcttagcattttgggaggctgaagcggaaggatagcttgagctcaggaatttcagaccagcctgggcaacatagtgaggtcctatctctattaatgagaaaaaaaaattagctggatgtgatgacacgggcctgtggtcccagctactcaggaggctgaagtgggagcatcgcttgagcctgggaggtcaaggctgcagtcagccataactgtgccaccacattccagcctcggcaacagaaacatatgatcattgtagatcatctaaatagcccattttttttctttttttttttttttcagatgcaatctcactctgtcgcccaggctggagtgcagtggcgtgatctcggctcactgcaacctccacctctcatgttcaagtgattctcctgcctcaacctctggagtagctgcaattacaggcgtacaccaccatgcctggctaatttctttgtatttttagtagagacggggttttgccatgttggccaggctggtcttgaactcctgacctcaggtgatccgactgccttggcctcccaaagtgctgggattacaggcgtgagtcaccgcgcccagccttaaatagcccattttttaaaagattggttgtaataatgatgtatataatgaatatcatcatattatcataatgacgtgtatctgtaataatgattcacatcaaaacaaatgcaaaggtaaagattagctaggtgttcaagcaatgaacaagtaactaatggatgaacatccccaaacacttcagtcctaaagtcacagatgacttttttagaacctgcccagaaattactgtagaaataaattctggcttcagaataattcaataaacttacctgtgctacctacactgaaaaaagtgacaagtactgtgccggtatgttgtggatggatttggtatttcagaggaaactggtacatactacagaaacggcctttcccaaaggaaaaatgaaatgctgccaggcgcggtggctcacgcctgtaatcccagcactttgggaggccgaggtgggtggatcacaaggtcaggagatcaataccgtcctgactaacacggtgaaaccctgtctctattaaaaatacaaaaaattagccgggcgtggtggcaggcgcctgtagtcccagctactcaggagactgaggcaagagaatggcattaacccgggaggtggagcttgcagtgagccgagattgtgccactgcactccagcctgggcgacacagcgagactccgtctcaaaaaaaaaaaaaaagaaaacaaaaactgaaatgcttatctcagaagcataaattaaagagaaaaatcatctctaatctactgtttcggtcttaccattttatagtttggacctaagagatcagcaatccttaataaataaggtttcccatgagttctggagcttctctgcctcctgttcgcaccctccatgtccatgtttaacaacctaatgccagccaggtgcagtggctcatggctgtaatcccagcactttgggaggccgaggctggaggatcacttgagcctaggagtttaagaccagcctgggcaacagaacgagaccctgtctctacaacaaataaaaaataaaaaatctaactgggcatggtggtgtggtggtgcacgcttttagtcccagcttcttgggaggctgaggtaggaggattccttgggccagggaggtcaaggcttcagcaagccatgatcatgccactgcactccagtctgggtgacagagtgagaccttgtctcaaaaaaaaaaaaaaaaacaaaacaaaaaaaaaacaacctaatgctggatggacacagtggctcatgtctgtaatcctagcactttgggaggccgaggctggaagactgcttgaacacaagagttcgggaccagcctaggcaagaaagcaatacccccatctctttagaaaaaaaaaaaaatgtgccaggcatggtggtacatgcttgtagttccagccactatagaggctgaggaaggaggaccacttgggaccaggagtttcaggctgcagcgagctaggatcaagccactgcacttcagcctgggcaacagaacaagaccctgtctcttactaaaaaaattttaaaaagtgaaccaaacgcttaagaagctaactcggttaggttcctaaggggccttttcaaaatcagatataaaagggctgatgccaggccctccagcactgagaagtgtaggctaaactaccttttctaggaacatcttcccttattctagaagaataggaatagaaaacagtggttattttagtggtcaggaagagcaaccaagatctcgcatggaggtgtgcttagggggaaaatgttaaaataattgattaggaaaaagaaagtacgagaattgtctgatataccaaggcaggatggtagacagaagcagtgaaatggctgatattacactagaggttgtatctgaacaaataatcagggttaggttctatgacttctaatcttggcactgcaatggaccagccacactgccgtaaaatggggcttaatatttagaaaataaagtttaagtactccaaaattactatgtcttttccaagacaataaaggcataaaagtcagaaaatgaaactaaaatatactcacaatgagtcttaacttttacctctttaaaacagtttagctcctggccaggcatggtggctcacgcctgtaatcccagcactttgagaggccgaggcgggctgatcacctgaggtcaggagttcaagagcagcctggccaataagctgaaaccccatctctacaaaaaatacaaaaattagctgggcgtggtggcgggcacctgtaatcccagctacttgggaggctgaggctggaaaatcgcttgaacccaggaggcggaggttgcagtgagcggagatagtgacaagagtgaaactccatctcaaaaaaaaaaaaaaaaaaacagttcagctcctttctaaaggagggtcttttcaattcattcataagtactaggttgggttccttagagaaaacctccaggccacttaatattcacaaaactaaagtccaagacccttgtgctcagaattttttttttgagatggattctcgctttgtcaccaggctggagggcagtggcgcgatctcagctcacagcaacccctgcctcccggttcaagcaattctcctgcctcagcctcccgagtagctgggactacaggtgagcgccaccactcccagctaatttttgtatctttactagagacgggatttcatcatgttggccaggatggtcttgatctcttgaccttgtgatccacccgcctcggcctcccaaagtgctgggattacaggcatgagccacaccacacccaaccagaaatttttaatacagcaaaattctcacatccaaatgaggttttacctaattgttacttacagtatcataaactatcagcaataatgaaaataataagagttcttcacctttccttccttctttgtctctgtagaagacctcaatttaacatcataaatcatttggtccttgacgtatggtaacttccagggagacagatgacatttagcacaggacatgtaagactgtgggaaaagggaagttcttggccgcaagaaatgggacaaaacccttgcctttgggaaaaatgccaaagatctctgaagtccacgctaaagcagttaaatttttagctttaaaagattccattacaaaaatccaaaccagactgggcacagtggctcatgcctgtaatcccaacactttgggaggccgaggcaggaggattgcttgagcttaggagttcgtgaccagcctgggcaacatggtaaaacccccctctacaaaaaatataacaaattagtcatgtgtggtagcatgcctgtagtcccaggaacccgggaggcgaggtggaaggatcacttgatcctgggaggctgggaggtcgaggctgcaatgagttatgatcatgccactgcattccagcctgggtgacagagtaagatcctgtctccaaaaaaaaaagcaaaaaccacaccatacaattagaataggcttttaaaaactacactataaaaatgcaagataataattttctggaattcataagaacctgtactaggtgatggtccccagggtggatatgaatattttttccccttgtaattggcttaagctaacatggttctaaaatttttcgctattcaaaaacgatgaggacgggcacggtagctcatgcctgtaatcccagcactctgggagaccaaggcaggttgatcacctgaggtcaggagtttgagaccagcctggccaacatggcgaaaccccgtctctactaaaaatacaaaaattagccaggtatggtggcgggcacctgtaatcccagctactagggaggctgaggcaggagaattgcttgaacccgggaggcggcggttgcagtgagccgagatcatgccactgcactctagtctaggtgacagaacaagactgtctcaaaaagaaaaaaacaaaaaacaatgatgaatatcataataatggctaacttttctgactacttattatataagcattgggctaagtgctctacatgcatctccttattaatcctcacaacattgtaaggtctaaataacataaactttaagaattttcaaaaaaagaaaaaacataaaattaaaataaaaaaagaaacaaaaataataataattttcaggctgggcgtggtggctcacgcctgtactcccagcattttgggaggccaaggtgggtagactgcttgagccctggagttcaagaccagcctgggcaacatagtgacaccttatctctattatttaaaaaatgaaataaaataaattggtggtggctcacgcttgtaatcccagcactttgggaggcagaggcaggtggatcacgaggtcaggatatagagaccatcatggccaacatggtgaaaccccatctctactaaaatataaaaattggccaggcatggtggtgcatgccagcagtcccagctgcttgggaggctgaggtaggagaatcgcttgaacacaggaggtggaggttgtgccattgtgctccagcctggtgacagagcaagactccgtctcaaaaaactaaataaaaaataaaaataaaactattaacagaaacataagtactttcgaaaactactctattatcctatcaatcatcactgggatatccatgcaaaaccaaaataccctgaacagctataattatacagaattttaatctagtgagagttctagttaagagtcttggcagggtgagatggctcacacctgtaatcccagcactttgggctgctgaggcacgtggattacctaaggtcaagagttcaagaccagcatgggcaacatggtgaaatcccatctctactaaaaatacaaaaataagccaggcgtggtggcaggtgcctgtaatcccagctactcgggaggccaaggcatgagaatcgcttgaacccaggaggcaaaggttgcagtgagctgagatcgtgccactgcccacagcctgggcaacaaagcaagactccgtctcaaaacacaataacataatgacaatgaagattaatacttatatgtagaaattgtccttcacactgccaaactgccagcccattaagaaaggcttttacggccaggcatggtggctcatgcctgtaatccgagcacttggggaggccaaggcaggctgatcacttgagatcaggagttggagaccagactagccaacatggtgaaaccccatctctactaaaaagaaaatacaaaaattagtcgggtgtgatggtgcatgcctgtagtcccagctactcgagaggctgagacaggagaatcgcttgaacccagaaggcggaggttgcagtgggctgagactgcgctccagcctgggcgacagagcgagactctgtctcaaaaaaaaagaaaaaaagaaagaaagaaaaagaaaggctttcacaagccttcttgtgcaaaagaacaagaagatataaagaaaataaaattttattgtagttgtgaccacaccttgaaatggagagttgacaactctgttttaaggaacaaatttttttcctatagtaatttcatcataatttcttgcacagagtatacagtatgtttcctctggcaatacacagctgagtaaaggttttctgtatcttttcatctgtacttttcaaactatattttaagaagcattaacaaaaccaaacacatatatcaataccaaaacccacaaaattagctattttatacccacttaggcacctaagtaaattggctaatggcttcatgggaagtaatgtagtgtaaaagaggaaacactggcagtgaaggcagaaaacctagacctgggtggaaatcatggctacatcacttgttaactatgtgaccttgggcaatttccttctctcagtctgagttttcttatttgcaaagtgagggtagtaattccaatcttgggagggacgattaattgcatgtgaaatgcccaccacagagcctgactgaaagcaggagtttagaaaagatactgttacgattgttattcatataagctccttaaaagcaaaaacatcatatttgtcctcgtagcccaattgtaggctttataattattgaggagctgaaaaacaagaaacaccaaagttacaaatgaggatttgtatccgttcaacacatgcctagacagaaaatgagactaagtaatcatgactttcaaaaactatatcaatgcatacacagcatataaatcaaagtatatattgccatttgatggggaaaaaaatcaaaatatgtaatgtgcttatttttaagccactctgaaagaagatgatgctgcctgtatacaaatcaagagtacaactactcttcattcattctgcaagtatttccgtaagtgccagtcattatgtcagtcattatgctaggcaatgtgcatatgatggggagcaaaagcgaaaataatcccaaccctcatagagcttgcttgcagtcatgtaatcacacaaataagtgttaacttgtgataagtgatgtgaatgacaggtaaatggtgctctgagaacctattaggttagaatctaatctaactgaaatcaaggaaggccttccaaggaggtgaaacctgagagctgaaggatgaagaggaggttaacaaaggggggtgtttccagatggaggaaagcagctcctgcaaagaccctgtaagcaggaggaaacaaggaaagaaggcaggactataaggccagtgtgcatggagcagagacaagtgtgagaactagctagggcctaggctgctcaagggcctagatatatagcctacattcaaaagttgcaatttgatctcaagagcaatgacaaggcctgtaatcctaaggctttgggaggctgaggcaggaggacggcttgaacccaggaggttgaggctgtaatgagccgtgattacaccactggactccagcctgggtgacaaagtgagatcctgtctccacaaaaaaaaaaaaaaaaggcaaccagaagccactaaagagttttatgaatgcttctttgcggggcaggcaggctgaggggaagatgaaatcagattttcaacaggactctggcttctggattctggaatatggatggaccaggtgggaaacaaaagtcctgtcaggataggatagtagcttcgaatagggtgatggcagtgatggtggaaggaagccaatgaattcaagagatattcaggaaaatctaacactgtattgtacacaagggcagagggacagcagtgtccaagacttctgggtttctgattcatatgactgtacagaaggagataccactcaggaggtattctgcttcagaaatatttttaaggagccaggcgcggtggctcacgcctgtaatcccagcactttgggaggctgaggtgggtgaattgcctgaggtcaggagttcgagaccagcctagctaatgtagtgaaaccccatctctactaaaaatacaaaaacttagctgggtgtggtggcgggcgcctgtaatcccagctactagggtggctgaagcaagagaattgctcgaacccgggaggcagaggttgcaatgagccaagatcacgccattgcattccagcctgggcaacaagagcaaaactctgtctcaaaaaaaaaaaaaaaaaaagaaagaaagaaaagaaatatctttttttttttttttttttgagacagaggagacggagtctcgctctgtcggcgggatctcggctcactgcaagctccgcctcccgggttcacgccattctcctgcctcagcctcccgagtagctgggactacaggcgcccgccacgacgcccggctaattttttgtatttttagtagaggcggggtttcactgtgttagccaggatggtctcgatctcctgacctcatgatccgcccgcctctgcctcccaaagtgctgggattacaggcgtgagccaccgcgcccggccgaaaagaaatatctttaaggctgttcacacaggccaaaaagggcctaactgcactacacttttgcatgaaaatgtgtaaaccgaatttgatcccctactttaaataaggctctaaaagattttttgctatttacagaaatcaaactgactctcaaaagtacaaggattttcctacactgaagaaatttcaaagattctgccacaagcttctaaatcaactccaaataaatgttaaattggtttgagcaatagggcagcattacggagtgaatgtgtcagttcccatgaggaccactttgataaggctaacacttatgtactgctgtttaattttaatattttaaataaatcttaagagtacccttggctgggcgcggtggttcacgcctgtaatcccagcactttgggaggccaaggcgggtggatcatgaggtcaggagatcgagaccatcctggctaacatggggaaaccccgtctctactaaaaatatgaaaaattagccaggcgtggtggcgggcgcctgtagtcccagctactcgggaggctgagacagaagaatggcatgaacccaggaggtggagcttgcagtgagccgagattgcgccactgcactccagcctgggcaacagagcaagactccatctcaaaaaaaaaaaaaaaaaaaaaaagagtactcttggctgggcacagcggcccaggcctgtaatcccagcattttgggaggccaaggcgggtggatcacgaggtcaagaaatcgagaccatcctccaacatggtgaaaccccgtctctagtaaaaatacaaaacttagctgggcatggtggcacgcacgcctgaagtcacagctacttgggaggctgaggcaggagaatcgcttgaatcagggaggcagagtttgcagtgagccgagatcacaacgctacacttcagcctggcaacagagcaagactcagttaaaaaacaaaagggtacttctggctgtgtgcagtggctcacacctgtgatcccaacactttgggaggccaaggcgggtggatcacctgaggccaggagtatgatgagactagcctggccaacacggtgaaaccccatctctactaaaaatacaaaaattagctgggcatggtgggtacctgtaatcccagatactcaggaggctgaggcaggagaatcgcttgaacccggcagatggaggttgcagtgagccgagatcacgccattgtactccagtctgggcaacaaaacccaaactccggccaggcgcagtaactcacgactgtaatcccagcacttttggaggacgaggcgggcagatcatgaggtcaggagttcaagaccagcctggccaacatggtgaaaccccgcgtctactaaaaatacaaaaattagctgggcatggtggcaggcgcctgtaatcccagctgctcgggaggctgaggcaggagaatcgtttgaaccctggaggcagaggttgcagtgagccaagatcaggccactgcactccagcctagatgacagggcgaggctctgtctcaaaaaaacaaacaaacaaacaaaaaatcaaaactccatctcaaaaaaaaagagagtactcttatgtgatattaaactaaaatatggtaacattaggcattaccataattagaactatactgcttttgtttcaatattttgaaatgcttgtaaaaaaataatattttgtagaaaaaagagataagattttaaaaacacacacacacacaatctcttgactttaataaacattttgccgtttccatcctagtccttgttaatgcccatcacattcaattcagggtaaaagataaggtttttactagttaaacacatctgtatatatgtgtatgcactatgtacaaagtaaagccaataccatgtcaatactatcaatactttaatatttacttttcctggttttagttttcaaatttgcaacggatgctatttgcatagaatactgatggctttaagtcttaaaaacagaaatctgactgacccaaggaaaaggatgaaagaaagagattttgtccctttaaaatcagccaacacatcctatcttagtactgaagtacttcccaattctggcagaatgggctccttggccacctgcttgcactagggtctgactagcattttattaacatccaactgcagttaccaggacattcattaccactgcttgtacaaagcagaattctttttaaatttttttcccatacagatttcatcaccaggtgtcaaaagacaaaaccgtggcctgaggccaaatagaaaaatgtcatctccacaaataaggagaaaagacaaggactttaaaaaatcaggtcaacaagcccattagccaataatagtttgtaaaactggactgtcttcacactagaggctgtgctagcaaatgtggtccttggaaacaagagctgtagagcttgaaatgggttgccagcatggtttgcctttttcttttttcatgtttatttttattttttttatttataacatggaatcagactatgactataatcgagcatagctatggcggggtatgggcagtgccaaggaagagacagcgaaaagcccgtagggttcccagtctaagctagcagaccttcccatcttcctcaggagtggtccctgtctccgcagctggaatgtgcgggagggaaagttacaagggcccccaaaatgagacagcaaaccacttccttctgaaaactaaaggtcataggcttttaaggaacaatagagctcaatgtaagcttcagaaagatggagacagtcagatgagacgagggtagggaagcgcgggtgaggagatgcgccccgtctgggatagctgaataggggggtcaaggccagggactttaggaacacgagaagggctggatcttccataacctgcccaagtgggcctgagaaacctaagaggctcctctgaaaatctagggcatctatgcatccaatactctcagccctctcctcgggaagggagataatccccacaggaagcaccccccaaactggggcttttcctgcccttcaaaagccacaaaccctcacggaaaacatttacaagggagtggaagggccgggggcaagcagcggttctgcaaatctcgggaagaaggcccctggatccaaggaactttgcccctggaatagggggtggggtgcggagggcaccgtctgaggctggtaagcctcggcgaaagaagcggcgggaacgggagtagggtcccgtgggtcccccgacgagggggtggcggcctggggcgcggtcgccggtgagggaggcccgcgagccgggcacgggagcggggggctgcggccccgtggctgcaaagagccggcactcgggaggcagaggccggcgtaggcctcgggggcccggacacacccaacgcggcggcctcgggcccgcttacctgctcctcctccggggtcagctccggcgccatgtcgggccggggcgcggtcgcgggctccatccccccgccaccgccgccgggcggacaaaactcgctcgcgagcgcgggagcccggcgcgctcggcctccgcttccgcgtccccgcgcctcagcagcccggggccggctcgcgcatagtgtggccggcagggcccggcgcctgcagcggccgcaaacgccgcttctgcttccttaagaaaaatctctccgaactgccgctctcttccgggaggaaatccttttttatattattcgctccgttcctcacactcccccttatctcctggggaagaaaaagtgcaggcgaagagctaacagccactcgggatttaaaaggaaataggaaatcaggaacttttagagccgggagcgaagggtcggcggaaatttcccgaaggccgccgaccccctcggcgccccgcttcctcggccgcgctcccgctcctccacagcgccacagagctcggggccgcccagccgggccgtcctcgcggacgctggccctgcgacctgcgcggctgcctcagccaggctcctcgcgggcggccgcagcgaaagggagggagtggagagggagcgagggaaacgcgcccccctcctgactcacggccaacgctgcggccgccccgcggccgcccgagccccccgcggctccattgagaaactgagcgtctcattcacaagctggcggcgaggagggcccggcggagcgaggacgcagtccgggagggggagacagagaggagcccgggcgggggaggggaccgggagggggaggggacccgggcggggaggggaccctagctggacggaaggcaactcgactgcgggagggagaaaaaggaagaaaagagtatttcgtgaggctcagatcctcggaggaggaggagaatacgttcgtttgcaaattatctgctgactggcacctctcctggggttaacttgccgctgccacctacgcgtgagaaacccacaatcctcaactatttgtcgcttgcagcctgaaagaccctggaaaggttgcctgccaggccaggatgcttaggtggaaggaatcgcacctgcctccctctctctccctccttactggctgcaccctgtaattcatctccagtgtcgctaattttaatcccccatagaaacgacatcagactccgaacatcattcaggaatgacgcggcctttgcagacctttgattttcactagggcaagtgcagcaaagggttcaggattaggggtacagtcttggagtcatttggggaggaatggggcatagagaaggcaaggctgggtctggtacgttgttgcattattccaagccaaagataaatattccaaagggacccaaagtccacaactagttccaaggctgaagccctggagccagtcctgagggacccaaaggaggggccttcagacaacaggaaggtgctgtgagttgtgatgctcctatgattttttttttatttttttttttgagacggagtctctgtgtcgcccaggctggagtgcagtggcgcgatctcggctcactgcaacctccacctcccggggtcaagcgattctcctgcctcagcctcctgggtagctgggattacaggtgcgagccaccacgcccggctaatttttgtatttttagtagagacggggtttcaccatgttggtcaggctggtctcgaactcctgaccttgtgatccgcccgcctcggtcttccaaagtgctgggattacaggcaggcgtgagccaccgcgcgcctggcttttttgtttttctttttttgagacggagtctcactctgtcacccaggctggagtgcagtggcgcgatctcggctcactgcaagctccccctcccaggttcacgccattctcctgcctcaggctcccaagtagctgggactacaggcacccgccaccgcgcccggctaatttttatttttattttttttatttttttgtatttttagtagagacgggctttcaccatgttagccaggatggtctcaatctcctgacctcgtgatccgcccacctcggcctcccaaagttgttgttgttgttgttgttgttttaacacagggtctcactttgttgcccaggctggagtgcagtggcgtgatcacagctcactgcagcttcaaagtcctgggctcaagcaatcctcccgcctcagcctcctgagtaggtgggactacaggtgcacaccactgcacctggctaatttttttttttttttttttggtagagataggggtcttactatgttgcccaggctggtctcaaactcctggtaaactgcctttgcaaaattataactgatgattttatgacagtgaaagaaatcagacctaactgactctatcttgtttctaacccttaagctgtccttgttcattcctgggcataggccgaactaactttgggaaggaattcagttcatggtttgactctgaaacaaaattgataatagccctttcccgaaaagacccccttcttccctggggtccagtctgcctttgcaggactaacagattaagctacaagattagaaattacaatttaggggtcatgcagccatgggctccaagagtctaaacctccccaaactgctcctggggataacatcactattgtaaaacctaagatcagtgcttgagatattttgcagaccctgcacccagtgcatcagctgataccatccagactggtaatctggcccaaataggtctgccatcccaaccaggaacagaagacagcaagaaaaactcatttcaactccctatgatccaatctcaaacctgaccaatcagcactctccacttcctaagcccctacccaccaaattatctttaaaaactctgatcccttaatgctccagggagactgatttcagtaataataaagctccaggccgggcatggtgactcacgcctgtaatcccagcactttgggaggctgaggcaggcggatcatgaggttaagagatcgagaccatcctggccaacatggtgaaaccccgtctctagtaaaaatacaaaaattagctgggcatggtggcgcgtacctgtcgtcccagctactcgggagtctgaggcaggagaagcgcttgaacccgggaggtggaggttgcagtgagccaagatcgcatcactgcactccagcctggcgaaacagcgagacgctgaatcaaaataataataataataataataataaaactccactctcctgcacagacggctctgtgtgaattactcttttgccattgcaattcccctgtcttgatatatccgctgtgtaagcagcaggcaaggtgatcccattgggcagttacactgggctcaggcgatcttcctgcctcagcctcccaaagtgctgggattacaggtgtgagccaccgtgcccagccttctaggatttttgtttttgtttgagatggagtttcgctcttgttgcccaggctggagtgcaatggcacgatctcagctcactgcaacctccacttcccaggttcaagcaattctcctgcctcagcctccctagtagctgggattacaggtgtctgccaccatgcctagctaatttttcgtatttttagtagagatggggtttcactgtgttggccaggctggtctcaaactcctgacctcaggcaatccacccgcctcagcctgccaaagtgttggcattacaggcatgagccaccatgcccggctccttctaggattttaaaaacaatccctgacctcaactaatttctgcattaatgcaataggaacttcaggctgcccttggtaagaatcagagacgatatccttggtatttgaatctttatctcagctaggatattttctcctttgcatcaatacagctgactggaggttgacttcatcactcctttagtttcagtattgtaaccagtctggaatacttttttttttttttttttttttttttttttttgagtggaggtcttgctctgtttcccaggctggagtgcaatggcgtgatctcggctcactgtgacctccacctcctgggttcaagcaattctcctgcctcagcctcctgagtaggtgagattacaggcgtccaccagcacaccctgctaatttttgtatttttagtagagacagggtttcaccatgttagccaggctggtctcgaactcctgacctcacgcaatccgcccacctcagcctcccaaagtgctggtattacaggcgtgaactactgcatccagcctgctttctttttattgaagtgtaatatacagaaaaagtacaaatataagtgtactgcttgatgaatttttttattttattttttgagacagggtctcactctgttgcccaggatagagtgcaacagcacaatcctggctcactgcaacctctacttcctggctcaagcgatcctccagcctcagcctcccaaatagctgggactataggtgcgtgccaccaggcctggcccatttttatattttttgtagagatggggttttgccacattgcccaggctggtctcaaactcctgagctcaaagcaatccacccacctcagcgtcccaaagtgctaggattacaggcgtaagccactgcacccggccagatgaattttcataaactgaacacactcgtgtctgtgcccaatgcacagatcaacaaatagaatattctgaacttgccaaagcctcgccttttgcccatcccccaccccacagtcagttactactctgctgaagggtaaccactatcttgcccgttttttttttttttttttttttgagacagggtctctcgctgtgtcacccaggctggagtgtaatggcacgatctgggctcactgccacctctgcctcccgggttcaagtgattctcctgcctcagccttcagagtagctgggattacaggcatgcactaccatgcccatataatttttgtgttttttttagtagagacgggttttcaccatgttggccaggctggtctcgaattcctgacctcaagtgatccacccaccttggcctcccaaagctctaggattatagttgtgagctatcactcccagcctcaggcttgaactcctgggctcaagtgatctgcctgcctcccccttccaaagtgttgggcgtcagccaccgtgccgggccaagtatgctttttctccctaggcaagcaaatggttctaggactaaactggagtaagaaacagcaggacctgagtagtacaaaccattgattggagacaggagaggatggagtctctcaactcactatttacacttcacatttgttttgcccactgatcctcaggacaccaggggtcagtgatttatccaaagtcacacaactaaataattagtattgagctaaaacttgaacccaggcattctaactcctgatctaggaactgggtgaggaggagaattaataaagatatttaactgagtgggctgagagagaactcagcagtgttttcagaggcacagctgtgtgtgtgggcgtgtgggtgtgtaaggaaagagagttctccggaactgttatccatcactgttttaacaggacaatgtttggaaatttctgagcacaaacgtgaataacaaaacaaagtgcaaggcggctggctggccagtttgttttgagaggtaaatccaggagacccagagtagagaggcaactacctggcttgcctgtaactgcaggcttgaaccaatgaactcaagtatggtactgtcatcctgcccaatcaaatcttaaaggctgggctgggcaccggggctcacgcctgtaatcccagcactttgggaggcccaggtgggtggatcacttgaggtcaggagttcgagaccaccctgatcaacatggtaaaaccccgtctctgctaaaaatacaagaaattagccagacgagatgttgcatgcctgtaatcccagctactcgggaggctgaggcagaattgcttgaacctgggaggcagaggttgcaatgagccgaaatcgcaccatggcactctagcctataaaacgagagcaaaactctgttgcaaaacaaacaaacaaaaatcttaaaagactgcagaatggcttgtagtatcaaaagattgaaaacattatgaggccgggcacggtggctcatgcctgtaatcacagcactttgggaggctgaggcaggcggatcacgaggtaaggagaacaagaccatcatggccaacatggtgaaaccttgtctctactaagatacaaaaattagctgggcatggttgtgcgcaccactgtcccaaccactcgagaggctgaggcaggagaatcgcttgaacccgggaggcagaggttgcagtcagccgagatcgcaccaccactgcactccagcctggtgacagagggagactctgtctcaaaaaaaaaaaaaaaaaaaaaaggctgggcgcggtggctcacacctgtaatcccagcactttgggaggctaaggtgggcagatcacgagatcaagagattgagaccaacatggtgaaaccccgtctctactaaaaatacaaaaattagctgagtgtggtggcacatgcctatagtcccgctactcgggaggctgaggcaagagaatcacttgaacctgggaggtggaggttgcagtgagccgagatcgccctactgcacgccagcctggcaacagagtgagactccatcccaaacaaagaaacattatggcccatcaatagaagactcagtaaataaattacagtacacacatacactgaaataataggttgacatttattgtgtccttacatttaccccacacactgttctaaatgactttcattgatttactctcaccataatagtataagaaaggtgaaactatgatccttattttacaaaaagcatatatagtagatccattgatacagcctccttacttttttttttttttgctgagatggagtcttgctgtgttgctcaggccggagtacagtagtgcggtctcagcttactgcaacttccgcctcctgggttcaagcaattctctgcctcagactcccgagtagttgggattacaggcgcctgccactacgcccagctaatttttgtatttttagtagagatgggttttcaccatgttggccagactggtcgtgaactcctgacctcgtcatccatccacctcggcctcccaaagtgctgggactacaggcgtgagccaccacacccagctgtttttcttttgtttgagatggagtctcgctctgttacccaggctggagtgcagtggcacaatctcggctcactgcaacttccacttccctggctcaggtgattcttgtgcctcagcctctcaagtagctgggattacaggcgtgaaccaccgcgcctggcccctccttgctttttattttttttgaggcagagtgtcactctgtcacctcagctggagtgcaatggcacgatctcagcccactgcatcctctgccccctcgtttcaagcaattctcctgcctcagcctctcgagtagctgggattacaggtgtgcaccaccacatctggctaattttttttattattattatactttaagttctagggtacatgtgcacaatgtgcaggtttgttacatatgtatacatgtgtcatattggtgtgctgcacccattaactcgtcatttacattaggtatatctcctaatgctatccctccccatgaccagccccgctgtttgatgttccccaccctgtgtccaagtgttctcattgttcaattcccacctatgagtgagaacattcggtgtttggtttcctatccttgcgatagtttgctgagaatgatggtttccagcttcatccatgtccctacaaaggacatgaactcatccttttttatggctgcatagtattccatggtgtatatgtgccacattttcttaatccagtctatcactaatggacatttgggttggttccaagtctttgctattgtgaatagtgccgcaataaacatatgtgtgcacgtgtctttatagtagcatgattcataatcctttgggtatatacccagtaatgggatcgctgggtcaaatcatatttctagttctagatccttgaggaattgccacactgtcttccacaatggttgaactagtttatactcccaccaacagtgtaaaagagttcctatttctccacatcctctccagcatctgttgtttcctgactttttaatgatcgccattctaactggtgtgagatggtatctcattgtggttttgatttgcatttctctgatggccagtggtgatgagcattttttcatgtgtctgttggctgcataaatgtcttcttttgagaagcgtctgttcatatccttcacccactttttgatggggttgtttgattttttcttgtaaatttgtttaagttctttgtagattccgaatattagccctttgtcagatgggtagattgcaaaaattttctcccattctgtaagttgcctgttcactctgatggtagtttcttttgctgtgcagaagttctttagtttaattaaatcccatttgtctattttgggcttttgttgccactgcttttggtgttttagtcatgaagtccttgcccacgcctatgtcctgaatggtattgcctaggttttcttctagggtttttatggttttaggtctaacatttaagtctttaatccatcttgaattaatttttgtataaggtgtaaggaagggatgcagtttcagctttctacatatatatccggctaatttttgtatttttagtagagacaggctttcgccatgttgaccaggctggtctcgaactcctaacctcaggtgatctgcccgccttggcctcccaaagtgctgggattacaggcgtgagccaccgcgcccggcccaaaacagacgttttgttttgtttttctgagagagagtctcaatctatcacccgggctggagtgcagtgatgcgatctcagctcactgcaacctccgcctcctgggttcaagcaattctcatgcctcagcctcctgagtagctgggattacaggcgcccaccaccatgcccagctaatttttgtatttttagtagagatggggtttcaccatattgtccaggctggtcttgaacacctgacctcagatgatacacccacttcagcctctccaagtgctgggattacatgcgtgagccaccacacccagcccagaacagacattttataaaataagacatttaaatctcaacaggcatataaaaagatgcttaacttcactgatcatcagagaaatgcaaatcgaaactacaatgaggccaggcatggtggctcatgcctttaatctcagcactttgggaggccgaggcaggtggatcacttgaggtcaggagttcaagaccagcctggccaacatggtgaaacctcgtctctactaaaaatacaaatattagcagggcacagtggtgcacacctgtaatcccagctactcaggaggatgaaacaggagaatcgcttgaacccgggaggcggattgcgccactgcactccagcctgggcaacagagtgagactctatctcaaaataaataaataaataaaataaaataaaattacaatgagataccatctcaccccagttaaaatggtttttatccaaaagacaggcaataacaaatgctggcaaggatgtggagaatagggaaccctcatacacttttggtgggaatataaattagtacaaccactatggagaacaatttggaggttcctaaagaaaacctaaaaatatagccaggtgaggtggctcatgcctggaggctaaggcaggaagatcacttgagtccaagattccaggagtttgagtccaggctgggcaacacagtgagacctcatctgtacaaaatataaagaaaatcagctaggagtagtgatgcacacctgtagtcccaggtacttgggaggctgaggtgtgaggatcacttgagcctgggaaataaaggctgcagtgaactgtgattacaccactgcactccagcctgggcaagagagtcagaccttgttgaaaagggaggagaggggaggggaagggaagggagggaaggtgtaggggaaaagaggggtgaggggaggaggggggaaggaaggggaggggaagaaaaggggaagggaggaaaaggggaggggagggaaggaaaggggaggggaggggggagaggaggaaaaggggagggaggaggggaaggaaggggaggggaagagaggggagtgggaggggaggggagagggaggggaggaaagaaaagaaaaagccaaaaataaagctaccaatccccctcctaggtatataccccaaagaaaggaaatcagtatgttgaagagacatctgcactcccatgtttactgctgcactattcacaatagctaaaatttggaagcagcctaagtgttcatcaacatataaatggataaagaaaatgtggcacagatacacaatggagaactattaagtcataaaaaagaatgaggccgggtacagtgactcacgcctgtaatttcagcactttgggaggccgaggggcagatcacttgaggccaggggttgaagaccagcctagccaacatgatgaatccctgtctctgtttaaaaaaatactaaaaatacaaaaattaaccgggtgtggtggcgcatacctgtaatcccagctacttgggaggctgaggcatgagaatcgcttgaacctgggaggcagaggttgcagtgagccaagattgtgccactgcactccagactgggtgacagagtgagactctgtctcaaaaaaaaaaaaaaaaaaaaagagagagagggatcctgtcatttgcaacaacatggatggaactgaaggtcattatgttaagtgaaataagccaggcacagaaagacaaacttcccatgttctcacttattttgtaggagctaaaaattaaaataattgaactcatggagataaagagtagaaggatggtaaccagaggatgggaagggtagtggggggtgagggagaagtggggatggttaatgggtacagaaaaatagaaagaatgaataagagccaggtgcaatggctcatgcctataatccttgcactttgggaggccaaggcaagtggatggcttgagctcaggaatttgagaccagcctaggcaacatggcaagactctgtctctactaaaaatacaaaaaagatcacttgagcctgggaggcaggggttgcagtgagctgagatcacgccactgcactccagcctgggtgacagagtgagaccctgtctcaaattagaaaaaaaaaaaagaatgagtaaggtgtatttgctagcacaacagggtgactatagtacaaaataatttaattgtacatttcaaaataattaagaatataattggattgtttgtaacacaaaggataaatgcctgggatggataccccatttaccttgatgtgattattatgcgttgcatgcctgtatgaaaatatctcatgtgacccataaatatatacatctactatgtgatgtacccacaaaaaagaaaaagagaaagaaaaaaaatagcataagtttcaggtctctgtctagaaagcttatcctcccctcccagcaccttcttcaccagacatatctgattcatccttaaggtctcagctcaaaagtcacttccccagcaagatcttccttgattactctctaaactgaactgcactttctgagactcatagcacccttttattcgtcagagagctgatcacaatttgtaattatgcacttgtttctacattcattggcctagtgtttgtgtgccttactagattgtaagcttcaggatggcaggaaccacatctgtcctgttggcccctgaactcccagcacctagaacctagaacatagtaggcaatcccttgataaatgtgttgaatgactgaatcaaggaagatggccactttatctatgagacatatcttaccattttcccctctcttttgttgtatttatttgggtttaagaatagacatacttccaatgctggagttggaattttataaccttctccaccaaacatttttatttctaaaatccaaagctcctctcaaacattgctccaaaatttctactgcctataaaagagacttgtgttgtgctataaagatgatatgaggctgggcgtggtggctcacgcctgtaatcccagcactttgggaggctgaggcgggtggatcacgaggtcaggagttcgagaccagcctgaccaatgtggtgaaaccccatctctactaaaaatacaaaaattagctgggcgtggtggcgcgtgcctgtaatcccagctactcaggagactgaggcaggagaattgcttgaacccgggaggcggaggttgtagtgagccgagattgcaccattgcaatccagcctgggctacagagcaagactccatctcaaaaaaaaaaaaaagatgatttggctataaaagattcaccccaccctgccaaaagaaagaaaggtgggcacagtggtgcacgtctgtagccccagacactcaggaggccgagatgggaggattgcttgagcccaggtgttcaagaccagcctgggcaatgtagttgagatcccatctctaaaaaatatctatctgtatagagtgcaatggtataattatagctaattgcagctctaactcctggccataggagatcctcctacctcagccttccaagcagctaggactacaggcacctatcaccatgcccaactaatttttaaattttttgtagagacaaggtctcgctctgttggccaggctggtctggaactcctggcctcaagaaatcctcctgccttggcctcccaaagcactgggattataggtgtgaaccaccatgcccagtctcatttctttattagaaaggacagctagggtgattgcctttcccttttccaatgtacaaagttagtttttaagctatccttttaatcacgtacacagaactaaatatagttcttgttcctaaaagtctgcagtatatccaagcacctgttagcagcttgccacacacctccatttagctttctcagcaaggtcactcctctgtgcagcagcagagaggaggggctctcctccagggtgcattctcattccaccttagtatttcttcattcactcaactaaaagttattgacgtaacaagtgccaagcataatgccaggcactggggacctaaagatgaggaagaccaggttcctgacctcatggaacttgctagctaatagaaggagtatgtagtaaagaacttaaccttgcaaagagtgttctggcctttgcccttcgctcctgggaggtaacctctaagcccttggaatgtcttgcctgataaaagtatctttgtttaccaggaggcagaccttaggccacactggacagtctaacaatgtgatttaggcagaagtctttggggcgtaccagatagtttagcaatgtgatgagggaggagggaagactttggatcacactttatcaggtagacttatggaggggctggagactgaggtcagtcacatgggcagacaatcaggtccacatgactgagccccaataaaaattttagacatcattccagccagacgcggtggctcatgcctgtaatcccagcactttgggaggccaaggtgggcagatcacctgaggtcaggagttcaagaccagcctggccaacatgggggaaaccctgtctccacttaaaatacaaaaattagctggacgtggtggcagatgcctgtaattccagctacttgggaggctgaggcaggagaatcacttgaacccaggaggtggaggttgcagtgagccaagattgtgccactgcactccagcctgggccacagagcgagactccatctcaaaacaacaacaaaacaaaaaaaaactttggacatcaaagctcaggtgagactgcctgattggcaatactctgtgagtattgttacacatactgggaaaattaactctgtccatgattccactgggagctctgcatttggaactttcctgctttctgctccgtgcatctcttcccttggccgactttactctgtttcctttcactgtgattaaactgtgattgtgaccataacagctttttttttttttttttttgagacggagtctcgctctgtcacccaggctggagtgcagtggcgcgatctcggctcactgcaacctctgcctcctgggttcacaccattctcctgcctcagcctcccaagtagctgagactacaggcacccgccaccatgtccagctaattttttttaatttttagtagagacagggtttcaccatattggccagctggtctcgaactcctgacctcatgatccacccgcctcgtcctcccaaagcactgggattacaggcatgagccactgcgcccagcccacatcttgatatttttgaatgctagcttgaaggacctatttcagagtgccccttacattttttttttttctttttgagacggagtcttgctatgtcgcccaggctggagtgcagtggcctgatctcagctcaccgcaagctctgcctcccaggttcacgccattctcctgcctcaacctcccgagtagctgggactacaggcgcccgctaccacgcctggccaattttttgtatttttagtagagatgggttttcaccgtgttagccaggatggtctcgatctcctgacctcgtgatccgcccgcctcggcctcccagagtgctgggattacaggcataagccaccgcgcctggcctccacctggtcatatttctttagagattatcaaactacctcttgccacctgttttaaagatggttgtgttggctgggcatggtggctcatgcctgtaatcccagcactttgagaggctaaggtgggcagatcacttgagctcaggagtttgagaccagcctgggcaacacggcgaaaccttgtctctaaaaaaaaaatacgaaaattagccaggcgtggtggctcatgcctgtaatcccagctacttgagaggctgaagcaggaggatcactgggaggtcaaggctgcagtaagctattattgcactactgtactccagcctgagcaacagggtgagcccctgtctcaaaaaaggaaaaaaaaaaaaagatggttgtgttataggttgctatgactgcatatttgttttctagccagccctctaaacagcacccagtttcttttttttgtttgtttcttttcttttcttttctttttttgagacggagtttcactcttatttcccaggcatggagtgcaatggcgcagtctcggctcaccacaacctctgcctcctgggttcaagtgattctcctgccttagcctcccaagtagctgggattataggcatgcaccaccacgccccactaattttgtatttttagtacagacggtcaggctggtctctccatgttggtcaggctggtctcgaactcccgacctcaggtgatccacctgccttgggctcccaaagtgctgggactacaggcgtgagccactgcgcccagcacccagtttctttttattgtagagtcatcttcccatgcaatatatttgagtgatgctatagtctgggataattgccctcccttagtcaagtgtcaggctcataactcaagatgggccaatcacattctcctcccacctcagctcccaagtagctgggactacagccagcacgcctggctatttttgtattttttgtagagacggggtttcgccatgtagcccgggctggtcttgaactcctgggctcaagtgatccacccatcttggcttcctagagtgtgggattacagacgtgagccatcacacggtccctaactgatactattgccatggcctaccttgcttgccttggcaggagggccagcttggcatgagttagcaaagaaccactatttgagatcacctattttatctcaagtactgctggaacccatgcacctagaaaagaccagggttttcaaccagtagatccagaataagcagtcttattgaatcaaaggatatatcagccaaaataatcaacaagcacaacttgatattttttaatggtagcttgaaggacctatctcagagtgccccttacatttttaactaagaagccagtattatctattgatcactgaatagcagtgtgtcccctggtcgtatttctctcactctctctgtctttttttgttgttacaaaaactgccagctctcacagtgattttaccacacctatgtatttacaatctttttttttttttattttttatttttattttttttagactgagtctcactctgtcgcccaggctggagtgcaatggcgtgatctcggctcactgcaacctctgtctcctgggttcaagcgattctcctgccttagcctcctgagtagctgggactacaggcgtgtgccaccacactcagctaattttttgtatttttagtagagacggggtttcaccatgttaaccaagatgctcttgatctcctgaccttgtgctcctcccgccttggtctcccaaagtgctgggattacaggcgtgagccaccgcgcccggcctacagtctgagaaaagtcatgctgagttccagtggctgcactggaagagtttgtgtcaccctaatccacttgtgtttggcagtgatttatccacatttgctatttctccacttggtcatttctcattaatgtctaaacctactgaaacctgacttctgttcctgccacttcaagtcctctcaaaggactactggtctcctgttttccaaatctgagggacatttccccagctttttcttacctgacttcagctgccatctatgtgctgatacctccagacctgtatctatctacttgccattcatctccagtcaccttaatactcagcatgtcccaaactgaactcaatacctttcctcctcaatccccctcaactgtgcttttcctgggatccttgtccttgttagtggcactcagtcacccatattaggaatctaggaatcatcacaatgatgattccatttcttatatttcacagctagtgagtcaccatgtcctttaattcccacctctctcttcatttcctctacaaccttaattcaggccttcatcatctctctcatagggtactgccagatcctcctacctagtttccctgccactagtcttttcccctttgaatccatccctgccatagcagagtgatcctttctaaaaatataggtttgatcatgttacttcaaggatgtaccattgactgcaagatacatgtgaagcttctcatcctgccatgcaagttcattcatgacctgaccttagtatatctctccagcctcataaattaccttgcctcctttgctgcctacttttcagtgatgctgttttacagttctgtgtataaatgcatctgtttcatacttttcccctacaccatccccgctcactctgacttcattcacctggtggatatacctattcgtctttgaaggactccattcaaaagacacctgtttgaacattttcctctgcaggtagagtagccattctttgtgccctccccatccatacagccagctctcacagtgattataatattttatcacacttatgtatttacatatatatttcccaaactcagggaatagtccacagactaccgttactttggataccagttgcaagtttggggaaccctaagactaccctctggttatataattcgccacaaggactcacagacctcattgaaagctgttatagtctctgggcgcagtggctcacccctgtaatcccagctactcaggagggtgaggcaggagaatcgtctgaactggggaggcggaggttgcagtgagccgagactgtgccactgcactccagcctgggcaacacagcaagactctatcccaaaataaaaaaaaaaaaatcaagttgtgattgttgataattttggctgatatatcctttgattcatgcagctgtccccagagtgtgtgtgcctgtagtgcctgtgtgcgccctttggggaagtagtccttccagacctgattatttctgaacagagtatggccaagtcactattgacactagcatgcatagcttctgaactgatatggttggctgctgatagcacagactagagcactcagaaaattatcaaacagagactaaatgtttaggcacttaaaacatgctccttggcaagaggaacacaatgttcctattacagaattgacctaaattcaggaaagagcttattgatgtaggcaaatgcttgaatctgcagccagcaggatcatcaatggatgagggtgggagcggggagtcttccaattttacaaggtcagcttgagcaactctctaagagccgacactaagactagttccactggatgtactgaagttgtataatcaggctccaaataactactacctctgcccaaatctgttcccagaactaatcaacatgcagggaccactgcatgtcagacaagagctgacctggatccctgtgaaaatctgtccacaggacactagtgctgctggagggaatggtgaagtacttgtatccatgacagagtcctagaaagatgggaagcaatatgggagctgactgaagccacaggaagtgggatccatttcctgaatacaaagcagaaactaattagtcagtttccaacacaatcttccattctcacagctgccaaagacctccagttcacaaatctcaagagaccttgcctgctcaaagttctttcttagctcctttcatccatgacacaaaatctaaaacctgctatctctctccagcctcttctcccaaactgtcctggtgggcttcttttctcacaggagtgtgagctcctcaagggcagggactaagtactgtccacctccataacccctctacttggcaggggcctaggacaagcttatctcctggtaggcacaaatgtttgctgaaggagtgaatgaactacatttgcattttatctctggcaatgtctaaaccaaagaaaatcacacttgtcttctcagaagagggaacatattcaaatacccagaattgcagttcctggtaaaacctttcggcggcagcagcaactggaaactcagcagaatctttgagtactaaaaagagtgaaatgggccaagacttgaacagccatggttgaagtagcccaggggactgagatgggaaggggagattcatggctatctaaagcttaagaaccacaaaccagttctttcttacaaatcacatatatttacattgtggatctgggatacacttatcacagtaggagctgctcaaatcaatctgaatgctacgcaatctgggaacctccccataactgtttgagccagcatttcagattatagataagctgtttccagctggactgggtttggaaagttcactctaaagaatgaagtcacctgttgtcactgtcctcctctccaggattccttttggggccaggtaccatcctgtggctccttaaggaggcttctctctttaattctccatgaggcatccagggtggtctgggctatgggaagaacccttcaacttgggagtagacaggtgctccaattcatagtgcccattctcagaggccttgtgtgtgagtttctccttcatgccttccttctggctcttcttgtgctccataatctgctggagctggtgcccagcatagtctggcttggtggtcagcgggccagccggcacagctacaccaaggacatctgacaccatgtaggggcgcagccagcccaccaagggagtgcttccggggctgtagtgggtctgtttgtggtagaagagaagtccatctacctataagacaaggggaaattgaggatcaaatgacttctggggccacatgtttccaggagagcctatacacacaagggcagctcttgtggtccgactcctttttctgggtcactgacagaggaaagagtcccagcttctcacacatgccgtttctctaaataaagaaatggcctagaaaactaaatttgagaaaataaaaacattggctgggcgtggtggctcatgcttataattccagcactttggaggctgaggcaggcagattgcttgagctcaggagtttgagaccagcctgggcaacatggtaagactccatttctactaaaaattcaaaaaaatagccaggcatgtgtggcacatgcctgtaatcccagctactcgggtgtctgagacacgacaaccgcttgaacccagtaggcagaggatgcagtgagctgagactgcaccactgcactccagcctggcgacagagtgagactctgtctcaaaaaaagaaaaaaaaaaaggaaaggataaacataaatagcactttcctgtttacagagtgctttcctgcccactattttactatcttacccatgacggtgtctgagagatggggctgctcatactcagggagttctgaggacctccttaaaacacacagtgagtaggaagcaggacttcaacttgaactctggtcttctgtccccagattccacggactttccaccacttaggggtctgtgttgtggtggatgagctctgtgcatggaatgaaaagcagaggaactggacaggcccctccggggcagcagattgctgcacacagtggaaacaggctgtccagatgccctgcttccctggctactgttggttgcctaaacctccccctaaattgtttgtgagccatgttctgggaaacagtttttctcaacgggaagacctcctacagtcccacattttattttctatgattcagtgactcatctctaaaaagcatttattgtcactggggcataagggttataaataaagatggtattcttaccaccttcttaattgactcccagaaatgctggcaactcagcctttgccatttccttatttgggaagctgtgatccttatataaaattacatccagttcaagcaaatgcttgcagtgactgggcagatttttttttttttttttctttctgagatggagtttcgctcgttgcccaggctgcagtggagtgcggtggtgcgatctcagctcagtgcaacctccgcctcccgggttcaagagattctcctgcctcaacttcccaagtagctgggactacaggcgtgtgccaccatgcctggctaatttttgtattgttagtagagccggggtttcaccatgttggcgaggctggtcttgaactcctgacctcaggtgatccaactgcctcgacctcccaaagtgctgggattacaggtgtgagccactgtgcccggccaaggcagaatttttaagggaatgatgggcaaaggaaaatgtgcttgttgagcctagagaaggtagctgcaggttctgaggctgacaagactgttgaggactggggagcctctggggctgtgaggtttgttttttgttttttttttttgagacagagtcttgtgctgttgcccaggctggagtgcagtggctcaatctcggctcactgcaacctctgcctcccaagttcaagtgattctcctgcctcagcctcccgagtagctgggattacaggcatctgccaatacgcccagctaatttttgtatttttagtagaaacgaggttttgccatgttggccaggctggtcttgaactcctgacctcaagtgatccaccggcctcggccttcccaagtgctgggattataggcgtgagccaccatgcccagccgctgtgagactttcagtgctaaaacagggcgagtcctgagcaaactggaatgaggtggtcacctgactcatgctcctgctcagcaagtgctgctgtccccaagggccatcttctttggtgaggaaaggattagggatttggacatttgttggagtcattcagtcacagaagcaccttcactttacaagcagccacgacagccaaaccagggacctgggtctcagcttgcagtaggaagaggcacacaagaaggatctaggcatgcaagtcttgctcctatctgggcctcagtttctccggacctcagtttctccatctgtaagatgagggagttggacgagctgtccattaagggcccttccagtgccagcattctgacttatccagcatgggtggagctcaggctctgaagggcagcaagtacatcctttctccagaatcagctttgtcccattctgatgctttgacacagcacaatcaaggaatattttaagactttgtgtaactaagtctctctgcagcctatcatcatgtcaaggcaataaagacaatggtttcgttacctcaaaagggaaatccatagatagcacatcacacaggctttcgggagtgcaagggaagttctttagccccacaaatttaaactgaaatagaaattagaacaaggaattagtacgttataaatgatactggcccaagcaattgaaaatctctgtcaggccaggcatagtggctcacacctgtaatcccagcactttgggaggcaaagtcaggaggatcacctgaggtcaagaaatcaagacaagcctggccaacatggtgaaaccccgtctgtactaaaaatacaaaaattagccaggcatagtggcatgtgcctgtagtccaagctacttgggaggttgagggaggaaaatagcttgaacccaggaaggggaggttgcagtgagccatgatcatgccactgcactccagactgggtgacagagcaagactccctctcaaaaaaagcaaaaagaaaagaaaatctctgtcaaagaagaaaaacttgtagtcccagctacttgggaggctgctgaggtagaaggatcgcttgagcctgaggtcaaggctgcagtaagctcagattgtgccactgcaccccagcctgagtgacagagccagaccctgtctcaaaaaccaaaccaaaccaaactaaaccaagccaaaacaaaaaaacaaagaagaaaagttttcagtctcatccttctctactaattcccctctacttactctcttaactactaggtcgtggttcccaatctttcctcccccttttttttaagagatgagatctcattctgtcacccatgctagagagcagtggcacaatcacagctcactgcatcctcaaattcctgggctcaagggattctcccacctcagtttcccagtatgctgggattataggcatgagccactgtacccagccccaaccttcttttatccacaagaatcatctagggagcttttaaaaattactgatactcaggaggctgaagcaggaaaatgacatgaacccgggaggcggagcttgcagtgggccgagattgtgccactgcactccaacctgggtgacagagcgagactccgtctctaaaaataaaaaataaataaaaataaattactgatgctggccaggtgtggtggctcacgcctgtaatcccagcactttgggaggccgagaagggcggatcacgaggtcaggagttcgagaccagtctgaccaatatggcgaaaccccgtctctactaaaaatacaaaaattagccaggcatggtggtacatgccagtagtcccagctacttgggaggctgaggcagaagaatcgcttgaacctgggaggcggaggttgcagtgagctgagattgtgccactgcactctagcctgagcaacagagcaagactcggtctcaaaaaaaaaaaaaaaaatattactgatgcacaggccctactctgagattctgactgaactggtctggggtgggatccaggttttttgttgttttttttgagacagagttgcgctctttcacccaggctggagtgcagtggcacaatcacagctcactgcagcctcaacctcttgggctcaagtgatcctcccacctcagcctctcaagtagctggaactataggtgcacgccaccatgcctaatctgtttttgtatttttttgtagagatggggttctgctgtgttgcccaggctggtctcaaactcctgggctcaaacaatccacctacctcagcctcccaaagtgatgggattataggcacacatcaccatacctggctaatttttttgtttgtatttcttttgtagagatggggttttgccatgttgcccaggctgctccgaactactgagctcaggcagtccacctgccttggccacccaaagtgctgggattacagatgtgagtcactgtgcctggcccaggtattttttttttttgagacaaagtctcgctccctcacccaggctggagtgcagtggcacgatctcggctaactgcaagctcggcctcctgggttcacagcattctcctgctcagcctctcaagtagctgggactataggcgcccaccaccacgaccggctaattttttgtatttttagtagagacggggtttcactgtgttagccaggatggtctcgatctcctgacctcgtgattcgcctgtctcggcctcccaaagtgctgggattacaggcgtgagctaccgcactcggcctggcccaggtattttttttaaagctcttcactgggccgggtgcagtggatcacgcctgtaatcccagcactttgggaggctgaggcaggcagatcacaaggtcaggagatcgacaccatccttgctaacacagtgaaaccccgtctctactaaaaatacaaaaaattagccggtcgtggtggtgggcgcctatagtcccagctactcaggaggctgaggcaggagaatgctgtgaacctgggaggcggagcttgcagtgagccgagatcacgccactgcactccagcctgggtgacggagcgagactctgtctcaaaaaaaaaaaaaaaaaaaaagctctccagctgattttaacatacagtcaggagtgggaaccactgtattgtactaggttgagtggttgtgtgttattctcttggccccatgacagctaccactaataaagggctagtgaaatccttttcacacctgcaaggatttttagactgaagcagcataactaagtgattagaactacaaactctaaagtcagattgcttgggtttgaatcccattctgccaatcatttaacctccatatactttcatcttcccatctgtaaaatgggataacaacagcacatatctacttcgtagggttactgtgtggattcagtgagataatatacatagagcacttaaaccagtgtcttagagagagcagtcttccccttcctcaatgcatgttcctccaggacctacatgataataacatcactgaaagtactgatcatatttattctcctataactggttgtccaattccctttaactttttttttttttttttttttgtgacagagtctcgctctgttgcccaggctggagtacagtggcacaatcttggctcactgcaacctccgcctcccaggttcaagtggttctcctgcctcagcctcccaagtagctgggattacaggcgtgcaccactacacttggctaattgtttttgtatttagtagagacagggttttgccatgttggtcaggctggtctcgaattcctgacctcaaatgatccacctgcctcggcctcccaaagtgctgggattacaggcgtgagccacggcgcctggcccttggctttaacattttttgtgagcaatccaagcaaatgccaatctgcagggctaataaaatgccctgaaaatagctgtcacatatttaaatcactgattattattgagtgcctaccatgagtattatgttaggaggacttgcatatttatataatttggttcttataacaaccctgtaaattagatgttattaccctatttttcagatggaaaatctaagggtaagtgagattattaacttaacttagtaataaattttttttagtctttttttagttattattacttcaataggtttttggggaagaggtagtgtttggttacatgaataagttcttttgtggtgatttctgagatttggtgcacccaccacccaagcagcgtacactgcacccaattatccctcatcccccttacccttccccagagttcccaaagtccattgtgtcattcttatgcctttatatcctcatagcttagctcccaattatgagtgagaacataggatgttaaattagtaataataaaagccaaaaatggaattcagatctacatgattgatactcttccctttataccatgctgcctcaaaaaagatcatttcatacataatgattatatttagataacagaccaatccacactactccccataaggaactcagtgatcctaacaccaggccttacaggattaagcttggttttctctcccagtccttcttcttctggtaactttgaatgcatccagtagaatcggaaatcagtctgccacagagaagggaaacagaaagatgaaatactttccatttcaaactctaatataaacaaaaacaccccatgctatttttttttttttttttttgagatggagtgttgctctgtcacccaggctggagtgcaatggtacagtctcggctcactgtaacctccgcctcccaagttcaagcgattctcctgcctcccaagtagctgggactacaggcgcccactgccacaccaggctaatttttgtatttttggtagagacagggtttcaccatgttggccagagtggtctccatctcctgacctcttgatctctccacctcgagcctcccaaagtgctgggattacaggtgtgagccactgcgcccaccgggcctcttcattcttttaaattattttgcttttggaaatttaaaaagatacatacagtcttttgtttacgttataaaaatatatttggttttagttaccaaatttgtaggttgtgaatacatgtaataaaatatccttcagcagaattaaaggaaaatatgttctagattgaatttatgttctgagttgtaggcttggttctacacgtgggcaaggtacttaagacctgtgcttcttagcatctcagcttccatatctatatgtcaaggacaggccaggtgcagtcgttcatgcccagcacttcggtaggccaaagtgggtggatcacttgaggtcaggagttcaagacagcctggccaacatggtgaaacgccgtctctactaaaaatacaaaaattagctgggtgtggtggcaagcgcctgtaatcccagctactcagaaggcggaggcaggagaagtgcttgaacccaggatgcggaggttgcagtgagcccagatcgcagcactgcactccaacctgggcaacagagcgagactccgtctcaaagaaaaaaaaggatgataatagtacttaccttacaataaggacgtgttgtaagggatttaatgagctaatgcagaaagtgcttagcaatgcacatcttgattgttattgtttgaatgagatgcaccttagaattctgagtaccaatacctagtgtgttttggaaacctagtatgcgggaatggcttagaaagaagcagcctatggtgacagcctgcatgaagatcactggaggcctgttcacacatcagcctcaggcccatttctacaacgttctgatatgcctggtctggagactacacaccgagaaccactatgataaactaattgacagggagcaaaaggaagtaccaaaacccccaaacccaccattatacaactgggacaatgacggggagagtgttcttaacagggatggaggccggtggggctcactcagcctcacctgatgactgctgctgttacctgttaagaatcaccaatagtaaaatgttgggggtatggtgaaacagaaggggagaatattggggcctctcctcctttgaaaagtctcctcctagagctaacctttgagatttgaggttctgggtcataccaaggaggccctgccattttcagggtcaggatgtggttggtgaaggagtggaggttgcaggagtctagtagatggtgacttacattcaattccaccttctcttcctggggctgctgcacaaggtggcatccccacccccttgccccacaatcttcactgccagaaatcctcccatactctggagagagataagggggtgggtgcagctgctatcaagtcccagcctacacccctgccatttctttctttcttcctctcaagaactgcatgtttctcttagttcctcctatttctcttttaaaactaagctaatttaaacacactcaaagatgcagggagcattagataatgttcttgatataccacatcctgtgcacaccaagaagttggtcacataccaaacccacatgctgagccgctttcccaggaggagaggagaagacaggaagagccacgagaggaggatccatccctacctggcaatcataaaaagggtgtccccgccagcacatcacatccagaacgtagtaggtctggtttacctcattgtaaatgcaatctagaatggtgtagtctgaggacacaaagcagaaagtcagcacagagttcttcttccaaccaggttccctccaccacaacctagggagccccatcccagaggcttgagtccaacaatcctcagtgcttgcagcagtcactggcactaaggactaaggattcactggggagagaaccctgcctggctaccagctacagcttcatggtgactcagggtaagacagcacaagacgcatcaaggcaaaccttaagcaaagtgagaattctgaagttttagataaactggcacatttactcacctcaacgaggtttaaaagcaagtcatcttccattttagtttacaactgctttttgagttcctatcataggcactgtgttatgtggggaatattaactataaatattccctgcctttaaggaagttaccatttggttaaggggataagatgatcacagaagaactaagagctaaattacagagctcatactaagagcaacaggagttcccgaaagagaaggctggagcagcaggaaatgcttcaagggagagatgccatacaaatagtcttctgggaccagccgggtttaaacaacagggcagaggggagaagagagggcatttcagacccaagtactgatgtggcatgagcaaagccccagaggcagaatgaactgggcacatgtggggagataagtcagctgaacagaaggtgggtataaggagtaggggaaagacatgggatgggtgggacaaagcctgcatgtgaaaggtactaaacgccaacagagaagtcagagcaaggccaggtgcagtggctcacacctatactcccagcactttgggaggccaaggcaggcagatggctttgagcccaggagtttcagaccagcctgggcaacatggcaaaaccccatctctaccaaaaatacaaaaaattagctgggcatggtggcacactcctgtagtctcagttactcaggaaattgaggtgggaggatcacttgagcctgagaaataaaggctgcagtgagctgtgatcatgcccttgaacccgagcctgggccacagagtgagaccgtgtcaaaaaataaaaaagagaagtctgggctcagtacagaggacatgaggaaccaccaaaggagcctgagcaggtagagaagaaagcaagcccagctctgccaattccttactgaataactgtgggtaagttatttctcccccacgaccttagtctactcagctaggcccagtggggaggaagaacctaaggttacaacaatgagaaaggagaaaagggagtttggcagggaagccccagcatcagctggctgtaccattatgcttagtattctctcagagacgtttccccccaaatctgtatctgttgtcccgtaatagaagtccaaagatatgttgaccttaattcaggaatttacggaccatcaggcctcatggggctgcatttattctgcaactggggacgcttgaccttgaaggggaggtccttggtccaggggccaggatggtgtctacatgcagtttcaaagataagctttcaggccgggtgcagtggcttatgcctgtaatcccagcaatttgggaggccaaggtgggtggatcactttgaggccaggagttcaagaccagcctggccaaaatggtgaaatccagtctctactaaaagtacaaaaattagccgggtgcagcctataatcccagctactcaggaggctgaggcaggagaatcacttgaacccaggaggcggaagttgcagtgagccaatatggtgccactgcactccagcttgggtgacaaagtgagactctgtctcaaaaaacaaaaaaaaaaaacaaagataagctatcaaagtgggtcttttttttttttttttttttttttttgagacggagtctcgctctgtcgcccaggccggactgcggactgcagtggtgcaatctcggctcactgcaagctccgcttcctgggttcacgccattctcctgcctcagcctcccgagtagctgggactacaggtgcccaccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcccaaagtgggtctttaaagcaaattacactgtcttttactgatcaataagtagacactctatgtaggtaccttttgctgttgagtttcgcctgttgcctcctggcagaagtgaagaaaacctgttgacacagtagccactcttggtgtaggcactggtagaaccctgcatggagagaaagttaccattcttattagacctcaaggtctcctcgccctcttgcctcctcattctgcaggaatgttactcgaccaaagatggctctcaacaaaccttcctgcaggaaagtgtttcaagctccactccaggcacagctgttgtggcgtatgaggaaaatggagcacaaagaatccctcccactacagaccaggcctactggcatagggggcaggcagctactcaccctggaggccacgataagggctctttttccaacagggcacacgaccacaatccattcctgccccaaatctgaaggaacgtcaattaaccactcagaaagcatcaactggaaatgcaaaaaatagtgttaaagatcagcaggggtgtgctactcgaaagtctgcaatgacaaggcattaatatcctgtgtgtatattaaaaacctgagtgaaagaatgagggcagagagccgggcacgggggctcatgcttgtaatcccagcactttgggaggctgtggcaggtggatcacctgaggtcaggagttcaagaccagcctggccaacatagtgaaatctcgtctctactaaaaaatataaaaaattagctgggtgtggtggcaggcacctgtaatcccagctactaggaaggctgagccacgagaattgcttgaacctgggaggcagaggttgcagtgagccgagatggtgccattgcactccagcctgggcaccaagagcgaaactctgtctcaaaaaaaaaaaaaaaaaagaatgagggcagaaaaggctgacagtggcacctccaccccatgtgctctagggagttggctgtgtctcctgcacagctgacaggatgatgggggccactgactatgaactttggcttctctcctccatctccacctgcaaccacaccatgcttactgcctcacctcccgggtcagggtgatgaaccctcttcctttccttactttgtccatctgctcctatcatcattactattatgtttgccacaactcagagatgaataagatccctgaccttgagatgctcttagactagaccagcatttctcaaaccgatgccccaaatactatactacaggatgttaggaaatctgtcttaaaaaacgaaacaacgccaaaccaaaccaacaaaaacagtgatgtggtgaaattaatttgggaagacaaactcttccactcagtctcttccatctgtaaagactttgtcccatgggctgggcgaggtggctcacgcctgtagtcccagcactttgggagaccaaggcgggcggatcacgaggtcaagagattgagaccatcctggccaacatggtgaaaccccgtctctaccaaaaatacaaaaattagctgggcgtgttggcgggcacctataatcccagctactcaggaggctgaggcaggaaaatcgtttgaacccaggaggcgcaggttgcaataagccaagatcacgccactgcactccagcctggtgacagagtgagacttcgtctcaaaaagaaaaaaaaaaaaagactttgtcccatcaattaatctctctcattgaatctttcatttctccttccctttaggcactcactcccaatctttttttttttgagatggagtctcgctctgtcgcccaggctggagtgcagtggcgctatctcagctcactgcaagctgcgcctcccgggttcacgccattctcctgcctcagcctcccgagtagctgggactacagtcacccgccactgtgcccagctaattttttgtatttttagtagagacggggtttcaccgtgttagccaggatggtctcgatctcctgacctcgtgatccgcccgcctcggccccccaaagtgctgggattacaggcatgagccaccacgcccggctcactttaaaaaaaaactttttgtggccaggaacggtggctcacgcctataatcccagcactttgagaggctgtggcgggcagatcatgaggccaagaaatcgagaccatcctggccaacatggtgacaagccgtctctactaaaaatacaaaaattagccaggcgtggtggcatgcacccgtagtcccagctactcgggaggttgaggcgggagaatcacttgaagctgggagatggaggttgcagtgagccgagatagcaccactgcactccagcctggcgacagagcgagaccccgtctcaaaaaaaaactttttgtcactcagcatttctgttgagctactccactttctcctagtttaaaaactacttaatacttcttgatgctgccttcttgctcaatctgacagccacagtccagatttcctaccccacagtcctactgaaggccctctgacctcttctcataactcttcctttttttcctttttttttttttgaactggagtcttactctgtcacccaagctgaagtgcagtggcacaatctcggttcactgcaacctccacctcccgggttcaagcgatcctcccattttagcctccctagtagccgggactacaggcacacgccactacgcccggctcatttttgtatttttagtagagacagggtttcaccattttggccaggctggtctcgaactcctgacctcaggtgatccacccacctcggcctcccaaagtgctgggattacaggtatgagccactgtgcctggcctcccatacctctttcttatcctccccactctactcctcgccttacgtaatgctaccagccacatctcccttcctgacatccgttcccttggcaccatgacatagcactactctgtttttccctctaaacattcctccacacactcccccaaaatatgtaatcttcagggggctgttttaggtcccccttttctcttagatgctgttcccattaggggtggatctcatctatttctatagcttcacttgtgcctcctaatgctccttcatctccagacttctttcctccacactcatctatattgcgagatgtctgcttggtatctctttctgtttgtctcctctgcaccgaaaactcagtatatccagagtggaattaactgccttctgttgcctaagtacttcccacccctgaaacacctacccttcccttctgcgtctcataaccttgttaatggcatcaccactccgttactgaatcttagagtttaagcataatctaggcaaattagactacatcaaaatttaaaaattctgtgctgccaacaatatcaccaagaagacaaaaagacaacccacagaatgaaagaaaatatgtgcaaatcatgtatctgataagaaacttgtatctagaatatattaaaaactcttataattcaataataaaaagataaataactcaattaaaaaacaaggagggcagatcatgaggtcaggagatcgagaccatcctggctaacacagtgaaacctcgtctctactgaaaatacaaaaaaaattagccgggcgcggtggcgggcacctgtagtcccagctgttcgggaggctgaggcaggagaatggcgtgaacccgggaggcggagcttgtagtgagccaagatcgcgtcactgcactccagcctgggcgacagagcaagactccatctcaaaaaaaaaaaaaaaaaaaaaaaagagcaaaggatttgaatagacatttctccaaagaagatatacaaatgaccaatacgcacaagaaaagatgtttaacatcaggccaggtgcagtggctcacacctgtaatcccagcactttgggaggccgaggtgggcggatcacaaaatcaggagttcgagaccagcctggtcaatacgctgaaaccccgtctctactaaaaatacaaaaattagccggaagtggtggcgggtgcctgtagtcccagctactcgggaggctaaggcaggagaatcgcttgaacctgggaggcagaggttgtagtgagctaagatcgtgctattgcactccagcctgggcaagagagggagactccaactcaaaaaaaaaaaaaaagaaaagaaaagaaaagatgtttaacatcattagtcactagggaaatagggaaatacaaatcaaaaccacaagaaaccacttcacacccactaggatggctatatttaaaaggatggacaataacaagtgttggcaaagctgtggagaaattggaacacttatatgttgctggtgggaatgtaaagtagtggagtcactttggagaacagtctagcacttcctcaaaaggttaaacagagttatcatatatagacccagcaattccacttctaggtatatacacaagagaaatgaaaacatatgctcacacaaaaacttgtagtacaagaatattaataatggcattatttggctgggtgcagtggctcacacctgtaatcccagcacattgggaggccaaggcaggtggatcagctcaggtcacaagttcgagaccagcctggccaacatggtgaaactcccgtctctactaaaaatataaaaattagctgggtgtgatggcacacacctgtagtcccagctactagggaggctgaggcaggaagatcacttaaactcaggagatggaggttgcagtaagccaagaacatgccactgtactccagcctgggtgagagagtgagacttcatctcgaaaaaagtaaataaataaaattaattaaaaaacaaataaaaatggcattattcataatagccaaaaagtaggagcaactcaaatagccataaactgaagaataaataaacaaaatgtagtctatccatacagtggaatattatttggcaataaaaaggagtgaagtactgatacatggtacaatatgatgaacgttggaaacctcatgctaagtaaaagaagccagtcacaaaagtccacatattatatgattccctttctatgaaatgtgcaaaataggaacagaaagtagattaatgattaggggctacagggaagaatggagagtgacactaattagtatggggtttcttttggggataaggaaaatgttctagaattaaatagtcgtgatggttgcacagtcttgtgactacactaaaaaaaaagaaaccattaaactatacaataaaaataggcaaattgtatggtatgtgaattatatctcaatataactgtctaaaaaatagtagtagcagctaatacttgtggggcacttccagactctgggctaggtatttaaggcatattatttcatttaatccttctaccaatcctatgagataagtactattactatccccattttacagataagaaaccaaagacttagagtggctaaaataccttgcttaaggtcaacacagagcctagctttgagatcagatctgtgtgacctcaaagcttacatcctttcccacttcttatactgcctctcatatccagtccactgctaagttcttccattctatctggcaacatttcttttttatttgttttatttattttttattttttatagaaatgggatcttcctatgctgtccagctgggattacagacacccatcacacctggctaatttttgtatttttaatagatggggtttcaccatgttggccaggctggtcttgaactcctggccttagcctcccaaagtgctgggattacaggcatgagccactgtgcccagcctctgcacatatttttgaggccctttacatctcttctgccatactccttctcccaactctatgccactctaccctaactggcctgcaaactgctcccgggcacaccatatactcctttctggcttctgggcctcgtgctcagcctgtttgttcccactgcctggaatgccctaaaatgcactgcacttctatctattaatgtcctacttacccttcaaggctgcctcttccttcattaacccttctctgatttcacaccccctccttcctccttggttggaaggaatctcatttttttttttttttttttttttttgagacggagtctcgctctgtcgcccaggctggagtgcagtggtgtgatctcggctcactgcaagctccgcctcccaggttcacaccattctcctgcctcagcctcccaagtagctgggactacaggcgcctgccaccaccacgcctggctaattttttttttgtatttttagtagagacggggtttcaccatgttagccaggatggtctcgatctcctgacctcgtgatccacccgccttggcctcccaaagtgctgggattacaggcgtgagccactgcacctggccagcatctcacttttttatagcacaaaacatcttctacacctattctaggagcacaggggctatttctgctccacatctatcttcccatgtcatagcctagtttaacacagagcaggtctttcaataatgcttactgaacaaaattgaattgtactttgtcacagaggatgttatctgtactgtatttggggtaaagaaaggggctgtgggagtgcatccaataaccatattctattgtgtttttttttttctttagagatggggtctctccgggtgcagtggctcactcttgtaatcccagcactttgggaggccgaggggggtggatcacctgaggtcgggagttcgagaccaacctgtccaccatggtgaaaccctgtctctactaaaaatacaaaaacttagccgggtgtggtggcaggcatctgtaatcccagctactcgggaggctgaaacaggagaactgcttgaacccgggaggcagaggttgcagtgagccacgatcgtaccactgcactccagcctgggcaacaagagcaaaactctgtctcaaaaaagaaaaaaaaagagatggggtctcactatgttagccaggttggtcttgaactcctggcttcaagtaatcctcccaccttggcctcccaaattgctgggattacaggtatgagccaccacactcaggcccaggaaccatattctaaaggcaggggagaattctgagatgacaagatacttgggttctagacacaagtatatgatagcagggtagacctccatcccaacttggacccataccctgctttctgaaatacctgagctgcctggaacacaagaacagtctctctccatacctctttccctatggtaccacagccatgttggtttcctctctggatctaaaagggcactgagtcaggtttattatagtgatctgctgcttcatggcctgaacctcaccttggccagctggctggtctggggtggctgggcaggctcactttattcaagggcagctgtacttcccacttgccaccacctgagtgtgaaatttcaagactggcctcatagtacactgcctgggaaagactctaccacccagggaagtggaaggagtcagtggtaggctgggcaggcccaatccagaacagctgtgcagtgacaactaaaaaaaatgacaaggatatggagtgtgttactatatcaatagctcaggggctttctgcagtgggctggcagcctttggtaacagcacaggctaatagttcccaaaccccactacccacagattccatcagtgattcctagtcagtccatagcacagtaagccatctctacttatcatcccatatgatctacgtacactggcatgttctttgcagttcctattcctttttcctgcctcattctcctctctttatgacagcatttatttcagtgggctttgactgcatagtaaagggagtgagattagctgggtctcatcttctctggaccacttacttgattagcatagtgttttggtaacttcttgacagtgtcaatgtccatttcttcatcatctttcttattttcttcctcactctccatccctgtccagtcatcttcagccagtcttctggcatggttcacataatccagccgcttgctggaaggaaaaaaaaggcataaggacatatcttttcttctttttttttttttagacagggtctcgctctgttgcccaggctggaatggtgcaatctcagctcactgcagcctcaacctcctgggctcaagtgatcttcccacctcagcttccacagtaggtgggactacaggcacacaccaccacccctggctaatttttgtattttttgtagagatggggtttcaccatgttgcccaggctggtctcaaactcctggcctcaagtgatctgcctgcctcagcctcccaaagtgctgggattattaggcatgaaccaccgcatctggccagggcaggtctttatgtcttttaggaagatgccctataatgcgacacatttaattcaaaagctccaaatttgggagcaacttggggattctggtggaagtaagaaatgatggaatctcctttgcaaggctaaaacagtgaccgccccctcaaaatcctaaatagcgaaaccccctctgaatacactcagccttcctcagagtttcctaagaatgcaaaataaaatatctaaagaaatttccaaggttcactagatggaaaggctagcttcacccctaccccatcccaccccagatgagagctgacaccttcctgcctagcagacatctcatccaaagaccccaggggtggaagagaagagccactgagatgcagtgagaagtctaaagcaaggacagcttctggagatttctgccttatacaccttttttgtttttaaagagaacttttttttttacggaccgtaggtgtatgccactgtgcccagcttatacagctttctcagaagccaggcctttctccagttcctgtctaactttcaaaaaaggtcacttagtttacaatttaatatattttatttatttgtttccctttatcgttatcttgttttaaaacaacacatgctagaaagtttgggaaactgaaaagaaaaaaaaagaatcttttggaacctaattgtttcaaagtgatttggaaataccacataacctcccacatttgatttcttcaatgctaaggcaggaattcaaccactgaggcagtgaaaccaacacagctggtttctcttaaacacatacatgttcatgctcattataaaaaggcacacaccagagagaacatatgaaagcacaatggtcttttatctcgagaataaaagagctggtatatttgtacatgtgtgaaagaaagtctgtctgtggttatttcctgaacattgtttgtaatcacaagagaagaaaactgcccagatgcccatcaggagggactggcttgatggcattatgaagtatccattccacggaatacctagcaccacgaaaaaggaatgatgtggtactttatgaactgatatagaatttctcccccaaaacaccactaaataaatgtgcagaacagtatatagtatactgctacttgtgttaaaaaaaaaaaaaaaaaaaaaaaaaaaagccaggtgcagtggctcctgcctgtaatcccagccctctgggagggtgaattggccagatcacttgagctcaggagttcaagaccagcttgggcaacatggtgaaattgtgtttctaccaaaaataaaaaaattagctgggtgtggtggcctgcaccagtggtcccagctacttgaggggctgaggttgcagtgagccaagatcatgccacagtactcagcctgggagatagagtcaaaaaaaaaaaaagcttttgtacacatactaccacacacacttgctcatatatgtatagaatatcttcggaagggccaggcgtagtggctgacgtctgaaatcccagcactttgggaggtcaaggtgggaggatcagttgagcctaggagttcaagatcagcctgagcaatatagggagaccctgttcctacaaaatataaaaaaattagccaggtgctatggagtgtgcctgtagtcccacctacttcagaggctgaggtgggaggatcacctgagcctgagaggttgaggctgcagtgagccgggatctgcacactccagcccgaacaacacagtgacaccctgtctaaaatatatatatatttggaaggatacaccagaaactaataatataggagaggaactggatagctaggggacagaaatgggaagacctcaccatatactcttctatttattttatttatttatttatttattggagagagtctagctgtgttgcccaggctggagtgcaatggcgcgatttcggctcactgcaacctccacctcccgggttcaagtgattctcctgtctcagcctcccgagtagctgggactacaggcacgcaccaccatgtcgggctaatttttgtatttttagtagagacaagttttcgccatgttggtcaggccagtctcgaactcctgacctcaggtgatccacccacctcggccacccaaagtgctgggattacaggcgtcagccaccatgcccggcctcttatgtatattttaaattttcaaccatacaaatgtattacctattcaaagataactacatttttaaaaatggggagaggaatgatctgggaatgtattctgcaagccacccagagccacagggaaccatctctgccaaacacaaccagtgatgcaacactgggcaaaatgcagactgtatggaaactatgcagctgttagtagtttcttctgatccctaattccttaatttatgacccagaagaggcccatgctgcattgagaatacaaggatcggccctgccttcagagtagctcagcctcaaacactcttatcctgccctctttccctgtttgcacatcttggcacttagaattaagtatatggaagacatttcctcagattcccttaggaattatttgtcttgaactcccaagagtgccacagaaacatttgggctgaaggcagatgggaagaccacaccaataccagcattcagagtgcagaagccaaacacaagcatcccaggaaatgtggggagtgaaagtctgggcgtggctttcgcaagttcctaaaccacagagctcagtacagctgccaggaaaaaaagaaaaacttaaccaaataattgagcttttggtttcaaacttcggtgtctccctaattcctcatcttctcctaagctctgggtataaaagaaacctacctctgccaggatttacccctcccaacctgtgggcaagaagatcagcctacaaagagtctactttgaagggagagtctgtagagacaagcctagagccttcggaatggttcatagctcctagcccagagaaagaagacaaggagttaaagcttccttacgatttctgcagttccagtaacctccggcggcgctcactctgctccaaggaactgtacttggacttgtactgggataggcgggggtgtggggcagctgtgctgttcagatcttgagacacagaaaagctactagccagggcctgactcaactcttccatcttccctacaaaggaaaacgtaagaaaatggttcattcatttcatatcatctcctgtatacagacagttatgcagttatgatatgatggccacattcctgaaaaaaaattaacttaatgcaaaatcacaagtgtttccatgagacaaaaggaagttaaagggtaaatgagtcatatattagcaataacattattttcctacagatatttccttttttttttttttttgagacagggtctctctctatcacccaggtcggagtgtagtggtgcaatcacagctcactgttgcctcaatctactggacccaagcaatcctcccacctcagcttccccagtaactgagactacaggtatacaccaccacacccagccaattttaaaatttattggtacagacgggatctccctatgttgcctaggctagtcttgaactcttgggctcaagcaatcttccctcctcagcctctcaaagtgctggcattataggtgtgagccactgcgcccggccttttctgagcagttcctctacagtttcctgaatagccatcactcattaaccaatataactctccatgcagtttattcaattggttatttaattctcaactaagtgccaactcatattatgaaaatttaattccagaggaaacactggttctagggtccctggaggaagacaaaagcaatcaaaaaccccaaactcgccaggcacgatggctcatgcctgtaatcccagcactttgggaggccgaggtgggtggatcacaaggtcaggagttcgaaaccagcctgaccaacatggtgaaaccccgtctctactaaaaatacaaaaactagctggatgtggtggcaggcgcctgtaatcccagctactcgggaggctgaggcagaagaatcgcttgaacctgggaggcggaggttgcagtgagccgagatcgtgccactgcactccagcctgggcgacacagcaagacttcatctcaaaaaacaaacaaacaaacaaacaaaaaaacaaactctagcgacctgggattacaggtggctcatgcctgtaatcccagcactttgggaggccaaggcaggaggatcacttgaggccagtagttcaagaccaacctggacaatgtagtgagactatgtctctactttttaaataaaaaagtaaaaaattattttaaattataatttattttttaaaaaatctgattgttacttcctcatattctagttgtgttttgtttttgggtgggcagaaagaaggtttcagggctacttatgtgggactcacttggaaaagagctaggatgtggaaggctgcttaacaagtaacgtcaatgctccagtagtgtgaagaacttccataaagtacattagggaaacaagacaggcatggagtagatgtcattttgaaaacagacttcccactttaggtggaccctaaagaatgggagtggggagaaaggtgaattcacacttcattcaagcgcctgtgagccttagattataagaaaacaggaacatttgggagaaatctgacttgcactgctgggctggcccagccctttggttctagtgtaaaccagagggcacctccagtgcttaacctccatcccaggccaggtccagtgctctgagcatcaaaatcaacaggttcattccagagcctctacagtgaaaaatacaactccataggcctctacttggccagtgagttactttccattgcacaagtgaagtcagatatttttcttgatttgaaacattagattttgtttaatttaaaaggaacttaaaaatcgtggtttgccaggtgcagttgtgcttgcctttagtcccagctactctggaggctgaggcaggaggtatgcttgagcccaggagttcgaagccagcctgggcaatatagcaagaccttgtctgtaaaaagaaaaaaaaattgtggctaaatacacatatcatgaaattcatcatcttaaccatttgtaggtgtacagttctgtaaagttaagtatgttcaacactgctgtgcagaactctccagaactccttttatcttgaataactgaacctctgtaacctttaaacataaaagaaacttttttttttttgagacagagtttcactcttgttgcccaggctggagcacaatggcacgatcttggctcaccacaacctccgcctcccaggttcaagtgattctcctgcctcagcctcccgcgtagctgggattacaggcgcccgccaccacgcccggctaattttgtttttgtattttttagtagagacggggtttcaccgtgttagccaggatggtctcgatctcccgacctcctgatctgcccaccttggcctcccaaagtgctgggattacaggtgtgagccaccacgcccggccttttttttttttttgagacagggtctcactttgtctcccaggctggactacagtggtgtgatctcggctcactgcagcctccacctcctgggttcaagtaactctcctgcctcagcctcctgagtagctgggattatagacatgcaccaccatgctcggctaatttttgtatttttagtagagaagaggtttcattatgttggcgtggctggtctgaaactcctgacctgaagtgatctgcctgcctcagcctcccaaagtgctggaattacaagcatgagccactgcacccggcttgaggtgtgccttaatatctttgcaatgcaaccaagggttgccattcctgagtgactgaggcctcatgatgagtgcttgggatccatatggtatgttattcaaatcatccataatggtatgtatgctattgtctctacttttctgtacttttgtgtaagtttgaaagctttcatgataaaattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttcagtagagacggggtttcaccgttttagccgggatggtctcgatctcctgacctcgtgatccgcccgcctcggcctcccaaagtgctgggattacaggcgtgagccaccgcgcccggccgataaaaatttttaaaaagtcattatgttttcagttcatcaccaaagtaatgaccaaatccaaagcacctttattaggcctatcatgcactatcttggtgtgggctcccgctctgccaagaaccacacaacctttgaaactgatgtcctgggcctggcgcggtggctcacgcctgtaatcccagcactttgggaggttgaagcgggcagatcacctgaggttaggagatcgagaccatcctggctaacacagtgaaaccccgtctctactaaaaaaaaaaaaaaaaatacaaaaaaattagccaggcatggtgacgggcgcctgtagtcccagatgctcgggaggctgaggcaggagaatggcttgaacccgtaaggcggagcttgcagtgagtcgagatcgtgccactgcactccagcctggacttcgtctcaaaaagaaaaaaaaaagaaaaactgatgtcctggatactggggcggttcctttaccttccttcaaggctgttcttggcgggttcctgctgtttcgttttgttttttctttgttgttgttgttttttttttgagacagagtttcgctcttgttgcccaggctggagtgcagtggcatgatctcggctcactgcaacctccatctcccggattcaagcgattctcctgcctcagcctcccgagtagctgggattacaggcacgcgccacaacgcccggctaattttttttgtatttttagtacagatggggtttcaccatgttggtcaggctggtctcaaactcctgacctcaggtgatccgcccacctcggcctcccaaagtgctgggattacaggcgtgagccactgcgccccgccgggctcctgctgtttcaacccattccttggatggtgctgcctccaagtgttcggaccttagccccaggtggtcttagcaccagtaacccccgctccaactccctaaagtccgacccgccccaggccccgcccacgctccaccctccctccctgtctagccccctcccccatccccttccccctccttcgcgtctccccatccggcgcccccgcctcgcgtcccctgggtccgcatcctggcagcctccgcgtttccctacccctgctaccgggctccagccccggggacgctatctgcttcactcggccgtgcgcgccgccaccgccccgcactgcctttttctaggcatggggtcatctaggccatgcatgattcgcccctgccccacagaagtccctgaggggtcctggccggacagcacggaatagaagaacggaaactctcccaaaaggagtcccaggcctggctctatccctccagatgacgtcccaggaggccagagtgcagggccggccagagggagtcacagtccggcaccgagaggcaactcggcagctggcggggcccgggctcgaacccagggactcacccaaaccgaggtgaccgtcgcacgcgccgccgccaccggggccgacgaatcacctgccctgggaagctaggtccgccctccccccgcccccagctgctgcctcaccgctgggcccacaggcctcgcgccctgagtttccggctcctccctcctttgcgaacgctgggagttccgttgcctacaggccgttatttccgccttcaacggctggggcatttcccatcggctagggagggggtcttcttgcatttgctttgcactgtccgggactcttcctgctagatgacttgaccaggccgaggcctccctcctgaacacaagctcttcggggctcctttcgccaatgggaggaggctgatcttgtggccgggcattcaacgccctgggccctgccgcctcccgcagatcttcccgggccttagggcttcacctggagtccccttcccctcttgggcccgtgctcttaaacgggcagtgccaattgcctggattactccaactaacccctcacacccaagtttcagacacagaccttcgctcccccacttgcccttaacaaaagcagatacatacctcgattactgcctgtttgctgcttttgcgagcttctttcccactcggctgcgggctgagcaatggtagggacctggcttgattcctatttaagtagccagagtccagcacaagggatggcgctcagtagaccctgcgtgaaggaatgattaaattggtgcaaaagactagggtaagcggcagagatttaggagattaagtcctgccagggtgtagcctctgcagggcgggaaggctgagattacaattttaaaactgaatatttattgaatgcttacattcagccaatccctgcttcacacccatcatctcatttaatttttttccttttttttcttttttaagccagtagatattaactcttaatcatgacatgaggaagtagacacactgaagctcagagaggttaagtaatttggccaaagtaacacagctttcaaggaaaatgtttgaatttgctgaaagtttgatgtatagggaagttgactaccgatgtatgacagaagcaaagtatccacctttggcacattttgcgtccacggaatgctaaaatttggacttgtgtattttatgcacattacaccatacattcagactaaaaagaataggaaattaggctgatgaaaggctattactagactggtaaaaagggttctggggccctggaaggccaatttttctggacgtgagatttttttttatttttttgagatggagtctcgctctgtcgcccaggctctggagtgcagtggcgcaatctccgctcactgcaagctccgcctcccgggttcacgccattctcctgcctcagcctactgagtagctgggactacaggcgcctgccaccatgcccggctaatttttttgtatttttagtagagacggggtttcactgtgttagccaggatggtctcgatctcctgacctcatgatctgcccgcctcggcctcccaaagtgctgggattaaaggcgtgagccaccgcacccggcctggacctgagattttatttaggtggctctttcagtggccaggctgagcaaagctgtccactagggtatttatttggtgcatccacaaataaaagctcatgtctgcctgatttatgagactgacaaaaaagagaagtccagggcctgacttcactagggaattttgacacccaggatattaggtattttgtgtccaaacaaccatcccttacaaccacggaggtcacatctaatggtcgggctgcatagaaaagaataaagaccttaaacattttaggaaaatagactgagactgagaaagaagttcccaaattcatgcctggaggtccaggagaaatgttctagttcctcactcacacctagctgaataacttcccatatcactgaaaaaacaaaacaaaaccaggtcaggcactgtggctcatgcctgtaatcccaccactttgagaggccaaggtggaagtagcccatgagtttgagaccagcctgggcaacatgacaaaaacccatctccacaaaaaaaaaattagctaggtgtagtggtatgagtcatgatcccaactacttggaaggctgaggtgggaggatcacttgagcccaggaagtcatggctgcagtgagctgtgatcctgccactgcactcagcctggagactctgtctcaaaacaaacaaaaaccagagcacctggcccaggggttcatttagagccagtgggtgtttcagaaggggctacctctggaatctcagcttcagaatgttggccacatgcacacactgtgctttatgtctttaaatcaattaatttaagaaaaaagcctgactacatttatttaaaagggcaacattggccaggtgtggtggctcatgcctgtaatcctagcactttgggaggccaaggcgggcagatcacaaggtcaagagatccagaccatcctggccaacatggtgaaaccccatctctactaaaaatacaaaaattatctgggcatggtggcgcatgcctgtagtcccagctgctcgggaggctgaggcaggagaatcacttgaacctgggaggcggaggttgcagtgagccgagatcgcgctactgcactccagcctggtgtcagagcaagactctgtctcaaaaaaaaaaaaaaaaagggcaacatcatagcattaccttacatcaatcacttcccactttattagaaggtatctataaaataaatacattgctcatgcctataatcctagcactttgggaggctgaggcagacagatcacctgaggtcaggagttcgagaccagcctgaccaacatggagaaaccctgtctctactaaaaatacaaaattagctgggcatggtggtgcatgcctgtaatcccagctactcgggaggctgaggcaagagaattgcttgaacccaggaagcggtggttgcagtgagccgagatcgcgccattgcactccagcctgggcaacaagagcgaaactccatctcaaaaataagtaaataaataaatacgtgaaaataatgttataggctggtgcaaaagtaattgcagtttttggccgggcgcagtgactcacgcctgtaatcccagcactttgggaggccgaggcgggcaaatcacctgaggtcgggagtttgagaccagcctgaccaacatggagaaaccccgtctctactaaaaatataaaattagccgggcgtggtggcacatgcctgtaatctcaggtactcaggaggctgaggcaggagaatcgcttgaacccaggaggcagaggttgtggtgagccaagatggcgccattgcactctagcctgggcaacaagagtgaaactacttctcaaaaaaaaaaaaaaagtaattgcagtttttgccattaaaattaatggcaccaacctaatataatcttgctagatagatatggatgtctgcagaaagctgtaagtctggggactttgtaaaaatcagagattagcaagtgttgaagtgataaggagtcacactaacagaatttttctttgacgtaatcagaaaaattcaaagaggacagaagagggaagaaccactttctcactctattattcaatgtcattaaagtggaatctgtgtaccccttaaaatcttctggttgcccatgggcaggagaatccttacttagaaaagagaaggttgagagcaggaaggtgtccagcccagaggggaaatggagggaggtaagatcacagaggctgctgggacacaggggcaggtaagggcctcaggccacggtggggagtttggattttacctccactgctgaagagggtttatttttttggggggtgcgtgggggttgtttttgtttttgagacatatcttgctctgtcgcccaggccggagtgcagtggtgcgatctctgctcactccaacctccgtctcccaggttcaagcaatcctgcctcagcctcccaagtagctgggattacaggcatgcgccaccatgcctggctaatttttatatttttagtagacacggggtttcaccatgttggccaggctggtctcgaattcctgacctcaggtgatccgcccaccttggcctcccaaagtgctgggattacaggtgtgagccaccatgcctgtctgcagatgagggtttttaaacagttatgagatagcagattccagctttagtgagctcccgctggctacttggtagacaactgaatgtaggcaaccaagtgtggaggcgtggaagccagtgagcagaccttgcatgaaagtatgtcgggggatgtgataggattaagatataatctaaaaataaaacctggacagtttgttactctttttattgagatggagtcttactctgttgctcaggctagagtgcaatggtttgatcacaactcactgcagcctcaatcacctgggctcaagtgatccttccacctcagcctctcaagtagctggaactacaggtgcatgccaccacacccagctaatttatttatttatcttatttatttatttatttgagatggagtttcgcccttgttgcccaggctggagtgcaatggtgctatctcggctcaccgcaacctccacctcccgggttcaagcaattctcctgccgccgggcgcagtggctcacgcctgtaatcccagcactttgggaggccgaggcgagtggatcacaaggtcaggagatcgagaccatcccggctaacacggtgaaaccccatctctactagaaatacaaaaaattagctgggcgtggtggcacgcgcctgtagtcccagctactcgggaggctgaggcaggagaatggcgtgaacctgggaggcggagcttgcagtgagccgagatcgcaccactgcactccagcttgggcgacagagcgagacgactctgtctcaaaaaaaaaaaaaagcaattctcctgccttagcctcccaagtagctgggattacaggcatgagccaccatgcctggctaattttgtatttttcagtagagacgggatttctccacattggtcaggctggtcttgaactcctgacctcaggtgatccgcctacctctgcctcccaaagtgctgggattacaggcctgagccaccacgcctggcctaatttatttttttagagacgaggtttagctatattgcccaagctggttttgaaaaactgggctcaagagatcttcctgccttggcttctcaaagtgctgggattacaggtgtaagccaccatgcctggccagtttattactcataaaataggggaaattagcacgaattatacatgcgtcctagtctagtccccagccaaaactttccccctgaggtttattagatctgagagaaaataggaaagggaacaacttcctccctaaatcgatgttgttaaaggccaaggccatgcaccatctaagccattttgaggaccagtgcttctcattggccacctggagacaccttgtaggacagtaaagaagtcagttatgggccgggtgcagtggctcacgcctgtaatcccagcactttgggaggccgaggcgggggaatcacgaggtcaggagattgagaccatcctggctaacacggtgaaacaccgtctctactaaaaaatataaaaatttagccgggtatggtggcaggcgcctgtagtcccagctactcgggaggctgaggcaggagaatggcgtgaatccgggaggcagtgcttgcagtgagccaagattgtgccactgcactccagcctgggcgacagagcgagactcagtctaaaaaaaaaaaagtcagttatggctggtcgcagtggctcacacctgtaatcccagcactttgggaggccaaggcaggtggattacgaggtcaggagtttgagaccagcctggccaatatggtgaaaccccgtctctactaaaaatacaaaaattagccaggcatggtggcacgcacctgtaatcgcaggtactggggaggctggggcagaagaatcgcttgaacccaggaggcagagtttgcagtgagccaagattatgcccctgcactccagcctgggcaacagaatgagactccatctcaaaaaaaaaaaaaaaaaaaaagaagccagttatgctaggagggagaagcagacgtgaaagggtggcaaagtcaggcatcaaagggggtcacaggagccagggtacagaaactgcagccacaggggaccctaaagctccagggagccaaacctcttccctactcccaccccaccccaacccacccccatcccaaggtccctgagccccagtcctgggtgagagaaatcatgaaagtggttaaggattaaggtcttgggccctggagctagatggcctagatccaaatccagactcaggtacctgttggcacagtggcctgggtttgttatttcaccttctgtgctcaattaccctctctgtaaaatgtggttaacaacagcacctagctcataaggttgttatacagtttcattgagctaatctaggtgaggtgattagaatagtacctggcacagagtaagtctttaaaagtgctgttttgttagtctttaacttgttataaaataacccctccatgactgatttacttatatctacaataaataaattgacacctacttaggtgagcccaagagaatctcttctctgcagacaaaagtgcttgcccagacttgaggtgacatagtttgcccaggttaggtacaggcagagggtgactgggtgagaattttaatccagactttcagcccttacggactccaaaattcctgactttttttttttttttttttagacagagttttgctcgttgccaaggctggagtgcagtagcatgatctcagctcactgcaacctctgcctccagggttcaagtgattcttttgccctagcctcctgagtagctgtgattacaggcgcgcaccaccatgcctggctaattttttttatttttagtagaaatggggtttcaccatgttggccaggctggtcttgaactcctgacctcacgtgatccatctgcctcggcctcccaaagtgctgggattacaggcgtgagccaccgggcctggcttttttttttttttttttttgagacagggtctcactctgtcacccaggctggagtgcggtactgtgatcttggctcactgtaacctccacctcccgggctcaagcaatcccctgatctcagcctcccaagtagctgagactacaggtgcttgcccccacacccagttgattttttttttttttttagagacagagtcttgctctgttgcccaggctggagtgcagtggcgcgatctcggctcactgcaacctccacctcccgggttctagcaattctcctgcctcaggctcccaagtagctgggattacaggtgcacaccgtcacacccggccaattttttgtagagacagggtttcactgtgttgcccaggctggtctcgaactcctgagctcaggcaatccaccagcctcagcctcccaaagtgctaggattacagcactttgggcgtttacagcactttcagccaccgcgccaggcctgatttttatatttttagtagagatggggttttgccatgttgactaggctggtcttgaactcttgactcaagcaatccacccaccttggcttcccaaagtgttgggattataggcataaacctggccaaaacccctgatttttatcccatggacccatggaatgttgcctgccctgtattttttttttttttttgagacagggtcttgctgtgttccccaggctggagtgtagtggtgtgatcacagctcatagcagcttctacctcttaggctcaagtgatcctcccacctcagcctccctgagtagctgggaccataggtgaatgccaccatgcccagctactttttttttttttttttttttcctgtaaagacaaggtctggttatgttgcccaggctggtctcaaactcctgggctcaatcctcccacctcagcttcccaaagtgctgggattacaggcataaaccactgcacctgggccctgcctcatattttaaggggtctactttcactcctgagtttcagctcatgagctgaatgaatgagtgatttggttcatctctgctgagattctgcccttccatgcagggaaccagcctggccccaggtaggggggaaatgtcctttacaaactgcccaggggcttcaaagttgggacccattcttggattttttttggtttttctttgagatgaagtttcgctcttgttgcccaggctggagtgcaatggcctgatctggattcactgcaacctccacctcctgggtttgagcgattctcctgtctcagcctcctgagtagctgggattataggggcctgccacgacaccaggctaattttttgtatgtttagtagagataaggtttctccatgttgtccaggctggtcttgaactcctgacctcaggtgatccacccgcctcggcttcccaaagtgctgggaatatagacatgagccaccgcacccggcctttcttggatgttaaaaccaaggtttgtcctaaagattgcacagctttctggagccagggctggggattgttggggcagtgaagcacgtctaaattcttctctactttgcaagtgttgacagcactcttttatatccttttctctaaatcagaaacagagcagaaactagagccatctcgtcctgcctcttcctatcatagaaaggagatggagggaggcctagagagagaaggagaagcttatgcccccagtcccgcagcaagtcagaggcggacaagacccctcttccctgaagcccctgcagcctctctgcccctctgctgctggaataggatgcagcatctgcatgatgtttgctctgtgccaagcactgggctaggaacaaggcctgtgcttttccaagtgtggtcccctgactagcagcaccaaaatcacctgggaacctgttagaaatgcaaattctcaggcccgccccagacctcctgaatcagaaacatgaagggggctgggcgcgttggctcacgcctgtagtcctaacactttgggaggccgaggtgggcgcatcacggggtcaggagattgagaccatcctggctaacacggtgaaactccgtctctactaaaaatacaaaaaagtagctgggcgtggtggcgggcgcctgtagtcccagctactcggaaggctgaggcaggagaatggtgtgaacccgggaggcggaacttgtagtgagccaagatcgcgccactgcactccagcctgggcaacagagcaagactccatctcaaaaaaaaaaaaaaaaaaaaaaaaaaaagaaacatgaatggagtggagacagcatctgttttcacaatccttccccaaggttcaaatgtggcatggtcaagtttgagaaccactgctccaagccatagtaggctcagtcccggtgtatctgagtggctaaaattgtggaacctggagtcagagagaactaggtgcaaacctgcctccattgctaactctgtgactcaggtaagctattgtctttgagctttagttctgtcagtgataaaatggccataataatagtgcccataaggttgttgtgaggactacatgagacagcacaaagcctggggcgtggtaagcactgctggggtagccattattagctagctgagtgattattttttatttttttgagacagtcttgctctgttgcccaggctggagtgcagtggcacgatcttggctcactgcaacctctgcctcctgggttcaagcaattttcctgcctcagcctcccgagcagctgggattacaagcgtgcagcaccacgcccgtatttttagtagagatgaggtttcaccatgttggccaggctagtctcgaactcctgacctcatgtgatccacctgccttggtctcccaaagtgctgggaatgcaggcgtgagccaccgcgccgacctcctctctacaatttttaatgtcagtactattttttacccccaccttttcacattaaaaaatgtggtaaaatatacataacatagaatttaccattgtagccacttttaagtgttaattcagtggtattaattacactcgcaatgtagtacaacagtcaccactattgtactataccacattgtactacattgtgaatgtgaaatgtgttgttctacattgtgaaagtttttccaaaactttttttttctttttgagactgggtctcactctgttctgtcacccaggctggagcgtgatcatggctcactgcaccctcaacctccctgggctcaggtgaccctcccacctcagcctcccaagtagctgggactacacgcacacatcaccacacccaactaatttctgtggtttttttttttttttttttttccacgctgcccaggtcttgaactcctgggctcaagcaatccacctgcatcggcctcccaaagtgctaggattacaagagtgagccaccacgcccagccttcaaaacattatcatcacccaaaacagaaactctgtaccattaaacagtaattccacacccccctccaatattaccacatttttatgatgaggaaaacggaggcacagagaggctcggtaaaacaatcaatgttacacagctagctaagcataggggtcaggactcagactaggctatttggctccagagcttgctttctgaatcactgtcttacattttttttcttttcttttttttttttcagacagagtctcactctgtcccctaggctggagtgcagtggtgcgatcttggctcactgcaacctccgcctcctgggttcaagagattcttgtgcctcagcctcctgagtagctgggattacaggtggctactaccatgcccgcctaatttttgtatttttagtacagacggggtttcgccacatgggccaggctgatctccaactcctgaactcaggtgatctgcccacctcagcctcccaaggtgctgggattacaggcatgagccgccatgcctagcagattttttttcttaaatctaaagcttttattcttgtttatttatttatttacttatttatttactctgtcgcccaggctggagtgcagtggcatgatctcggctcactgcaacctctgcctcccaggttcaagctattcttctgcctcagcctcagctttgcaaacctagcccaagtagctgggtttacaaacatgtgccatcacgcccgactaatttttatatttttgctagagatggggtttcaccatgttggacaggctggtcttgaactcctggcctcaagtgatctgcccacctcagcctcccagagtgctgggattacaggcatgagccaccgcgcctggcctgaattttgaggtttttatctgcttgggccatgggtgcaggctccaattactccaaaggggctgatctatctgccatgccttgtggggtctggtgggagctggagggccacaggggtcctgccctgtagagccactttgtttttcctccatgagatccacaatcttgggagccctgaggatgttcctccaaatgggcagactatgcccagccaccagagctggagagcaggattctctctccttccacttataaagggacagcactgaaacaaacatggcctctggagtcacatgagactggactcgaaacctagccttggacaggttgctattccaattgtttcccaaactgaagttacagataccaccacctaccttgcagagttgttggtaagagtaaatggcagcctagaactagcagggcctagatgagagttagttcccttcctaacttgaatatcaccttttccttaatgccttcccagttcaatgtttgctccctcctcacacctttatacagcatcctgtggagaccgatcgaattgcctagtgctgctgcttttccctgctggtttgtaaattcaagttcagagactctttctaaactctgacacacatcaagggctgggtgtgctgacactgacacagtcccagtccattgcttactggctacgtaatctttggtaatttgacccatctctgcctccatttcctcatctgaaaagtagagaattggattctccacttcataggattgctgggaggttgaaatgggctaatataggtggtgcacttaaaaatggagctgacatatagtagaagtacttggtattatatgatcccatgatataataagtccccttctctaaatcatttcttcacctaatgctgcctcacacctggggaagcgaacaaggcaccactaaaagccaatccactgatctcggcatcctatttattctccttttagaaggcttggccaggcacggtggctcacacctgtaatcccagcactttgggaggctgaggcaggattgcttgaacttaggagtttgagatcagcctaggtaacatgccaaaaccctgtgtctacaaaaattaaaaactagccaggggtggtggtacatgcctataatcccagctactggggaggctgaggtgggaggactgcttgagcccaggagatcgaggctgcagtgagctgtgacagctccactgcactccagcttgggccttgtgtgaaaaaaaaaacaaaaagaaaaaagaataaagaaatcttgagtaaaacttggtagtctcccttcttattctctatcactgctatcatctaaatttccaggaacctcctgggccacttctaaccgctagatggccaagctacagagtgattatttccttaggcaagcaaacatcccagccctctaatacggtatttcctggggctggaatatcaacaggaagttatgtgaggaagagctctgccaaaacactcattccaaggaagggactggtaaagtgacaaatttgcccaatcctgtacaacatcctgcatcctccacatgtggccctgttgcacatctaatccacaggcaggtcactcgctgctgactctattcttctctgggctcctgggacgtataaatatgactctatgtaagaaaaccagaggctgggcgcagtttgctcatgcctgtaatcccagcactttgggaggccgaggcgggcggatcacgagttcaggagttccagaccagcctggccaacatggtgaaaccctgactctactaaaaccacaaaaattagccgggcgcggtggcgggcgcctatactcctagctactcgggaggctgaggcaggaaaattgcttgaacccgggaggcggaggttgcagtgagccgagatcgcgccactgcactccagcctgggtgacagagcaagactccgtctctagagaaaaaaagaaaaccagacagattaaaaagttgcacttacaaagcagttggggcatttattgacatttaaacaagggaggagatcctgaacactagtctcgctcagtttataaaaacttgaggccaaactctccatcatctgtacacagcttaaccacggccaggagcaagaattcgagttaaacgaattgaaccagtccaaccacaagacgataaagggaaacagggcgtggggatttccagtttttccttttacattacaaagtttccaacacaagaagccaacaataccccagtgctgcaccaagttacttcccactgtttcccaaggcacagtcaattaataatcagtagtccaagttctaagaacattccctggaaaacaaggacgcacctcccgtggctctatgcatggcctgccactgatgaatcaaattcttaagaacctacgaccgtctgatacccttgaggagagcaccctcatagaatctccagcatcaggcctcagttttcccatctgtaaaagacagccatgcaaagtgggagatccgctaggcttccagatcgaagtcatcgcgctcctcattgtactctagcacgtgccgcttgatcttggacgagtccacccaagtgacaaagtcctccatgctgcgcgtgacaaggaaggcggggtcggtaaccacgtcagggcccacgcgtacgtgcccttgctccacaaaggccacggcagcctgaaggtgctgcgccatgcgcagcttgaggagcacggtggggaggcggcggcggcagaaggacgaggccgtgacgaagtcgcagagctccagcgaaccgcgcgtgggcaccaagccgagagcatacagcttgtccagcagcgcggccgaagcgcgcacgcggaactggtcgcgttcgggcaggtcgcgcaggcgccgcgccagctcacgcacggcacggctcagctggttgtagcgcgtgtagtcctcccgccgctgcagccggtaacgccgcagcacgcgcagctcgtgcaggttgtggtcggtgacctcccagttcaggaagtccacctgcttcagcagcttctgctcgtggaacttaagcttccgcaccatgatggcggcagccgcagccgcaggacccgaagctgagagcgcgttctggcatccgcgcgatttccgccgcggcgccccaagacctggacggcctgggaccctgggccaatgaaagaaagacttaaagtcacgccctcacttcccattggccagggtgggaccacgcctctgcactgggatctcgcgtttcttcttttcttcgcgtttgcgagggagggggtagaagcaccggaggtgggtggttgggagcgggtccctaggcggttccgcgcggtttttagtagccaagactgtatccctttctgcggcaatcatttcctcctagacttctgtcctttggggactttcagagtctcccccgcaagagctgaagaggccatttctggggaagaggggtgactgcggcttgttgattgggtttactgtgctaacttgcactgggctcctgccatgccttgggggagcttgccggagccggctctcctggggctgacctggtagtccccgccgcccgccagcgtcaggtccttcacctggcatgcagagcgatctctcattgtcaagttgggataggtggcaccgaacccatgaaatactgattggctgcttcctaggcccacagaaaagggatctataagggagtcgcctggaaatctgtattattaactaaagtgtcagatgattcataaaacccagcaagtttgagaaacttggactataactacaagtccaaaccctttagtctgtgctcaaatgaattatcctgacatgaatttctggccaccaagcattgagttaacaaatttaatgctgtttccgctagttgcatctgtaagttacatctgagtatagcgctgcagacctaacccctttttgcccgggcatttgacgccacctagcttctcactgatcatttttgttttgtatgcttttcattgtcttttacaatacaatatttgagggttgggcgcggtggcacatgcctgtaatcccagcactttgggaggctgaggtgggaggatcatttgaggccaggagttcaagaccaacctaggcaaaaaaaaaaagaaaaaagaagcgagatcccacctctgtaaaaaatcttaaagaattagccaagcatggtggtgcgcacctgtagtcctgactacctgggaggctgagggggaaggatcatttgagcccaggacttgtaggctgcattgagctacaatggtgccaccgcaccccagcttgcacaacagagccagaccctgtctcaaaaagatatatatatatatataaaatattcgatatctggaaaataatataatatgtaaattataaagtataataaatactcataaacttagccagtttaagaaaacatcaccaggctaggcatggtggctcatgcctgtaatcccaacactgggaggccaaggtgggaggatcactggaagccaggagttcaagaccagcctgggcaacatagtaagactcagtccctatggacaaaaaaaaaaaaaaaaaattagccaggcatggtggcagcacctatagtcccagctactggtgagggtttcggggtaagaggggggaggatcccttgaagccggaagttcaaggatgcagtgagccatgatcacactactgcactccagcttgggcaacagaacaacatcctgtctctaaaacaaacagaaagctaatacagattgtttgcttttttaatctaattgattttttctttttttttttttggagatcgagtcttgctctctcgcccaggctggagtgcagtggtgtgatcttggctcactgcaacctccgcctcctgggttcaagctattctcctgcctcagcctcctgagtagctgggactgcaggcacctgccaccacacctggctaattttttgtatttttagtagagacgaggtttcaccgtgttagccaggatggtctccatctcctgaccttgtgatccacccactttggcctcccaaagtgctgggattacaggcatgagccactgcacccagccccagagtaggtcttattgagaaggtgatattttataggggttaagccatgtgtggatatctagggggagaacatttcaggaagaggaaacagtggaaatgccttaaggcaggaatgtgcctggcatgtcagaagagtaagaaagctatcttggctggagcagagtgggcaaggaggagaggaagaggttaaagagcttgtagtcccttgaaaagactttggcttttatgttgagaggcatatacttcggggttttgagcaaaggattgacacttatgttttttgtttgtttttgtttttgagatagggtctcacactgttgcccaggctggagtgcagtggtacgaccaaggctcactgcagcctcaaccttccagcctcaagcaatcctcttgagtagctaggactacaggcacatgccaccatgcccagctaatttttattttttattttattattattattatttgagacagagtcttgcccaggctggagtgcaatggcacgatgtcagctcactgcaacctccgcctctcaggttcaagcaattatccctgcctcagcctctcaagtagctgggattacaggcgcctgccaccacacccagctaatttttgtatttttagtagagacggggttttgccatgttggctaggctggtctcgaacttctgacctcaggtgatccgcccaccctcggcctcccaaagtgctgggattatagacgtgagccactgcacctggctactaatttttaaattttttgtagagatggggtctcactatgttgtcatggctggtgttgaactcctgggctcaagcgatcctgctacctcaggctcccaaagtgctgggattacaagcataagccaccatgcccggctcagaaattcaattttggacatttttggttggaggcatccattagacttctgaggggagatgtcaaggagaaatagatatatgagttaagagtttttttaaaaagggctggagatttaaaaaattgggcattactagaatgagtggtatttgaagtcattcggctggatgagatcatcaaaggagtgcctatggatacaaaagacaagaggacaactctactgtggttactctaacgttaagaattattggaggcttgctgggcgctgtggctcatgcctgtaatcccagcactttgggaggctgaggcaggtggatcatgaggtcaggagatcgagaccagcctggttaacacggtgaaatcccatctctactaaaaatacaaaaagttagccaggcgtggtggcgggcgcctgtaatcccagctacttgggaggctgaggcaggagaattgcttgaacctgggaggcggaggttgcagtgagccgagatcgcaccactgtactccagcctgggtgacagagcaagactgtctcaaaaaagaaaaaaaaaaaagaattattggagagaagaggatgaaccagtgaggtggaagaaataccaggagagtatgttctctccaatgcaaatgaagaaaatgtatccaggaggaaggagtgatcaaccaggtcaaatgctaccaaaaggctaaataagagaaggactgagaataaccattagggtccagcaacaccaaggctattgatgaccttgacaagaatagttcagtggagtgtgggagtaaaagattggccagagggatttaaagagagaacaggagaaaaaaaattggacgcacttagtatagacagctatttcaaggaattttgctgcaaaggtgagcagaggaatggggcaatagctggtggggaaagtggagtcaaaaaaaattttgagatggagtcttgctctgtcgctaggctggagcgcagtggcgggtgcaatctcggctcactgcaacctttgcctcccaggttcaagcgattctcctgcctcagcctcctgagtagctgggactacaggcacacgccaccatgcctagctaatttttgtatttttagtagagacggggtttcaccatgttgcccaggatggtctcgacctcttgacctcgtgatccgcccacctcagcctcccaaagtgctgggattacaggcagtagccaccatgcccggcctcaaaaaaaatcttttttaacatgtgggttgatacttcactcaatagctgcagcttattggttgctttcccagtctattctacctccaaaagctctcccagatttttgtctctccagcctgttacccctgccctatgtcaggccctcatcatcttttgtctgcattcctacagtaatagtccagtgtgtcctgcaggctgccaccagcagagtcagcctgaaaaccactgggcacagttctcccttgctgtttcctttcctaaaggatggaaattggatgcctggatgagggatggatgctgtttcctgtgtatgaatcagggtcccagcaggaaagacagaacacaccccagtgagaataacgtgagaggctgggggtggtggctcatgcttgtaatcccagcactttgagagaccgaggcagaaggattgcttgagcccaggagtttgagatcagcctgggcaacatagtgaaaagccccctatacaaaaatacaaaagttggctggatgtggtggcgggtgcctgtagttccagctacttgggaggctgaggtggggaggatcacctgagcccagggaggttgaagctgcagtgagctgtgattgtgccactgtattccagcctgggcaacagagtgagaccctgtctcaaaaaaaaaaaaaaaaaaaacagaaaagaaaaaaagaataatgtgagacttgactaaagggactgtttccataggaatgggcagggtatagggagatcacaagggttagtgcagtttcctgagactgctaacatggcctgtttcccctaggactgaagaaggtccctggaggggagggaatgggaagatacaggttctggaaatctcagtgaggctgaggagtgagttcctcccaagaacctggaaataagggtggctcctgagagttacaaaaaaacccgtctagaacacatgtgggagtaaatccaaaatggctggtctgtaaatgtgtgactgagtgtttgggaaccaactaaagtctgtcaagggtggtggctgaggacgcctcggggaggttgggctggagggggaccctattgggtgaacagaaatcccaattgtattaagtaaactaataaaggtaaagcgtttactgtagtgtccatcactcagcaagcactaaggaagtagatgcttttttttgctttttttttttttttgtgagacagcgtctcgatctgtcccccaggctggagtataatgacatatacaatggcaccatcttggctcactgcagcctctcactcctggccacctcacctggctgatgctatctttttttttttttttttgagattggagtcttgctctatcaccaggctagagtgcagtggcacaatctcggctcactgcaacctctgcctcctgggttcaagcaattcttctacctcagcctcctgagtagctgggattacaggcatgcgccatcacgcccagctaattttttgtatttttagtagagatggggtttcgccatgttggccaagctggtctcgaactcctgagctcaagtaatccacctgccttggcctcccaaagtgctgggattacaggtgtgagccactgcacccagccctgatgctattgttaaactcagtttggagaaaggctatgtggacagaagatagatcacagggaaggggggggtcctaaaagcacgtggggaaaacgtatattctgtcttagagatgctaggacgaactgtctttagaatgaaggctgccccatgacaggaagcaaggttttaaggttacttgactgagagactcctcataccctttcccctcttgggggttccagactcactgagctaactttctggtaactgggcttcccaaggggtagcccaaactgccttgatctattgatgcagaaattcagttctgcttgacagttttatttctctgtgcaaattgatacctagccttctggggtttgtacataggcctttattctggtcaaatgccagacctgcgaagggagtcggatccactcactgaaccagtgaaactgggttttggagccagaggtctgggaaccatgtccctcaaaacagccaaaggtatccatctttagcagaactaccttgtaccagttaatctgcaataagtgactagggagagaatgaagggaagatctagctagacagggtagacaagactccagggtatagccaggaaagggagtcctcctgaagcctttgcctcatcttaggcacttcctccttcaggaagctttccttgatccttgctctacccaggctggggtaggtaccctcatgtgcacttttcatggcactaactagtcacactgggcagggagcatttgtctacttgtcacaacatatctgagcttttggaaaataaggataatgtcttatttgtctttgtagctcaggggcctggtgcagagtaggtactcagttaatgtttcttgagtgcatgacttggctgaatgaatgactgagacagaatggattgattaaagacaagagagggtggactgtaagccccccaggatagaaaccccgactgccttgtggtgtactactccccagtgcccagcacagtgcctagcagaatcaatgcccaaagtgttcccgatatgctgaccgagggtcagatcccacttgcctcttctcgaagattctctacctgaccacttctctccttgctgccgctggctagcacagaacatccagtccccgctgctgtactaagcaacacggaaccgggtggcacctagacttgttccctgtcgctgcagatgtagagtagtgtctttccctccttccaagctagtcgcccagggcagggtcgccctgtctggctagggtgctgcacccgcagctctcggtatcttaggtcagacgcctggaacgcgcaggccgtttctgttcctccggaaaacaatctctgagctgcgccacgacccgtccctgcggagcaggagtggggaatgggaaggtgggaaggcgagtccgcgactctgctccccaaccccagctggcgcggcggctttccacgcacccccctccccccaccccgatctcccgatcctggctctggcgcggtgctccttgcagccccacgctttgcaaactttcggagttttactccatttgcgtcacggaaaaggcaggaggatgacggagtccaggaagcgaggcagcggcagctggcaagctcccccgccgggcgctccaaccacgggggcgtgaggtgtctcccggcgagggcggacaggcggagggagaggaggggaggtggcggtcccagggaccagccccggaggctctcgggccccctcgttcccgggtcgtttcctccctctcgcctcccggactgagcgccagcgagcgagggcgctggccagctgggaagccgcgcggaggagtaggcgggggctcggctgcagcgccccgggcccgcgggagggcggagctggccgtccctgccccgccgggacgcacggaagtgcagcggagtttgcccgattctccagcctgcttccccctccctcctccctctccccacccctcacctcccctttggcgatcccctccttcctcaggacgccacctcccggaatcgcctttttgttttggagctgccttctcgctggcggagcggagggtctgcgagcgccggggaaggcaggctgggggcgcagcccgccccccactggccgggccccgcagggcggagaggaggacggacggacagacggctggccgcgccatctgctcgccggagctcactctccaaactccaaactgttgagtgtgtgcgtgcacgcgagggtggtgatcgggggtcgtaagtcccgggtgaggaaccggtttctgctggggttacctttggacggggttcctgggattcagagcagggtcagcgtcaggctcagaaactgctgaggaattaggcaaacaaaagagaccactcagcgagtggctagaagtcgcccgacagcctcgtcgcgccccctccttcctccggggttggggctggccacttctggggcggggagagggcgcccgagccggcgggggctccggctgcgcagccggggtcgaagagttggcggcctgttgtgtaagcctcagtccttgttttcccggcctggctcgttgtgaagccggacacatccacccttggactcgattcaggcggctgctgcttttctccttgcccctcttggattttccggatttttgaaaacccagtggcccaggagcaagaggaggaaggaggaaggggcagatctgcagaggaatgtgagagcctcccaaagcgagagccgccaaaagaatctgggagccagagggacagccgagccctgcccgggtttctggaatggtggtttcagagtgagtctcttctattttagaacgttgttccagtggaaagtgtcgaatttttcccctcgcagggcagatttctccaggtcacttgacttttcttctgggagtaggagttaggagagattcccctctaaccccccagaggctgctaagggaggaggagactgtggacatgagccctccctgctcacaagcatatgcccggagacctgatagggcagtttctgggccatggacattgctttgaagagggggagactggacagcatctgtgggtgctgagaccccaccttaggacctgagagattgaactgtgtaagcgccattcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctaggagtggtgggggcagtggcttcctctcaaaccagggtagctttgaggaggatgatgatgatgactgggatgactgggacgacggatgcacagtggtggaggagccacgggctggtgggctgggcaccaacgggcaccctcccctcaacctctcctaccctggtgcctaccccagccagcacatggccttccggcccaagccaccactggagcggcaggacagcctggcatctgccaagcgaggcagtgtggtgggccgtaacctcaaccgtttctcatgctttgtgcgttctggagtggaggccttcatcctgggtgatgtgcccatgatggccaagatcgctgagacatactccattgaaatgggccctcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggtaaggcccagtgcaggcaggaaactcgtcctgagtctggctctctgctgggccctggggagatggggatggcctggatagaatggagcaacttgtctttatttctctgtctcaatcattcatttaacaaatgtgttgggctgggcacggtggcttacgcttgtaatctcagcactttgggaggttgaagtaggaggatcacttgggcccaggaggttgagactacagtgagcccgattgtgccactgcactccagcctgggtgacagagtgagaccctgtctctaaaacaaacaaacaaacaaacaaacaaacaaatgtgttgaatatcaactctgtgtctgtggcaaatgtgcttctaggtgcagggatattgttgtgcacaggcccggtctctgtcctcatggagcttgatatttaccttcttgtcagttcattcattttctctgtttgcatctcgtttacccatcatgcatggtgtcatgctgggttctgagaacacatagatgaccaggccccaggccttgcccttgaggagccggtaggcccttgggagacacagacccaacccagataacaagagctcagagtgggggcctgtcttgtgctccttgcaagttaacctccccacctttgcagctttggaagctactctcaccactgtgtattctctttatgagcgtcttgtctgtgtgcaggaagatccctgtccccattttgcagatgaaggagctagtgtccacagaagagtggttgcacagcctgtggcccggctgggactgtcccttcctcctgccacctccccaaggacacgtccatgttggccacttcccaagcctagccatgttttcagttctcatgaccccctctgtgggggagggacaggatgggcctctgcctgttactgctggggctgtccatgaactgccggggaaatgactcatcctgggtcacacaggggcactctggctgggccaggggtgcagaatcaggggtccagggcactgtccacatggcctatccaactcctgcttcccaagcctggcttctcttcttgcctgaggagagagccagtggctgccccagcaggtgcctgagtcctgggcacagctgggagggcagatgtcaggagagaggtgtgatcctccctggggctgcttggtaactcgtctgcagggcgtggagctggctccctggcccttgggccctgaggttagacctggcttggtggggagtttgactctgggtggggccagggggcagacctctgcactgagcctggggaacaggaaacatgtcacccaccaccaccagggagggcctggggtaagctggccttgctttcctttaccaagaggttgacttctataacttctccagctcccagcctcctttctccccttgctatatcctcttcctcttcctttctttctgtttttttttttttttctctcatctctacctttcttcctcctcctctgaactccaggaaacacaaacctgagtgctagtcttggctctgcccctagattgctgtgcgtccccggggagtgcctttgcccctctgggccttagtttcctgatctgtaaaacaagggaatggggtcccagtgagccatcaggccttcaagggagtgggtgggaagggactcctggggagggtatggctcagaaacagaatgacaccttagctctggctctgagcactggggcaggagtagggcaggggaggtggccaggcctgctgggggcccactggggcaggtgtctccctgagcacaagtgggaaggctggttcaaccagctccttagatggcttgttcctgtgcaggcagcaggagggggaatgcaatgattaaacagatgctcccatgcagtggctggggaccccccacccagagcagagctgaggacattagggcagccccacacctaggaaggacaccagggcctcccaggctggggggaagccagaccagcctttctgaccctgggcagagagacagagctgagataggccatttctgagtttctacttgaggtgtttctaagagtcagaggccactgtcctctgtgctggtgcatttgacctgaaacagaggccagcccactgccttccctccccgggaggacccctcccaatgggccaagccctctctggcttactctaagttctgggctctgcactgctcctcccaggcctgtggtgtggggcaagttagggagggggtactgagacagaactggacaggctttggggaccacagcccaatgggagtgataaggagggggtcctaatgctggccttaggggtggagcccttctcaaagaaaagagaagaacagttgggtcctgggcccccaggattctgtccagcctgtctggacatctgaatgggtggtgagtgtgtgggaggaaggacagtggaggcctaggtgggagtcaggagaccaggatttggacaaactttgcatctgacatgactttgggagagatttctcccctcagtctctaggtgagtaaaatgggacccgagggtcttcatttccttaggagggctccatgtcatgtgaaacttacattaaacaaatttgtatgcttttcagaaaaataataaaatgaaataaaatgggacataaaccctggctggagctgagaggagcctggtcctcccacgggcctagtccctgtagcccaatccaggggtctcctaagagaagggtaaccatataattaaccagggcagtttggggcataaaagggggccctagcaatagtgatcccgggacaacaggggaaagtaactgtccagggcaagctgggacgtatggacccccaacttgacagccagcaagagcggggctggtcctaaggctcacgacaggtcaggagggcgatgtggtcacttccgttttacagacgaggtgcagcgatgcagatgagcctcagagcaggagctggagtccagtgtgtctggctccgcagcccaggctgtttccactgtgccctcccagatgggggaggggatccccagggatggagagctgagccagaaggcgaaagaggagggaggaaggcttgggtgctccttcactggtcctgtgggctagagagaggcccaggaccacagagcttccatggaggggccatagggacagcgtggccaaggcaaagtggcgactgtagggacaagttcttgcctgggggatgggtgggttcagcctctgggttctgagccatcatctagccttccctctaccgctcatcctgtaatctcagcactttgggaggccgaagtgggcggatcacaggagttcgacaccagcctggctaacatagtgaaaccctgtctctactaaaaatacaaaaaaatagccaggcatggtggcaggtgcctgtaatcccagctacttggaaggctgaggcagaagaattgcttgaacccagcaggcggaggttgcagtgagccgagatcaagccactgcactccagcttgggcagcagaacaagactccatctcaaattaaaaaaaaaaaaaaaaaagaaaagaaaagcagttttcaagccataacatgtagcatctggagcttctattgtatctcaggtgcgctcctttgaactgtgtacatattagttcagttaagcctcaactatactatagggcaggtactattattatcccattttacagatgtggaaactccttaaagcactataccgtgtgagaggttgtcaacagcatcacatctagtgcaacctgtcccactgggcagtggggagacctggagcccaggcaagagcagtggcttgctggagaggatacagctaggactaggactcagacctcctgctccctcctgcccccaacctggggtggatgttaactgtctccaagaggcaggggcaagatggattgaggtgggagcttagggaatatccctgggacttgcagctggtgggctccaaccctcctttctgcatttttgggacccagcctgtaagaggagtgctgaggcaggaggtccccctgggtcctcagctctcaggttaagtcttaagtagaatgtcggggggatgctggacaggcctgagccctgactcccagcctgtggggtggggtgcattagcattagctggtcctggccccagagctgagtcacagggtggaggggtaacggagaacagggtggggcctctgtttccccccgacctctgcagcctttgctccccatccctggcctcctgcctgtctgtggatacctaaccattgcaatgggttcattcttactctttgggctcctcatcagcaaaagaggcctttccttcctctaaggccatggacaggaaaagtctatagatgcacttccactgtgccaactttctcggcaggtggaatccaggctagttcagtatctcctctttagctaggttccttctgcggaagtttaactccagtttcttcaccctgctgttttctacctttcttcttacggttcttcctactccttgggaccttcttgaatccctgtgtccaacgtctgggggccccacacatatgcctgaaggacctggcatgggctccctgcagcagaagtggtgtccgacccccagctgtggaggaccaggcaggaaagaggctgggagtcctgggcaagttcctgcccctcagggccttggcctcctctgtacagtagtaggatggaggtggaatcgagggttggacacctgatcttttgggcctttctagctctgaagtctcttactgggtcctatcctgggccttggggtgatcccccttctgctgcccagggctgggctgttgagatggtgcaggaggtggtccagggaaggtggcagaaggactgagtgggctgggagctggggaatgcagatttcttttgggcgctgtgtgagcagccctggagactctctgaacttgagtctgtttgcctgaaatgctactattagccgattagccatgcacttatcaactaacatggatgttgccccttctaaaggcatccagagttattcccagcatgtagagccctgggcctgatatacagtaagtgctcaatgaatgcatttagaatgcactggacaatttgagccagggagtgaagagaatattatctagacagccctcaagagccctccttaaaggagaagtgggaaagcatgggtattgagcatgctatctgtgtgtagtgggtgcgtttgcagtgctcaggggtgtgctgtcctctatgccaacccttccctgctcctaatcttctttgtatggtggattctctgcagccctcggcgactgagtgccaggcacaggcaaacttccttctcttcccagcaactgtccccactggcttaaaggcagaattcgtcaagtcccttttaattcagaactgaaattcattcaccagctgcttgttcattcattcagattcttctaaattgggtcctctgcccaggttcatctccaccccccatctgtcacctggttattacacaacctcctcgagttccctgggggctgggatgaggagggaacagggcgtgcatgtctgggagatacaccaggtggcctttgaagagttgttttagaatcagcagtgtgatgggggtgggggtggggagccagggcacaggtgacatgggagagacattctgtcaggggaactgggagaggctccagtgtagaagtggcacctgatcggggccatgaattatgaataggaatccagggggcagaggtaggaaggtaggaaagagccaggtgagtttgacgaacatgggggtcagtgtggaatgcgtgcaggggccaactcccagaggtgagggccccccaggccaggcagattggtgtggaccttgatctgtaggtagtggagagctaggaaaggtgcccagcttgggatacctctttagatgctgcagagaacctgtcagaggctggggcggagggcagggagacgtggcggggctgttgtagcagtccagtgagggacagggttgaatcagttcagcaggcctatatcaggatctgctgtgggccaggccttgttctgggtaccagagacacagagaggttgaggacaggctctatcctcattgaattcatagtccatcaagcagggctgtgactggtcacatgtgggctactggtggcactgcacatttggagagaagatgatgtgcttggtttaggaggtgctgagggtgatggcttgggtaacatcctggcagagacacccaggtggctggaatgtgggtctggggctcaggaatgacgtccgagttgagctgatgagggtgctgtctgccctcaagggtacagggagcacatggagatcagagccctcacacgctgtcctctgctctgcctatgccaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagataacacaagcatgactttttctgtttggatcccagaaaggcggagggcaggagaaggatagagccctaattgctcctgagagccattggatgagattctgaggtcgtggtgggcacaaattttccacagaacctcaaaagttcaggggagggctatgctggtggaaggtgccagcaggcaggaggagctagaggcggctgtggacccctgggtggatccatccctccctagaacgcactcttgtctctaaaacaggtggagtgctgcccaggggactggctgtactgccttgtgatctggggctgagggttgtatgaggaagggacaggacgctgtgccctaggacaattaatagatggtggctcctctccccaaggagccatgccctggccttgcccttgaaaagccctagtccaggggagggaagtgggggactcagaagctgtgtctcttccccaaaccgtcctgggtacccagccctgcggaggctcccacattggaaactgaagaggacgctggctgttgggggtgccctgatcaggatgagcggaccttgctcttggatctgttcatccacagatgagaggagggtactggttgagacttggctctcctttggaggcaatggggacttggtggagggagggcttccagggtcaaggccgtcagggaaggttggctagaccagggaccagggagcttgtgcaggaagatggagaagggccagcaggtgcggtgggggaaggggcgggcaggactccctgttcagggcatagcgtcctcagaggaacttctggaatgggtccccctggcccttggtcaacattaggtcagatttgggactttctgaggaattttcccctctctccaccctgccccattttctaacccatccgaggaacttcccgcccttaacctcttctcagctctgccatccatgtagccatctgcagaaggggctctgagcagtgggggctgggccaggccgaggcagggctggtgggaatgctcctcctaacccatggtgcctggaaagtcccctgctcatgcttcctgctctgggaacagtgttgtcctctgtgtgccttccttgagaggggaccacctcccaggccttccatcctcagggtgaggccatcagtctgatacttttctcaggagggacttggatccaggagaagcatcaggaagtggagtcttgggataatgccaggcctgctcctggtatcctgaggtctctgggctggggcaggtgtgtgtgtggcagggagggaggctgtcctggccctcctctctcttttctttctgcctctatgggggtgggggtattgggggaacttggggccgttctggggtagctaagcccctttcagcaggagattgggggaccagtgttgggggcatcctggtgatggccgattcctgcctcgtcacatgccaggcagatgttcccgactcggctggacccagctgcctcgtttcctcccttactttgctctgagggggtggaaaacaaggcttctctttctgccctggacagctaccagcacccggggtaggggatcccctggtcaccagtcttggcccagtacaggaaaaggaatccgctttgtggccacagatgggggctggggatggaagcagacctcagatcctgcatctcttcacccgctggacacaggagggctatgaaccactgtgccgtggctgcaccactggctggagcagagccaggcctgggagaggcaggtggccccatcggcccctgctctgcaccacccctcccagatgacagagccatatgtcttccacgtgtctacacactcacagactcacgaatgtaatcgctcagtctcacaacaagcacacgcagtcacacacctgcccacaggcacatacgccacataagcatgcctgtatgctcacacagtcatactgccacacgctattacacattcacagccacagccacacatgccttgccatccattcaaagcaccagtggctactttgtcagacacagccacaccacagtcctatgcacatggtcatagcctcacacagtgacacatactcgggcacacaccgccacaaagccatgcttgcacagagcaaaggtgtcataagcatctctgtgcctggactgcacctgcatgacctcccagggtccccacctcatcagagattaaggagagctttgcttggagacaccacccctggagggggtgtctccaagggggagtagagccagtcacaagcaccacatacaggcacacagcctgaggtctagggatgcaattgggatgactggataccaccaagttcagctccttattgaacagatgggcgcctgaggcccagggagcagtggtggctggccttatcacccagcagggcaggggatactctggggccagagcctggctctgggcagactctgtttcctggccctgccctcccctgggccaatcctctgggccaggctgcctctgaaggcccctggctgaaccgatccagcagagctccaggcagctcccttctcaagctagagctgagctgcagtggccacgggagccggagccaggatgcggtgggcagggcctaggcctgggcgggaggaacattcctgcaccatctcctccccaagcatgtgaggacccagcccgccctgcccgcctgcccgctgactcaggcctccaggagccaagcctgctcagctcccccacccaccctaacctgcttccccactagttcggctctggttcccctctccactggctggggcaggagaagacggtgagccctggtaggaagaccatggggaaaaatcaaacctcaccaccccccgacatagctcagaagggctgattgtgaaacccagctctgttcaacatagttgaacacaaactttttttttcttttggtttggttttgttttgttggtcaaaccccagtgcagtgcagtctgtttaagaagtagtgtcgcatagctgtggcctggatctgctcagcagccccagtaggcagcatttattccctttcgcaacaaagagactgagacttggccagagggaagatgggacctgcctaggttcacacagggaatctctggcggggctggactcaaacccagctccctgccatcactccttagagtcacactgatgaactcatttagggccaaaggaagaaggggaggcagatttcccctctagatgagtgaagggataggaggctggtgaacccaacggctgaaatgtgaagggtgagagggtagggtgagtccccccagccctgagggatgaagggtctgaagatggcactgcacggtgacagctgcagtgactcaggagctccgtttacaaaggaacatgagtgaggaacataacttaatttttttttatatctgacctgaatttctgttttcctcccccattccccacatggtagaagtgtaatctcacatcaatttggggaccctttctttccccagggatgtgtagaacttttggggatggcacatttgaagaccttagggagctttgcattttaaaggctgaatcccacactctatcatacatattaatatttacctgcattccacattaaagggttcagtttatgacttgtgtcctgtcttgtagatacttaattaaacggtattaattttgattttgcccctttctgttggtgctctgctctcttccctcctccccgccctgcccacccagcagcacacattgttacgggttgcttcttgcagaactcctggacctggatgctgccattgggcctgcgatgcccgccatggtcctggtcagcattgggccctccgatcatcttgccctgcctcctgcctttcccctgcatgctcccttgatgcccatcctgagtctctgtgtgtctggctcttctctgctcttgggcactcagggctccttccatttgccctgtactaaggggctgatagaggtcctttctgtggcctgtggccccctctggggcctgtggtcatcattccacagctcccacttcgcagtcaagcacagggagctctggggtgccgcttagacaccccatgccaccctgtttcttctgggatctggctcctttcttggggttctacctgggatgggggtatgagtcccactgcttcggaatctcccagcctctggggattctactatctcccagtgcaggcagcactgtgatgggcactggatggtcgttattttacaaccaccccatgtgcaagagattattactgtcattttacacaccaggaaatggggtccagcgaggggggtgctggagtagccaaggctggtgcgaaacagtacccaggcctgggctacctgtgctgagaggcagatggccagtgccagggccgggtgttacaggctggcggaagcctggaggcacctggagcctcttctgggctgacccgcaccccttgctgccatttggcaggagtgctctggggttggagcaagggagtatgaggctcctccatatagccctgctgcccccagatagcagcagcccccaccccaaccccattcctttccctctaccgcccagaggcaagtgcagatcctgaccagtgtggccttgctgtagggatgtttcttaactgcttcatgcttctgtttctccactgagaggggagttccagatggctgttaggagggtgacgtgagcagaacacatcatctgggcagtgcctgcacagccagcgccactgaggagcaggtggggtcatcagcctgagtagagctggagcagccctggggagagagagtgctaagaatattggtacccccacttcataggttggaaaactgactgggcaagccctttaaagccacacagtgggtagatggcagagctgggcctggaaccaggcccccaaccacccccagacctttagccttgccccgtgttgccacactgcctccgtggggagcagattccttggggtccttggctgtcattgtacttgtcatccagggcaggaggggtccgctgggccactaacagttacatataccaacatatacaggatagcacagcccaaggttaagagccccagtctcatacccaatgcctcccataaacagattcactgggtgacctcatgtaaggtcatcattcagtctcagtttcctccagcatcactcaagcgatggttaccacgattatacatggccacgagttcacgagtgtggatgctgtcactgcctcaggccggctgcatcctcaaagccacacaggtcagccaggttgggtgggcctgagtgcacaagagctaccattttttcagtcctctgtgctggtaccacgactgtttggaaggtaggaactcctattgtcaacattttccagcagacggtggctcagaggcattgagtcactgcgagattgcgcacctgccccatggcaggcctgggctgaggtctgcctgcacttggagccgtgcccttcccaccgcaccaggctgccttttgaaggctggggggctaggcgtggcgggggccactgtcctgctgcagtgtgaacacaagggtgctgggaatcgaagggaatggggagggagaggggcaggtggccgtgaggggcaggtggtgggtattgggtggaggtggctgtgttccttcaagtcagtgggtgaaaggtcagagggcttggcccacagagagtgctgagcaaatatttgtggagagataattttctggaaggcccgaggctggggcatggggtcaggttctggctgtggaggagggggctagacaggtgaggccatgggcagcgagctgggggcaggagcaggactctggtctctgagaagaactcaggagcctccttactccaggagacaatatgggggcagtgagagctggcaggaaaatgtcgagactcggggaagggggcttgtgagtgctgagccaaaaagggctctggccctggggctgggctggggtgtcaggtggggcaggcagaggtggggtgatggagtctctgcctgcatctggtacctggagtgtgtggacccacctgtgtggttgcaggtgcctgtcagtgtgtgcacctgtacctacctgcgtgtatgtccctgtggtggcgctggcgcttggtatctatagtcattcagccacacgagcttttccctgtgtttctcagcctggaaaagacaattcctctccccctgaacctcaggcccaccttgggctcatgcctggctcctctctttctctcattccacatcccatccacaagcacagccttgttagtccatcaaatgagaccccaaatgtaatgctctcaccacctgggtccaaaccactaggcttacctggactattgcagcagcctccaagctgcccttctgctgcctctcctgctccttaatggtctaacaggggccagagtgatcttttacaaaaacatgtgaatgtatatatatatatttatacatatacacacacgtgcatatacacatatataaaaatatgtatttttttttagagacagggtcttgctatattgtccagtctggtctcaaactcctggcctcaagtgattctcctgcctcaggttcctgcatagctgggattataggcataagccactgtgcacagctcagagtgaacttttaaaaccatattctttttttttttttaaagacgatgtctcactgtgttgcccaggctggagtgcaatggtttgatcttggctcactgcaacctccgcctcctgggttcaagcgattcttctgcctcagcctcccgagtagctgggattacaggcattcaccaccttgcctggctaatttttttttgtatttttagtagagatggggtttcaccatgttggccaggctagttttgaactcctgacctcaagtaattcacccgcctcggcctcccaaagtgctgggattacaggtgtgagtaccacacccagccttaaaaccatattctaaatcaaatcatgtctctcccctgctttcaacctcagggcttcctgccatacttaggaaagtttccaaactcctagcacaacccacaaggctccttcctggtcttgcgtcagacccctctgcacttcggtcatggaactccagactcattggtcggctggtttcctcttctgcgtttgctcagacctcagggcctttgcatttgctctcttctctgtcttgcatgttcttcctcccagataaacatgtggttctcacctcaattaattcagatctctacataaatgtcacctccttggagaaggcttccctgaccctgaaatctaatgaaacttcctcgtccctctgtttccttaccctgccttattttttcttcattttacttattaccagctgccaattataaatgtgtatgtatttagctcttatttatttatttttgtcacccaggctggagtgcattggcgtgatctcggctcactgcaacctctgcctcctgggctcaagcgattctcctgcctcagtctcccaagcaaatacaggcctggcacggaggctcatacccaccactttgggaggctgaagtgggcggatcacctgaggtcaggagtttgagaccagtctagccaacattacaaaaccccatctctactaaaaatacaaaaattagctgagcgtggtggtgcatacctgtaatcccacttactcaagaggctgaggcaggagaatcgcttgagcctgggaggcggaagttacagtgagccaagattgcacaacttcactccagcctgggcaaaggagtgggactatgtctcagaaaaaaagaaaagtttcaaacatacacaaaagtagagaaacgaatataacagaaccccacatgcccacctcttggctccaacaattctcaacactgggtccctattttactcccccacaccctttgccttccggtggactccagcatcacacagtctcatgtgtggatacttcagttcaaaggttatattttaaatgtagctgtttctggtctgtctccctcagtagaaagcagctttctggggagttggtgtctgtctgtcttgctcactgctgtatctccagctccggcacagtgcctggctcccagtaggtgactgaggaggtctgcatggctgtgtctgcaggtctctggggagggcatgtgtgtaggtgctggtttgcacatgtccaccaccgtgtcagcgagtgtctgcacatgcctttatgcgcagctgcatgtggcagtcctgtggatacgtgtgcatgtgtacgttgccacagcagctgatggctaaatgcgtgcctactccctgatgtcatttcccacacccctggggacccaatgactcgttctgggaagtatttccctctttctcagcaagggatggggtgtgaaggggtggaagaggggtgtgcaccagtctgctcagccctctggaggacccagagagccccttcttgaccttccttactagcagggcgccgtgctgtccccaccagtagagcaggcagcctctttcttccctggcattgaaacccagccagttgggccggcatcagctgggtggggtgtggagtgtgtgtgtatgaggcgtggtggtggcccatcctggccagctccaaaggctcctagggtgactgctgtgtaattgggcaactgaggccatttaagctggggacaattgggtgtagacatctggtccagtgccccagcagtgccccctctcccccctgcaagttctgcatcttaaagggctggccctggaaggcgggcagtggcgtaagacctcgctctcagcccagcaccgggttcattccaggggctccttgctgtcgggccaggagctccacagtggcttctcagcctgctctccagggccccttcttaccctggaggccagggtccgcgtcctctggctctgcattgtccttcccacctcccaccctgccttaggctcagctctcctccttcttcagggcccagcccagacagcccctgtgttccaggaggggcctgccccttccacctgggcagtcaggttctttggggctcctccctcttggatccctgaggccaagacctccccaccatgtaggccagatggtccccactcactccacccccaacctcagggagagccttccgaatcagtgaggtgggtgtgcagcaaggaagggcagagtggcactgccagctgctcctacccagaactggatcccttgctgcacacctcacttcactccctgccacagcccagtgaagaatggccctgcgtctctctttgccagatggggaacacatgcattcggccatccaaaagaaggactgagcatttgttcggcacctactatgtgtcgggcactgagatagctgccataaattatgataataacaataacatcagcttctaccatttgtcaagcacctacaacatgccagacccatatgctgggccattcaataggaggaaccatcataacaccaataataagaatggtcggcctggcatggtggcttttgcctgtgatcccagcactttggaaagcagatgcgggcatatcacttgaggtcaggagttcgagaccagcctggccaacatggtgaaaccgtgcctctactaaaaatacaaaaattagccgggcatggtggtatgcgcctgtagtcccagctactcgggaggctgaggcaggagaatcgcttgaacctgggaagcggaggttgcagtgagccgagatcacgccactgcactccagcctgggcggcagagcgagactccgtattttaaaaaaaaaagccggtcacggtgtctcacgcctgtaatcccagccctttgggaggccgaggtgggtggatcacgaggtcaggagatcgagaccatcctggctaacacggcgaaaacccgtctctaccaaaaaacagaaaaaaaaattagccaggcgtggtggcggacgcctgaagtcccagctactcgggaggctgaggcaggagaacggcgtgaatctcggaggcggagcttgcagcgagccgagatcgtgccactgcacatctgcctgggcgacagagtgagactctgtctcaaaacaaaacaaaacgaacaaaaaaaaaacaaaaaaacgaacaacaacaaaaaaaaggccaacatttattgagcatttactgtgtgtgaggggctgttctaagagctttgccttaacactgaccctttggaaagaaaccttggtcagttatactgttttggtagatcttcattcagagagagggcagaagctgggctggggccctctggccagacacatagcatgaatgctggaagggacaggaggagggcttctaggcagaaagcaggcactgagctcccaggcctggctcaatactctctcgaaccagtggtcccttcttgagttagaacaggtgggtggacttgtacaagctcaccaagtggacagtcactgcctctgccctccttccttcagttcatgtgttctgcccccagactctgagcttctcagggcagattagggagcagaggtcctggggccttgaaccttcatggagtccctgggccttgccccagttgcttgtccaggtgcagtactcacaaggcaaccttttagcagggctgactcagaaggggcctttctacctgagtcactgacttccaggagcgctcaggctctgccagcctcgcccacctgcccagcagctctttaggtcaccccagcacaggcgccaccttccccaacaagactcaacaaggctcccctgccgcagtctggttcttgaaggtctctgccctggccagcatgtctggcatccctggcccattgcctggccccgatgcctctccaggtgttgggcatcccactgctgagagacatatctttggcatctggaagtgtttcaagcctctaggaggcctagctctgccggtgaattgctttgtgactatggttgagtcacacctcttctctgggccccctgattgaatgcacggtcgtctgggtgggggagaggtgagggcatccgtggctctgctctgccccttgcccccgaaggttgtgatcaagtgagccctgtgagtggttagcccggctggcacagcgccccatgagcctggatgttctcaggagggctgttgggcagggggaggctgagtgtaagggggtttggggtcatctcctcctcctgccccacttaactttgcttctttctgtggtgagcccccacgtgtgatttggtgaacgtgttctgcccatagcgttctgagatagaccctataggcagaacacgttcaggcagaatgacctcaggtgtctgggtgggagggagccacgggcgagtctgaaggaggtgtgcagtgagctctgaagcatctgggagggaaagattaaatccacccgacagaaactcagggcctggggtcaggtcagcctgggccctagcagagatctggggccagagcagccatcgagagcccagccagcaaccctgggggtgagaggagcaggggagccagagtgggaacccaggagaggtctgggtaggatgggtggtcagaggcctcttggcttgagggcatgtctgagggaagggggtgctgtgttctggcagtagatgtttgctggacatctactgtgtacccagcatgggcacagcagtggctaggccaggctacacactgccttagtggagtgtatagaattgaacgatgcctactgcagggtgtgggggtctggggccttcacctgggctttggctcaacaacccaggaggggagtggagttggtgggggtcccaaaggcactcccagcaccaggatagcccacaggctgggggccatagaccagcattccttctgtggacaggagagacagtggggcacctctgcgggacagagagctctgggtgtcccatgccctccttctgaccaggcctggctggcagtgtgacaggtggcttctttcccctctcctgctggctgccctgctcctccatgggggaggccctgtgcatgacacaggcactgactggtgacattggccggacacttcccttcatctcttcccctgacaggtgagaccagatgggcagggaagggacaggaagggaaggagcagccagattacagaaggtggggtggtggggctactgtacttcccagggccccatctttgggaggtaaggatgggagtaggctgtttcctgcagagcctccccattggatcagatctggctgctggtcttaccctcctctgcttccctctcttgtcctcactggagtcccctggggaaggaacccatgtcagaacccatccctccaaacctgcagcggatgtgggggtctttgcaagagtgagagctgaagtggaatagaaaaccctgggacagggctcgaggtctgacccctcttccagctcagccaccagctcactgtatgatcttggtctgggccctgcctctcccattttagtgtcccctaattaaagggtgaggggaagacttcagtcaggacttacactgtgtcatgtgtcttctaatcaccagggaccttgttaaaacacagtctgattcagctactctggggtagggcctgagagtcttcatttccaacaagctcccaggtaatgccggtgctgccagttcatggactccactttgagcagcaaagacttaggcaactcattgcatttgagtctgcaagacccagagactgtgtctcttgggtcctttgcaatctcacgaggcatcagaaggaagccttgggattagctccaggctctggactaacagagcacggatctcaggttggcaggcaggggaactatcctagtcccctgctgaggctgtgtttgggtaaaaaagtccttcttggcaactgggcgatttaatccagggttgcttctgtctctaggggctcacaggacatctggaacatgaaggaacacaacacaacccaccaattatcttggtggccacagagggccctccaaggagctgatgccctttgtgaggctagtagccatcagttaaatactgtaatccattacactgagaatagaaatgtaaccaggatgtagctgaacatgcccagctttagctgccatgtggctgggccttccatggaaaggaccagccttctctaaggagaggaggaagcagacagaggcagtgagccctcccactctgcgcttcccctcactggcctgctcacaccgctgggtgaaggcacatgtcagggttaggtagttattcaatggtatgcctgcggctcttcaggaagggctgattggattcctatctacatcttccactgcatttttggcacaaaatgctctggctattgcctgaccaatcttagcggtaactccacagggatggcgttacctatgagaggccctagggtcggagtggagctgtgtagaggagcccagcgggtctggttctctaccttggtcccaactatttaccagggcttcccgacatcttacggccaggaatgggagatccaaccagagaggtctggagttctgcccaggaagaacctccacctctttgagatctggaatcttcagggcctggaggaagatgccagcagccctggcagttctcattggtcaggggaggtcggtgtggggtggcagaagcacttctctggcttcctattgggggatgagtgtgcaagctcagtgggctccctggctgccagagcaatctgcttaaaggactggcttctaggatgcagggaagggctcagagggagccccttctctagcacctgagagactaagccacttagggtggtgggcagggtttctaagctggggtcctggggatctgggcccctctggcaactcctaccctgtccccttcccccaccagtgggctcactttgcaattctgctgatgtcagcttgagtgccttaatgggcagaaaatcctgactcctttgcccgactaggctagctgggactgcagggggccccaggtaaggagcatatacttctgaaatttgtgtgtgcccccgcgtatgcgtttgtgtcttaggtaggtaggtatttatctctgtgttgtgtgtctgaaggtcatgcatgagcctgtgttcatatacacaatggcgtgcacaaaggcacattatggatttgtgtatgtttgtttgtgtggagagggtcaggagctcccagacattcctgaacacttgcacatgggttggctgttatctccagcgcctgggaggaactggctccttaaaggagggggatggtgagttactttgtaaagtggagacaagccccttaagccctggggaaagggatttacataaaccaaggtcccacgtttaggttgggttctcagctctggtgtgcccatgaaagaccctctcccaggtcctagcagagctgctggcacagtgccctgggtgccagcccactgtcctgcatgggctcagaggagctggaacggtgtcagctggtgccagctccctgggggcagggcaggccgggccaggctatgtgaacagagtgtgtcctcagtcctctgggggaaatcggagaccaggccagatcctgcctgctgggtctctcaccctcttctcagcttacacttccagggaaactggtcaccctgggtagagacttgctccagatatcagggccctgaggctccagcctgagctcctgggaggggatgtggtgtagagacacccttggccaggcccctgcctcaggctggcctggggcgccagagagaccaggcttgtagaaggaacggagcaggctcacgcggagccctgtgcacggtgagctcagggtgcagagggatctctggggccctggtcaccctccctggggagtcctgcttttcagtgtggcaagaagcgccttgctgtgtgacagccctcttcccctccctgactcttagtctcccctgggtcctctgggggccctaacagcaggatgtacctggcctcctgcccgaagcctctcagagtggaggaggacctaggaggctggacactgagatgcgagaggcgtcataggaggggcggtccaggggcagggtggggaggagacttctcttgctcattcctggttcaaatgtttcagatgttgggatgcagggaagaggtgactctggtccccagatgcaggtcagctgccagaggctggccagggcttcccacccactgaccctggctgcactcagaggcctctcacatttctcttcctctcttcagtctactgtcagggccaggcatatcccctgggacccagaatctgtctccattgcccccaaccctgcgacaccctcaagagaggtctagagggtggtgactcagtaactcagagagggccttctggagatgccgcggcctcagaacccctctgtaacccaatgctggcctctcaggccacgtgcggggatgcctggcttttctgaatccttgctgcttcctctggctttgagaagcagcacacttggtcctcctgttgggagggtggacaccagcagaagccttccttgtaaaagtttctaggaggcacctgtggtggttctcctccccctcccccttggtaccatgtcccagccttgggatccccaagtccccccactcccttcactttgctgctgcaaccccttgagaggtggctggggaaggacaggggtatggaggtcgaaactcaggctaataaatctagggtggggagcatttattttaatttttgtcttgcagctctttgtagaggacctagcctttctctactgaactgaaggggtttggtcccatcacccgaagactggcccacctgcccacacaggtgggggcacaggaggtctgggaggccccaggaggtggaagttcagaggcctgcctggccctgtccatcccactggctgaggccaggccggagggccgaccccaggggccctctgtatgcaagccgacgcagacaagggcccagtgcatagttaagacacaaacaccacacagctgtccagagcctccaaagcactgtttatccaggctccatggaaccaagtgcccccagctgcctgccctagtcctcaggggggcactggcaccgcagtggcctcggcctgagaccctcgatgagccccagcctaacctgctccaaagccactgacacatgcatgtttagcccttggcccatcaagatggggccctgggaatgaactggctgcagaccctcctccatcccacacccccaggggctccatcagtcctggctagctcagcaccatgttaaatagcttccttgcaatctcccttaaataaacccatccccagagcaacctacccaccctgcaccctgaatatattatcctattggcttatgccttctagactggaggcgctctctcctcttgccctctactccaggggataccatctccctaaaaaaccaggggaggaagtttttttctcaactctggggcagagacaaagggtggcctgggttggagtggaaaagccaggaatagcttcctctgtcccttccctccccagggtacttccttctccttgccctcttagcagcctgggtcaggcgcgacttacccaaggtcacagacccaggacccagagtcatgacccatgtaggaggttaccctggttttgacagcccaaaccagctccagggcaggaggactgaacttaagcctgcctccaccttggcccctgcagttctccaggctcggagtgagctgagggaggttccagctcttgactccactctgtcccggacccctgggactatctcccaggaccctccacccctggtgtctccaggtctctcttgctctggggatactcagacagcaccaggcatggaagcaatggggcccgggacatgggcaagcctgtccctggcccgatcagcatctgggcccaggccaggcctcacacccagtactggccattcttaagggcagggttgggtgtccggcagaactgcagcagctctgggtcaggctggcctcctggagggggcccctggccaggcacagctgtgagcgggatggcctggcctggctccaccttgcgaaaggtctcggtgtcaccagccaggccgttgcggggcttggcagtcaggacctggacgtcatgcttgcccgtcttgttgcgttttcggaggtagaagagcaggggcaggatgagcgccaggagcagaagtaccaggcacatggggatgatgacgctgaacatgttggcctcaaggaagctcaggaagcctcccttggccacagcgggctcagggctggatgccatggggcctggctcgcctgtgggggtgctgctctctggcttccctgcttccgtccgggcggcctcggggacactgagcagggccacgctgtagggccgggcagcattgtaaggctcagtggcaaagtccagggaggccacagcaggcgggacgccctgtgcccacagctccagagtgagactgtcacctgcggggccgggggccctcccctctggcctgcccacctccagccccagcctcccgtcctcaaggtcctgctgagtgaactgctccaccagctggctgcccccgggctccgtcctggctcggggcacgcggaccacgcggccatgccggggtccctccaggaggcggaagcgcggcacactgcctgtgcggttggccagctcgccagcatctaggacggtggggtccaggcgcagggtggcaccctggggccatggcccacctgcccacacatgcagcagagccctcacagtgacgttcactacggctgatgcattgacacccctagccagtgccaggactctgaagtggtcatgagaggaggagaagttggtgaaggcaaagaccacctcgccctggtctatctggaattggctgaaggccgaggtgggccgcccgcccaccaggagatgcccatactggggtccctggatgaggcggtatgctgcctctggctcctcccgatctgaaaccacccggagctgctgctggctcagtgaggagcgccccaaagcttggggcacctccaggggtgcccgcagctgcacctcgatggcggatggtaggatgtccacagccagggacatgggcaggggtgggctggccccatcagacatgctcagctggaagatgcctgccacgctgctcccgttggccacgaaggccagccgccctgaatccacatcggcttgcgtgaagcgggtcacgggccccaggccaccacccaccaggctgaggaagccgttgtggggtgcccgctggacctcgtactcaatctccccaggagctgagtctgggtccaccacactcagctgggcccgggagatgggggcacgagagcctcgggtgagccggagtgggacagaggcctgtggctgagggggccgctcatttacatccctcaccgtgatggcaaaggcctctgaggtttggggtccagccacggaggcccctgctggcccctggaggtgggcacgaaagtggaagccatcctgctgggtgcccccaccgccgtgggcatacactagctgccctgcagccagctgggactgcaggaagtggggctgcccagcatggaggggctcctcggacaccaacagctggccccggctggggaactgtgtgacctggaagagcacatcatgctctgagcgctggggtgatggaacgctggccaagagattggaggcatccagagcagccacggtgatcctggcccgctggccctcggggacccagagacctgggggtgggacataggctatgagggtccagcccactgaggggagagtgatggaccctcagctgggggtgcctcagggcaaggatgtgcctccccccaaccatcaagccaggtcctccagggtggggctcagggttcccaggaggataaggactatgtccccgctgtgatgtcaaagcttccccactcaccctccctgtgacttcccaggtcctgggggctgagacaggagctgctgaccctggcctcgtgtcccctcctcctgggcctctcccattgtccctccccacaatcttgccagcttatcatgctgttcacctttgttcttccagaggtggctggggcgctggggacaggcagcctcaaaagacacagccacagcaagggtggcggccacgtcccgggcaggcggcgaggacagctggagctctagggtatcatgggcctcccaaaagggctcggggggcatctcatgctcatacagaatattcccagcgtagacctaggggagacaccatcgtggggtgagaggcaggtccagcctgtgttgtccagacactgagcacttttgtctcctcaggccccactctgggctctcctgggtgtgcccaggtctgtgcgtgtgacccgctgtctccctcactaactcactgggtcacatcaggcaatgcagtgcagagctgggctctggagccggagcctgggctcaaaccccaactctgccaccctggggaaatcgcctaatttctctgacctctggggaatgcaatgatctgtctgtgctgctctctaaagcgagtacttcctcttgtgcacaggatcctatcccctcttgccttctgaagacaccacttctactgtctcttggctttctcctatggtgtcagttccccccagatgcatcattcccttcattatgcaactatgctattcttttgtctcacttacattaaagctatttaattaattattattattattattttgagacagggtcttgctctgttgcccagactggactgcagtggcgtgatcatggctcactgcagcctcgacctccagggctcaagcgatcctcccacctcagcttcccaagtagcggggactgcaggcacatgccaccacacccagctatttttttttattgtttgttgagacagggtctcactatgttgcccaggctggtcttgaacttctgggctcaagcggtccacttgcctcggcctcccagagtgctaggattacaggcaggaggcactgcacctggccagaaaaaactattcttgacttcacattttccaccagcttcacccctgcccctttgcttctctttgcagcaaaacttcaaaaagcatagtccacgctctcccccaggcattcttgggtctctctacccaggattttgctcccccatcgccacatctccttttgccaagggcaccagaggcctccgtgttgttggatccagcggtcggctctcagcctcctcttaactgctcagtggcactggtgccgccaagcaacccttcctccaagagagccacaggctctgggatacttcactctggggttcctcctacctcacagactctcctggctggtcctcctcttctccccaacatcttatggccaggtctccaggctcttttctgtctacaggcactctccatgagtccttattcagtctcctggcctcaaatgccagctgtgctgagacccccttatttgtagctccagcctagcctgctctcccctgaaccccagactcatgtttccagctacctctgccgatatctaatagacacctcaaactcaacctgccccggctgcactcccgatcggcccccacctcctacagtcatcctgcttcagagactatagctccgttttcaagggctcaggccacacccttggaaccacccttgcatcctctctttccctcaaaccaccgcatctctcacctggattatcgtaacagcttcctgtgtcccagctgcagtcccccgcccattacattttgttcctaacacagcagccagagtgagccttttgaaagggaagattatggggctctttggctcacatagtgcagtgtctccccatctgaccactaaggcctggctgtgaccatatcacccctgcgacctcaactcccctcacctccactccagacacacctgctgttctatggtgctgcctgcagttcaacaccaaagaatattcttcgctccaggaagaaaaacggttttctccacctccaatcacaatgtgttcttttggcctatcttttgctccccacccacccttttttttgagacggagtcttgctctgtcgcccaggctggaatgcagtggcacgatcttggctcactgcaacctccacctccacctcccgggttcaagcgattcccctgcctcagcctcctgagtagctgggactataaatgcgtgccaccacgcccagctcattttttgtattttagtagagatggggtttcaccatgttagccaggatagtttcgatctcttgacctcgtgatccacccgccttggcctcccaaagtgctgggattacagctgtgagccaccgcgcccggccttattttccccttttaggaaacactgggaactattttcttctcagagaaaaacaggacttgcccaatagtaacatggaaacttaacagggtcttaacctgtgaagactctaggagcagaacccggagtaagggggagcaggggccggagtaaggggagcagggccccgtctaagatggggcagggcctgggctaagggagagcagggccgggctaaggggaggcagggcccagtctgaggtgggggcagggcctggtctaaggggagcagagcctgggctaaagggcagctgagcccagtctgaaggagagccgagctatctgaataggggctagcacctgttctaaaggaagtggctgctcccctgctttcgctgtaagagggaacacaggccttttaagaaaatgggaatcaagttttttgtttaatttcccaaaggttatatgttgacaattaacttcaaagtattagctgctttttgtaggccaaataaacacgtctgtgggccagatctggcccaggactagagttgccagtggcaacttctggcccaggctgaatggtgggcaggaaggaaatggagcccccaggagtgggagtgggagctgatgcctgggtacgggagctctgtgggtgggagtgagacaaaaaacagggtcttgagctctggggagcaagcagtgtcctccagtgaaggaaatcctggactcgcaggcagaagttttgcctcttactcgccatgtgctctgaataaagttacctgccctccacgagcctgtttccttatctgaaaaatggggacacctgaccccttccctgcccagtttagtgttgtgggacagggctgctgtcaagacaatacccagtcctgccctcctcccagagtgggccagggtagcccacgtagcctcttccctgctttcctgggtggcactgccagcctgaccccctggtgtccattcagtctagtccttcatatttctggggcacggggaagctctgagtaacgtgggactataaagtgcaagagggttgctgatggcctggtcccgtgccctctccattcctgggcattcttgacaaaggctcccagcaactgagggtacgcagcagctgcagacaccagcctgacaaatatctcattgtggggagggggccatagcaggagtggggagccagggaaatacagaacctgggactgggaggtgttgatgtgagaagcccaagaaacttcattccacctgtcaaagccacctccttccagatgcccaaatctgagccacttgctgggcagggactttgcctttgcacttgctgaataccatctgcacctctcaggagggagagtgccaggctcaggagtccctgccgagctaggaaagggggctggggtgggctctgccattttttgaaggctggcagggggacccctcaggaggtacttggggcagtaccatatgctgtggctcctgagtgagagtcagctctgcgccccacaagaccactccctacccagaattcactgtcatcatgtgctgggtccagatgcccatgcagcctcctggcgggagcatcacatgtgccgcctgcctgggatggcccatggaagagtctgccccgctctgccctgctatggaacaactcctgttctgtcttcagcgagtggtgttcatttaagtgatgactgggctggcccccatggcacagttatcacagagagtctgctgctacccatggctgagagctctaattcttcctggtggtctctgaagccaccaggacggatgaacagcagcttcaccctcttggctgactcagctgcctttcatcagctcatctgcccctaggatccactctgcctctggctggcacttgacctgagccccaggctcacacctctgcccacaggcccagccgctgcttcacgtccaactccatcccccaccaagcactgcccctcatcagctactggggtaccactagtgcccccacatggtgccccctctccagaccctcgggtccggctgtagcttccttctggaagctataccccaagaccccagccctgctctagggccctgtatccccgactttctgcatccttctccctccttctgggaacatgaacttgccctgccagcctggcggctcctggaggacaggacactagcgcctggacaatggcaggcccgggaacgtctgctgccagtgatgctggagctggcatccatgtccacatgatgtccatggcacagcggccacctgaggctgggggcatctgagtggtggctgcaaagttgggcccttacctctgcctgagtgaagttcaccagggcctcccctgtgctgtcctgctgggcgtggaacagccggcctagctgggggccccgcaccacacggtagagcaggagctgggggtcagtgcctgcgctggagctggccctgagggtctgactgctgagtggctggacggaccctgccagaggcaaaaggggatatcagattttgactgggagccaggtccaggcctgtgtttgcaaagaggcagcgtgaccctggcatgccaccctcagctccgccccagctcctggcacccaggaatgcccatgatcagcacacccacctgggcagacagtcagtgtctggctgcccttcagcgagaggagcacttgcttctgggccgtcactcggaagaagtgtccgggggaagtgtgctcgccgtcagagaggcggaagcggaagcctccatccagggttcctggggacaggggcattgggtccagctggcccgagccggctccccatctcagggcacccccgtgggcagcaggaacccgaggcccggccctcagcacccacctctgtgtgagaacagcacgagcccgccgtccagctgggcctgcgtgaagctgcgcacctcagtgcccggcgccccccgcagcactacccgcccgttgctgggctgctcgatggtgtagaccagatcctcagacccagagtcgccgtccgtgctcctcagagcctccgcagggatgggcgcagtggccccctcccacatctgggaacacaggcctgtgaaggttctgccttgccgcactcacccaccccttcctccccggccctgggctgccaccagggctccagtcctgctgcggctcagcccctcgggtggcatcgaggctggcgccactctggctcccctgcacaaagggcctcccgcattcaccttccctgtcaccccagggaaggccccagggaaggtcaccctccaggcccagcctccctgctctccatctgccctagtcctgtgtgtccctcaaggccagcttatgtcccctacccaggaaggccccagctcttaccctcaccaagttctcactcccagaaacccccagcgctgaccaacagtgctccctaatctgtctcactggtgggacaggggtctcctttcagagcctccgtgtgtgcctggccggggccgggcacaggtgggaatggtgattttagaaatgggccctccttccagctgagggaggggtgcgtggcgcagagagtggggggctgatggttggcactgttctgcagcacagaatcagcgtgggatgggcccaggtgcttccagagcagttaggggccctccttatgttgggcaaaggggacccctttttcaggcctcccacttgcaagcagagcaggtgcctgttcctgaggtcctggtaccagtcttgctgggtcaattacttgcgggcagagctgcagtgggactcacatgcccggaaaacagagccttctggcattcctgggcttcctcccccggccccagggagccctcaggcccagccctggcaggaggggccataatgttgcggggcaggaccccagcactaggcttctggagcaaacacaggtagatggcaccacctggtggctgtgctgccacacagccgtcctggcctgtggttccagagcactgtgtcccactctttggcggcttccgcaccaccaggccacccgctacgggcacatcctagaccaccaaggccccgcccccacccccgccccaggcaccccatgccagagacagcccaagtcagccctttatggaaacttcagtggctcctgctgaccggggaggatgcaccccagaagctggggttcaaagccctgccatgtgggctttgtaaagccatgccctttctgttccaccagaactacttttgcaaccatggagaagttccatcccacgtctgggcctcaacttccacctgcagagtggggcccttacctctgcctgagcgaagttcaccagggccttccctgcactgtcctgctgggcgtggaacagccttgtgcaggagtttggggagccaagccatggccttcacttgctgggtgaaggtgggaaacttaacagcttccgccctgatgcctgcccttaagggcttgtaagtgattctgtcagatgttctggtccttagccacagaagaaggaacagcagagccacccgtggccgctcagaagtctgcctaccatacttgcaaacatccaataaaaaaacttcccacctgtgttctatttcagcacaatctcacttctctccttccaacaaccccgtgaggcatgtggcagcgtccccattttgcagaggaggaaactgaggatcagagctgggggagctctgagccgcgaagtaggggacgctggcctctttctcgaagcagacatgggggtgttcccagggatgctctcacctgcaggcctgtgtttgtagtgaggatggggggttggtcattgacaggcaggacagtgacagtgaaggccacaggatggctctggcgatccatctcggaggcattagccatcaggacaaaactgtctgtcagtgtctcgctcccgtcatgcacgtagcggatcagctgctcttccacctaggggcaggcccagggctggcagtcaggccccagcagcacccttcatgccctgcctttgggtgcaggaggagactgactcttttagggcttcattttccattggtagaaaatggggaccataagttctggctccgaggagttgtgaggaagaaaagatatatggtatttaaagcataggtgcttctgaaatgtgactccccgtctcctctctgtgtataacccccagactgggagtccccagggctccctccactctgcccccagagctgggctgcagcccctgggcctctctcacagccataccattctccaggagaaggcgctgagggtcctggcttgaggtccgtcctccttctgcagggctccatgctggggtggctccagcacctgcaggctgaggcccaggagagtggggaagtagggcccggagacacggagcagtggaggggccagggtgaggctgccaccctcagggacgctgaagttttgcgcctctagtgggatggcagcgggcagcacctccagctccacaaggacgccctcgaggggagcacccaggcctgaggccacatccagcgagaaggcatcgctccaggcctcagggcgggagtgcaggtacaggaccctgcctgtgtccactgcctcctgggagaagctctgcacagggtccaggctgggtggctcatctgccaaggcgccacgcgacaccatcaccaggtagccggcactcggtgggctcttcactgagaatacgatgtctgcaggtggcactgcctcctgggctgcctggttaacagaggtcacaaggactcacagggggccacagagggggtctcagaggggtccactgtggccctaagaagccggaacaggcttgatcttgccccacttattcctctagataccactgctcatttagacacacaaacacacacgtgggttcacacacacagcagccagacatgcagctggtcacattttttgttttttgagacagggtctcactctgtcacccaggctggagtgcagtggtacaatcacagttccttgaagcctcaacttcccaggctcaagggatcctcctacctcagcctcccaagtagctgggaccacaggcatgtgccaccaggcccggctaatttttaaattttttgtgtagagatggggtttcactgggttgccccggctgctggtcacatgttaatgcccaccccacacacggttgcagggggtcggtcacacagcttgagatgcactccctcagggaggtgcataatcacatgtccccagactcagtgacacagacacacgagttcatcatatgctgacgcagtcacacatgtacacatgcgtgtgtgcacacacacacacacaggcccccctgctcaggatccgttcaggcctgtggctggtttgcaggcagcacctccccagcccctgctattaccacccaggaccatcagagggcgccccgccccacccctcctggaggcacagccgccttcagctcaggccctacagagctcacgccccaaaggccacacgggctccctcacctgatgggccagccacaagaggccaaaccaccccccaaactcacattcctgttctatgcatttgcccggaatgttccttctgcctggaataccactccccattctctgctcctgatggcctgtgctcttcagagcccggcccaaacgctgcctcctcccgcgaggccttcctgactccagatctgctggcttgctgtcggccccaagctccagacatgcagaccagaagggtctccgaaatgagcagtgtaggagagtaaggccaagagcgggcaaggactggcctgaggtcacagggcaagtcagtgagcctgctggagggcccgtggttgctctgtggggttcctgggtgggcagaagccacccaggtctgggctctgagaaaagagtgggggacatgagggtctgaggagtagcggcctgtctccacggtcagcaatccccaaagctcaggacccgtgatgtcctcccagggaactgactgcaatggagattctcgggctccacgtcagagattctgtagggctgggtggggtccaggaatctgcatgctcagccatgtcatacacatgagtggacacaacctctggaggcgcacacaactcccaggaggatgggtgtatagcaagctccccagaaactcctgggagcacaacatatacgggagcacatctgaggcacgtgcacacatgtaacctggagccaccacagccacagcccaagtcacgtgtgttcctggcatggaggctgggagaaggccctctacctggcccacacccctgctcaccacctccaactcctcacctccagctggtcccttctgatctcagctgcctctccctggaagacgtagatcttcttgtgccggaccagcttcagtggggccagtgggccctctagggcaatggtcacttgtagggtggcatccgtgtgcactggccctgcttccacggagaaggccatggtgtcgcgggggctgaggctgccattgtggctatagagaacggccccatccagcaggtcctgctgggagaaggctgtggctggctgaccagcccggactagctgtccccagcgagggccagctgtgacgtggtagtggacctcatccccactgcggatgtcgaggttggtgtccaggtggagcacggccgtgtcgatggtgccctggcctccttgagggaccacaaggctggagccgttggccacacggaggtagggttccgaggcctgcacctccagcagcgcagtggcctggtgttgcccgtcggacacctgcagctggatccagccacggtcagcccctgagtgcacgaacagtactcgcctcttcctgaggtcctcctgggtgaagcggtagatgggccgcgtgggctcatctacggccacgatactgccaaagaggaggtccttgcgggtaagcaccagctgggcgtcagcaaagcccgagtcagcatcgctgaaggccacgtcgtctgtagtcagcagccgccgcccaccccgggccacatggaagatccggctgatggtctgcacaggggcgtggtcattcacgggctggatggccactcggaagacaccccgtacctcctcccaggccatgtcaccactgctctcgccctggcgggtagcaacaaatgggatatcatcttctgtggtctcggagtcatcatgctggtagaccagccggccacgcaacaggtcttcattggtgaaggatgtcaccatagtggtcttgtcctgtgtcccacgccaagccaacctcccatggcggggccgctccatgacctcatagaggtagctggcactgttgagactcttgacaaagaggtggtcagcagagaggacaccctcaccaccctcaggcaccacgaggaggacattggtgaggacaggcgcatctgggtcaccaccaatgtggatggggaaggtatagagtggggagaaatatggtggagctgtgacacggaaacggaaggtgtcctcgactgcctctgaggcacgtgctgtggccccataggtcacccggccagcctgtatgtcatcctgggtgaagccctggccatctgacagccttgtgccctgtagttgaaggttgcctttcctgggagcctgaaccacctcataatggaaggttggggggcttgggcctgcctcctccagggtggcctccaggtgggctgtggtgagggtctcctgctgggtgttctgagtgtgcagtggctccagccgcagcatccacacagtggctctctggatggtcactgggaaggacagattgctcaggatctcctggcccacctgcacctccagggccaggttctccacggtgtcgtaagcgtggtgctgtgggtcagtgctcaggtacctcacgcggccctgctccacatcccgctggtggaacgcctgtgtggcccaccactcagcaccctccaccccacctgccccctgcttctgcagctccccaaactgcagggccccagtgacgcggaacagcacgctcacatcctgccccacggcattggtctccaccgacaggttggcgggcaagatgggcatggcagagccttgggccagtcgcaaccctgtgctgcggtggatctgtatggccggccggatggccaccaccttcagcgtggccggggggctggcctgcagtccatcgctgacccggaacgtcaagtcctgtgcaggaccaccgcggtggacatagactaggctgccggcctccaactcccggcaggagaactcggtcgccggctccccaggctggtctcggcgctccacggggaggccagaggaggtgccaaggacctggaaggtgaggccctcacaggcagagtccgggtcataggcctggaaaacctcaggccccagcggcttctgcgtgtgttccaggatcaccatgaggctgccatgtgggaagatgatgtggggtgggtcattgacagggttgacctggatgggcaggaggtatgtttggcccctccgaaggcatgagggcatgggcacccgagccgtcaccgacacctccagcaccagctggtcggaggtgtcctcagagccatcgtggatgaagcgggccttgcggttcaccacgtccaggagggtgaacatttttcgtgcctgggctcccgggatgtccagctcgagctcgccatggcgtgcccctcgggtcacgctgaacagcacctgggatttgcgcagctcagcctccatcaggtccagcgtgggctgcacatgcctccactcaagccaggctgtgcccccctcggccaccaccagtgggctgatagtcagcagctgggtgaaattggcaaagacaggaggcagccctggctcaggcacgcatggctcaggcagctccatggctggccaagcctcaggggccagggtggagaaagcttcataatgtccataggcatcgtcctcatactcctcctcctccagcctgcagccggctgccatgttgcgcgtcagcaaagcttcccgcagcccccgcctctggccattgacactgaggtcttccatgcagcccagcagggaggcattggtggcctctggtgtcaggcccaggcggtgttcctggaggtgacgagaggcctctgcatccagccccccgagaaggagactgccccgtggctccaggtagctgaggactcctcggttcgaagtatgcgtagggtactggtccacggagatttccagccggtgagcattgatgtggacactgacctcatggggctgcccatcggccacaggcacactgttgtggagcaatacggtaccctggcccttctccaccacggcccgcaggtggccctcaaatatgtccacatagatgaagtccccacgccggccccctgcctggaaggccaagggtgcctgccggctctgtgtggtgagtgtaaactctagggttccttcgtcctgagtgccccaggcagggaaggcagccagagagtggggcccagagaagcccagggccacatcatcactggcagaaaactcttcagcacagccctcatgcacatcgggggtcagaggccggaggaggctgcggccattgagggtggctgcatggaggcaacccctcaggggtcggctggttcccctcaggtagggcaggccaagggtcccagtgcccccaacaaagagcccataggggacctctaggggggctcctgggactgctgaggaggcgttcagaaacccatcgactgacaacgtggcccagccctctacgacagtcagcaccacagtgtgggggatggagtcactcagcagcgtctctgctggagtctgcagcctcagctcctcctggcccagaacaagtctgacctgaagagagatggggagtgggagatagtggacagcactttggatccatcatttcccttataaaagcatagagccgggcgtgattgcagtggtggctcatgcctgtaatcctagcactttgggaggccaaggcaggcggatcacctgaggttaggagtttgagaccagcctggccaacatggagaaaccctgtctctactaaaaacacaaaattagctgggcatggtggcgcatgcctgtaatcccagctactttggaggctgtggcaggagaattgcttgaactcgggaggtggaggttgcagtgagctgagatcatgccattgcactccagcctgggcagcaagagcgaaactctgtctcaaaaaacaaacaaaaaaaaagcatagtgagttccccacacttggggccccagagtggaaaacctaggacaagagcctctggtgccactcctcttgccgtcctgccatctctttattcatcctccaaacactcaccaaaggaaactctgggccagggctggatgggctctggggaccctgatatgaatcagatgtggtcctcgcccacaaggaactgacatacagcaagatgctctcctagaaatccaacctgtgtttttaaattcttcccctctttccttgagtgagaggtgccagaaatattgtcttggaatctggatttcaactttggaataatgggtaactgggaatcccttgatcagtccccttcaacagagcaaagtttcttggggtcattgaaggcagccaggctcactgttcaggaataggctaatttttaaattaaaatttaaatactctgtgttctgaaaaaaagctccctgacctggggtggaaggagatcttggggagagatgaaggacatagttctgtctccatgacattgacagcagaaatggctctggtacggtgctcccagatggtagaatgggaggtggcagagtatggtaactgcagaaccagggcactaagaactataattttggagtcctggtatggagcatctctgtaggggtgtggcatcattgtacctacagaactggacagccatcagcaccagcctgcaccacgctggtgtttaacagtgaaagcagcagactgaccaagccctagtcctctccccatggggtgtggaaggagatggctgccccaaatttgtttttttttgagacggagtttggttcttgttgcccaggctgaagtgcaatggtgcggtctcggctcactgcaacctccttctcctgggttcaagtgattctcttgcctcagcctcctgagtagctgggattacaggcatgtgtcaccatgcccggctaatttttttgtatttttattagagacacggtttcaccatgttggccaggctggtctcgaactcctgacctcaggtgatccacccgcctcagcctcccaaagtgctgggattacaggcatgagccaccgcgtccggttatttttttcttttaaaaatagagatggggactcattgtgtggcttaggccagacttgaactcctaggctcgagtgatcttctcaccttggcctcccaaagtggtgggattataggcatgagccactgcacccagcctggcacaaattcggaataagaccctgggttcttaaactcttcatggtttaggggaagactcaaaaaagccacaagactccttgctaacaaagcttgtggtgtcttgaaggatgaaatggaaaaatgaggaagctgaggcagtactggtgctgttactgtcgtggacagaccatggtgctgcagagaaattggtgcagtgccaccgggatgcacaggggtcatgggggctcaggagggggcctagcccaggaggaggggatgcccacactgagacttcaaggagaggctggagttaggcatgtgcagggaacgggagaggcgcacacctggcagaaggagtgtgcatcaagagcctggcagcaagcgactgtaagatggccaggaactgaaagcagttcagggctgtcagagcacaaagggccagcgaggggttgtggcgggaaacatggttggagggagccagtgggcagagccagttcatgaaggatttaccatttctgggctgctgctgcccatcccacagtggagaacttaagaccccaagataaaagtgacttacacaaggtcacacagccagctggggttcactcaaagctagagaaggaatcccaccccgaatcccgcccagatctcagggggacgtcactcacctgcaggcgtccagagtagagctgcagcaggaggtggtcagctgggcctgctgccaggagaaggagggcttcgggctgggacgtggagaactgcagctgcaggtctatgtcggtcagagccgtggccacaggcacctccaggtggttctcaccgaagaaggaagctgtgtgagagagggagctgtggtcaaggctcagactcttgcctggaggaggcgaggtgccgcaaagagggacgggtgggttgcagaaaggggtccgtgctggcgcaccctcatggttctgctgtatggtgctgcctctgagcactgcccgggtcccagcatcttcttggtcctggcaccagaaggcacaggctcaccttgtgtccagcccagatcttgtatttacaggaggtcagacccagaaattcccagcaactcaggtctcctccttggaggttcctggagccagaggcctccgccagctctgactcgcctcccctgggccccagaggagtctccctcgtgggtctggctcctggacccagcccaaagggaaccgcaactggcctgaccatctggcttggtggtcacagccccaaggaatggagtttctggagaatcacccccagtccagactgatccctgctcagattccttctcctaagtgcccttgtgcttgggctcctgtgcagcgcctgctgtgccatgccccgcctccatgggttggctgaggccacgactgggatctgggggtggtgtcagcatggcccacctatccccgcttctctctcaggccattcttccagctgccattgagcgtcggggcaggagcttattggcctgagtctgccaaggagcaaaggctctgaggccagatggggaccatgtgcagtgtcaaaccaaagtgggcccacacttcctccattacccttgctattgcttcctgctggagagctattcacagtccccgatgagcagtcagatccggccccattgtttccaccgtggccaaggaaccagggatgagaacagctgagttcctaacttccccaggccaccacgcaggctgaggctgaagacagggcttgggaggggctgagggtctgctgggcaggccaaagagggcctccccaggcagaaggccatgtctgggcttgcctggggttagtggttcctatgcagggcccgttctgtcccatactgggactcctcctcttttgaattgctgcttcctccagtcagtttccccagattagcctccctgacttccaacccgctgccacaatttctggtccatgccttttgtggtgataagagccaaatataactttgactttgcctgcagatgtccagggctggggggtagagaaacacgggttaaaaacggtgattcattcctgttgggcttccctcaaacccgagagcgagcacaggctgacggccttgatagggataatccggcaccagccccatgtgctggtccctggccagcctgagccagctgccatccgcctgagtaagcagcttcagccgttggaggagtcggagacttgtacaccctaagggcagccagccccactgggagggatgtccaagaaagatcccgtaagaaccccttgggctgagttaaatcccctctagttatctcctcctgccagcactgctggcaataccagcaccttgtctgggaagctacgggaatcaagggagccctgcagaccatctgcgcgggggcggcccagctggttcagcagagcttggcgccagcaagggacagaccagggaactgcaggtggcggccacctaccggggtgccttatctgcaaagacattgattcctaagagcaaaacacagcacactaaagtgagggaggccatagcacaaggggtgggggcacatggccctgcaggatagagccaccaccgtcacctgctggagcggctgacagcagctgccaggagtctactgttgaattttcaggaattttgagagccaggtgatactgcccacagtgagaacatttataccaggaaaagaggcaaatactgcaaatcagggttccccctccccaagaaagcccattgctaaacatttacctatccagcacccacagagaagggggcacatgtccctgcccctacccacccttgcactaaaggtatatgtagacccgccaagtcatggtcaacatcagggctctgggccaggcaggaactgaactagatggttggccctaaccactgaaccacctgcctgcagccccctcccagcagaggagagtagagcctgtttggccagagtgggagggtggcaggaagtagaggtactttccagagcgctggggtctgaatgggtccattgaggggctgggccctgctgcttcctgtggggctgagcgggaggggctcacacaggctgtcttgtgctgctggagcgcgtggccaggcagccccccaccccaacagaggcctctgaggccttgctggccagggctctggaaactctgacagcgccactccctccacctcctggtctccttttttctgcccctcttacactctctgaggggcttcagttgcaagaactcagaatccctgtcttggaggtggtgggggggcagttgaagaggggcttcaaatggagagggtgtgcagaattaagatgtaataagctaggagtcaatccagaggacttcctggaggaggtcacggtggtgtacagacacagagagggaggaataggcagtctcagaggacagcagcaaggccgagtgagactggcaggaagtacacaggtcccctttgggtggggctaggagggtttctgctccatcacccgctaaagcctctggctaacttgaaggaagagaagtagagggaaaagtagaatgggtcaagctaggctcggctgcgtgactggggcggggggatggaggaggttgtggggagacattggcacaggctggatcagacctgccgttgattctcctgggtcaagaggacccatgattcatcaaaacagcagaccaaacctgtagcagccccatgggctgccctctgagccaggagaaggggcccacttcaggcctcagtgtcaccattctgtaaaatgggcacagtccctcccaccccttccccctcctgactgtggggattagtcctgggggtctctccctgatctaggagtttgctgtccatatggatgtggggaaggttaatggcatggggtgcctggaggtgccaagccttgggcatgagaggagcaggatgccccacaggtctgggggcccgtgggaggggcaggaagagtgctgcgtgtatgggtttctctctctggaaggcgcgtcagtgggcgtccagggctgtatattaatagatgtgtatttgtgtgtgcgcaagcatgtgggtggctgctgggggtgtgctttgggtttgcgtaaggctgtgtgtttgtgtgtgtgtgcgcgtgtgtgggccgggagctgccaggacagagcaatgattgtgcccgggcctgtcctgcccttcggtgcccgcctgccattacttggctgggcctggctccatgaaaggggctgtgtgttcttggagggttcctgcccctcctgctcagcgcccatagagaggtttgctaaaggtgggtacatcctcaggcttcccacccttcctccccataaacagggcactgctgtctgggcctgagggtggggtggctccatccttcttcctgagatctaggcctgggggcacagaaaaagcctgtttccttccctgccaagtcccttctcaggggctagaggaaacctcggtcaaggtccccagcaagccccctctgtcagggcaagggctgcgctggcatctccgggctccccggaggcactactaggaggagtgtggatgggcccctgaggcttccagcctgacacccagccctctgtctgacaccaggctccggggacaaggagtcgctgtgaggggaacatctctgcccatcaggcccgcctcccccggccagggccccaccttccccagccaggccagggccgggtctcaggcacagatgcctcttccaggctgagggctgctgtgggctctgttccttctgagtcctcagaaggctgcctgtgtccctgtatctgccccatctctccttcgcctccggccatccctgctgccaggctctgcctctgctccccctggtctccccctagctctttggctccctcttccctctgccccatcctggctgtccctgggcacatcaccctttgctctaggacagtctggagggccccggcctggggccccaccctccatgggtgctgagtcccacagcatcagcattctctgtagctcaagcctgctgcagggcactcagcttccaccttccagacagacaaactgaggctccagaggagaagcgatttgacgaagagaagcagaaagagatccagcaggtcccagcaccacccgtgtgagccctacccacccaggcacccccactgtaccccactctctggcaatggatccctgtgtgccccactcccgccatgttcctggttgcctgggggcagccccacagccaggctgcgtcatgggagcagcagcattcctgggtgtctgctgctgcctgactttataagggagaaattctgggagcccggagctgctggcccgtggggagtgcctgggcccgtagttgagggtgagggcaggagacctggacatctgtatgtgggggagggacacccagtgccacagagacagagcaggaggtgagaggtggaatgcgtaatagagacccattcattcattcactcaatcacaaatacagcaatacagtgatgggaatggaagaagacagctaacatgggagaaagttattaaaactgagaaggagaaatcaagatgccctcctccataaagactggattcacatacagaccaaggcctgaggaaggagacggaggaggaaaactcgagggagacagagaaggcgggatgttggcagcaagcctgctgctgtgcacaggagtgaggaggggatgcccagccagcctgctggggagggagggccctgctccaagacgaagccagacttctccatcaccgcccctcggggtttggcaccacggcgggagatcctggctccaggtctgggcaggcaggggtgagggagtctgagggggctgtgggatggggtattctgggagggccaaggccgggatgaagggctctctgtctcccctcataggtgtgtatgtggtggggcggggggtggtcgtggcccacctgggggctgaatgccggctctgtgagagcatggacgggccaggtgtgcttccccagcagcggaccctccctgaggtcacctggccctctagacctcaggtcagttcccctcccctccccttgcacctccaagggactccccgattttacttccgccaccaatctacttccaaccaagcaggcagggcatgggtgagtgtgtgcaggaatgtgggtcagtgtcacatgtacacacgtgtgtggcggcaaggcaggcgaggaaggggtgcgctgggtccctggtctggccccactgtgggccctggataccgagacataactgggggtcccctccccagcacattggtctccctgggctcctcaggcaagggagaagctgtctggtgtgcctactcaggggtgagcccctctcaaacctcctcccagcagactccccaaggctcagccacccacactgagctatcaccttcacccaaccctgttactctgagggtaacaagggggtaggttacaggggagacttaaggtcagactaaggggagcgacctgcccagtgatgacactggggtcaccagggcccaggcctagaaggctcatcactggccagggtgggctgcctgggagacgctcacacacctgcagacccctcagggctcactgctctttagcaactcttcctggctgcttccagactgggattccaccacccagggccatccccgcggcccaaggactgcctgctcctctcctgtcccgtgagctaccgaaatgcggacaacagtaggttagttccaaatcccatggagcttacaacagcagccatcatctcaggagacactgctttatcccagtggggtgctggagtgctaggcacctgctcaggtgactgcctccacgtctaaatgctgcagagacctctgtcggggtcagggcagcaccaaaaactcttgagccaagagacacacactcaggtcagctgaccttctgtttagttgcctttctggtcccttgcaaggccaagggggccagggaggaaaacagtttcctcagctattggctgggccctgaccctggtcactggcctcagctaccatcctctaaccaagcgctttgagtcacccacgtagaggggcatgtgctggggaacatttccagttgagggaacccgtctggaagatgagtggaagcaggggcaggtggggtgggagaagctgagcttggtccacagaggctgataggggctgcaccctgggctcccagccacatgtcccaaccctggggccttgtggagcacagaggaagcaggaggggaaatgagaggttttgagggaagaagcagcccagagtccacccaggcgggagggctgggccgggggaggaggaagcggggcctcaatggtgtctttgtggaagtcttgctgctccccaggcctcaggcgaggagggtggggtggctgcggtggggagcggttccaagaggcttttccctgccttataatcttccctcttggacagggagatgggtgggtttccaggctccatccgtaccctcctttcccccactttcctggccctagaggacctgggaccctcacctcagtggacccaggctggggtagggtttctggcagggaagagaagagtgaaggaccctcacttggcactgggcctgcacagccccccagccctagcagggctcctgggaggcatctcccatgttacaggtgaggaaactgaggctcagagagggcagtcctccgtgctagcctgtggagcagcggcagggctgggacttaagctcctgtgggtgtggctccagagctaggggctgtgggtgtcagcagggcacatgcaccgtgtgtgcacccagagaggcgtggtgggtttgcttgctgcctgtgaatcggaagtggagcatctgccaatggccccagtgggaggagggtgtgagagctggaccccagcctggggaacacacactctttcccttcctgtcccctgggactcttctgtcagggccgggtggagggggcagcgaggagggggggacagcgaggaggggagggaagcatctgctctccttgggcggtttggcagcccctcctctgtggctctggggctggccgaatcgggagggcccttctgcaggggctggcgggggatgactaggtccagaagccagtgataagtgccagccctgcccactggtgacttggaggtctgggaggagggtggagagacaggggtctgggtgggagctgcccccaggaggctgagggccaggctctctcctgggctgtgtccaggaccaggcagcccatggctcatctctgagttccccttggctctggcagcagaaactgctgaagacagggctgctggggcggcgtctcggggcttccccagcctggcgggctgggtctggagatagtgagtgtgtgagttgggatgggggaagaacagaggaaatggtgactgtgggtctggacggctgcctggacctgaaatctggtggcacaacttgtgcacagtagccttgtgtgcctcctcctcagttcccccatctgaatacagagggtgggctcaccccacagacagaagtccatgtccagggcagaagcctgggtcagggctcacacccccagcacacacacagggctcagagccatgtgcttccatgctttccctggcctcagtgtccccatctgtaaaaggggacctggatagagggactgacacacatctggcctctgaccagcccagcagactggcaagaggtgtggccactaccgtgggtacagtagagccacctctggcctaaatggccacaggtctagccagactggaagctcttgaggacaggaccagggcccacatctccttcccagggcatctgtgcagcaagaaggccatggacctgtgatgagggaggtgatgtcagcatctaagggaacgaaaggatcaaatgagatggcatttgtcccgtgtgagggtttttctatcaggcagagctgtcccaccacagcaagtcccagcactggtggtgctccagtgggagggcgttgccggggggtgcaccaggaaacctcagtgtccttgctagtgaagctctgggctacccaggcccatcagagatcccgagactgagacctctcttcctgggcaggcctgactcctcctggaataggttcctgcctagcacccccacctgccaactgcctggaagcctgcagcctgtgggccccccctggagctgtgcccaccgccaccacactccctctggccctccttttctctcccggcctcaggcccagcctctgctaatgcaccacgtctctctcactggcaccaactctccagggctccaggcccactgccagtgtccctcagatgtccatggcaggaacacccacaggaacccccaagcccaaccccacccaaagcaaggaggactcagtgtactctcccctacagctggctcgccagccccgtgaaggcccgactgtccacctgttgctgagtagacatctgagggtcgcactgaactctcctcctcctccctccccacagccactgctgattaatactcaggttccatccatccagtccccaaattctccttcaacttcatcttcctctcttgctccctggtccatccataaggcggctggccaccgtcctcggtctggcttaatcaatctcctgactccctttgctaatagcagccccagttaacccaaactgaaagccactccctcagcctcccttgcctttggtggctcccattgccccagggtcaggcccccacccccgggtggcactgaaggccagggtgccctcaactctgcctgcagggtctcttgctctcttccaaggacactccacgcctccgtctcactagactctgcactgactccgtgcacacctagcagggccgacctgctgccttcgctcaggctgggcctgctgctgggccagctcttctctcctgtccacctgtgaaatgtcctcatgctctttcaggaaaaaagcccaaagcaccttctgtgtccttggggtgcaaagacactcgctgcggcccagggggctgtgctgttgtcacctctctccatttacactgtgagccttggggacaagactgaccttgcttggggacaggacgtgggaggaaaggagggaggggcccaccagggcatgagggccatgggcccagtgggaggggctgcctctgggagctcgccccagccctccccaccttgtcttacctccagtctcctttccaggcctcctctgccctccagagccccagggctcagaggcaggggactggacactatggcctgggagggctcgagggactgccagagccagagactgcttttctgggcctgtggtgacagagtctggtgcttgtttttaaagaaaatagaatccgagcccctatttatagccggaggccacagccacagacagaagacggatggggtttgaggcttacaggcccctgctctagcatggactgggaggtggggccattcccaggcccccctgcccgcctttgtcaacccccaaggaagtgcctgtgggatcctgacactccctgggacaggatgtagcctgcactttggggcacgggaggacctggtgaggggagcggaacatttctcaggattggtccctggggcccagagtcccttgtgggaatgggaggaggtgagggtctgttatgtctactgagaaggcagagagggccctggggacgggtggggtgctggcggcagggagcacttctgactgccgtggaacccggtaaaggagaagggaaggagaacagagcaggactggagagatgggcagacagacagagagacagggtaggaaagacagacagaaagagatggaggaaccacagccaggggtgggaaaggacagagagatggagagagcgggatggggggatggactgagagatcgggggtgctctgcagcccgggtgaccctgcgcaggggcagacagaagccgtgaggggagactgaagtgtggcttccgtcccatagagtcttcatggtgctccaggcagcgtggtcagagtccgggtggagccggtgaggagggaggaagcaggcgtctctgtggcctcgcccacccccagcctccagggtctaggggctggagaccctccgttcccggcagtctccacggggaaggcccaggcctgttggaggcaacgcaatgcggtggggcagagcccagattgaccttgtcaccaagatccccaagggctgtcttgggcacggccgggaccttgagggacaggtctggtctctggcttgttatggagtgagttccctaggcctggagggctcacaagctaaggctatggcctggactcacacctgctgccagcctctacgcagacccctcccttggctgcgcttgtaggggctgtggggtaaccgtagcctggggcatgtgtcatggagccacaagcagtgactcagacagttaaaaaaggagcagctctgagtggtgactcaattggctctggaggggctgggtgggtctggctggtacaagatggggtggtctgggtttatttttggcagggcggggctggggccagggggtggaagatgggagccgggggtggagaggagccgctgctctcatcccggggggagccccagggctccatgccaacttaggaaagtggctttccaatgccagggagtcctggcaggctgggctgcttctcagccccattccaggcctagcctgccttgctgcttggcccaggacaagcagctggctctctctagatagaggcagaggcccctgtcctgttcccaagaggctcaagctcagaatttagagctgacctaggagactgaagattccacccagaggcccagatagggccaggggtctccccaaggccacatagcagggccaggtagcccaagggctgtggcaccatcagccagctggctcaggcctctacaatatctcgctggccccagggctgtccacggttggagggacagcccccgtctgagtacccacccctggaggggctcagccaggctccagatgggtggccagaagcacacgggccccagatgcccagagatggaaccttggccaggggcagccacctggattccattaaaacatgtgggtggggggcctggccgggccctgtccaggggtctgtggagaagagtcacctctacgtgggtgaaggcagtgggggcctgcacaatgggatcttgccctgagggctcaggcacaggcctgcccttgtccggggtccctccagtgtccctgccccgagctgtgcaccccactctgcagtcacctcagtcacctccccacacctccccctactctgagctcacatacacccataccactgaggggtcctagcagcccagagcggagagggctgtcccctccctcagtccggatttctgctcctcgtgatgcagccaccactgcttatatcatgagtggtggtaacagccccatggtgactctggcaggtgagctgtcccacgtccctgggccctggcctccagcccccacctccagagagggactcgcgaggggttggtagagagcagggaaaagacaggcttctagggtccccgtcccataaaaggtcttggggcctgctcattctcttctcctcactcacctgctctggggacagggggttcctgctgtgccccggcccagtgagccccatcctaggggctgttaggcttgggagaaacaggccctggggagggccaggcaggggctgtccccacttcttctagcactgagagaggggtgtgggcctcagcccagttagccacagagatgcagacccccaccccctcccaccttctgaagggtcctgggctggcaggcagccgctggctgataccctctccagagcccacctctccttttccatgtcacttagtcccacacagactcacggggccacctcctctaggcctttgcctcggaatcttccttaaacactcctaagcagaagtccccatgttgccgggccactccaccctgggaagaagatgctaatagcagagtgactgcagcttcaggagcagatgtccaccgagcattgattccaggcaaagtgtcttgcttaatccttacaacacgtaagaggttggaattatttatccccattttagagaggagaaaactgaggctcagaaagacagagtcacttgcccaaggtcatgcatagagcgtcagggctggaattcaacctgagctctctaatgccgtgtttcaccaccatgtgcctggcctcctgcttccctgtgtgggttcccacagctcaggactcagaggagggagagatggggcctgggtcagggctgaggggcaggggaggggctccctctcagctgctcgcagactcccaaaaagggtgatttgctcctccttgaccagggtgggaagtaaaagtgtgtgtgtgtatctgtgtctgtatgtgtctgtgtgcatatgtgtgtgtctgtgcctgtgtgtatatgtctgtgtgcgtgtgtgtgtgcgtatgtgtgtctgtgtgcatgtgtctgtgtctgtatgtctgtgtgtatctatgtctgtgtgtgcctgtgtgcgtatgtctgtgtctctgtgtgtgtgtggctaggcctcaggcctgcctggctggactctagctgcaggagagctggtctggccccagcaactgtgcacagggaaggggcagggagaagcgggtgtcgtgggaatcagtgtcctggtcccactggtatttatagctgccccttcctgaaatgtgggtgggggaaggggctgctcttaggtgggaacggaagttcgtctcctctccccagccccctctgtctccccagagagtggactggcccaggccagagggcctgccctggcgggggaacgaggcactgtgtcctgattttgggggttttccctggggctgctggctcggggcaggacactctccttgcctactgagcaatactgcgtgtgtgtgagtgtgtatgtgtgagtgtatgtatgtgtgtgtgaatgtgtatgtgtgtgtgtgagtgtgtgtgtgcacacacacgcatgtgcacttactgggtgtcaggctgaagaaggtcatgaaccggggacagaggccaggtgagggtaggggaagaaaggcctgtaaccccacagagatggagggcagggccccaggagaggggccatccaggtcatgggtctcagagcaatctgtggttagaacaggctcctgggggtggcgatactggagctgagccttggaggatgggggaaaagggaaggcctgttgcatggagcagcttgagtagaagtggaaaggtgccagcggttgtggattattatctgatggcctagttctatctgatcagccagtccgtgggacacaggatcaccttgaccagggaggatgatatatttggggagagaaggacatagcacagcacagttgagcatccctaatctgaaaattcaaaatccaaatgcccctaaatccaaaattttttgagtgccaataggataccaccagtggaaaatctcacacataagaactttttttttttttttttttagatgaaccctcactgactctgtcacccaggctggagtgcagtgacgcgatcttagctcactgcaacatctgcctcccaggttcaagcgattctcatgcctcagtatcctgagtagctgggattacaggtgtcgccagcacgcccagctaatttttgtatttttagtagagacagggtttcaccatgttggccaggctggtctcgaactcctgagctcaggtgacctgcctgcctcagcctcccaaagtgctgggattacaggcgtgagccaccgcgcctggcctccacacataagaacttaacataaatttctctcaggcacaaaatttctttaaaaaaatctataatgttaccttcagcctatgtgtataaggtgtatatgaaacataaatcaatttcatgtttagacttgggtcccatcttcaaaatatctcactatatataacaaatattccaaaagccaaaaaattccaaaatctgaaacacttcaggtccccaacatttcagataagggacactcagccagtgtggagtgagggccagcaggcagtgggcaggagtgggaagctggggcaggagaggccacacagccccaggcctgctgtgaggaagctgggaccaccttctgctcccggcctccaggctcccagacttggggaaggacatcttccaagggcccttagtaccaatcttcatggaacccaatctataaacaggtttgtggagtggctctgcatgaattggggtggggcaggcgtcccatattcccaagctcagctgcctccaggccggctcagctggagagccctggggtgcgctggagtgcagtcagaaaatccctggttggctcagtgatctctacacccctctgggggccaggctgtgagccctacaatgggggagacccctgagcaaagcaggtgggatgtgtgctcccggggagctgctggtcctgagggtgaagctaccccccaaaccagggccaaagagtagggagccctccccctaatctcctgaggactcactgtgtgactctgaacaagcaggctcctctgtctgagcccgggtttccccaggatccatggggggctggtctggggtcaggggtttctgcagtaagttccgggaagggaggcagcgtcactgacacacctcaaccttaggccgcaggagagccacacactgaagtgttgaagcaggagcgatggctggaggcctggctaacgcatgcatgccagggctggcagagccagcggcctcctccacaggctgggagccggcctgggtgtgggaaggagctgagcgagaggcaggaatgctcaacaggacaggcactgtccctgatggggcccacccctgccaccaggccaccttgacagcagccctacagctatcaccctacatcagagacaaaagtggcttcattggcaaccctagctttggggggagagggttttttgaaggggatttgcttaggctgtgagaaagtggggagggtttggaaagggagagaacgctggctggtgggggatggggagacagaacaaacatctggagtcctcagcgagctgtctgtccctgcagacctctctctttcccctgctggggcctgagcccactggtgggtggttgtccacctggcctgatgtggggaaactcgctgctgttggggtgagtgagaacaccacggcctgtgtgcccaaagagagacctgaggcagtccctgcttttctctgagcctcagtttcctcatctgtaaaataggactgttggacaggtatggtggttcacacctgtaatcccagcactttgggagtcccaggtgggaggcttgcttgagcccaggagttcgagaccagcctgggcaacatagtgagacctcgtctctacaaaaaataattaccctggtgtggtggcacatgcttgaagtcccagctactcaggaggctgaggtggggagatcgcttgagcctgggaggttgaggctgcagtgactgtttcctgacctgcagggctgctgtggggctgcaggactaacaacatggttagtgcacactatggggtgtccctgaaggtaagagcacagcaataagacagctctgtcctctcctgtttggagttacggaccctcctgagaagcggagagagctaggaacccttgccccacggaggagccaagtacaaaattgttcatacaaattcagttcattcaaaaattcctcatacaaactcagtaggaatggtaatacagtaaatctgaaacctgccctaagcctgcagctggaggaagagccttaactctggaaggctctattgaactgacatatgctggggcggagggcatgttggaggcaagaggagagctggatggggcgggagtcagggggaaaggcagtgaaggagcagagggaccagggagggaccaggcctcagtcccatgcccacaggccccttgttcatttgcccctggccttgaatagaagacacacctcaggtggcacccctgtccccatcctgtgctcacttccttccccgcaagtgccactggcccagatctttaaggtaggggacttggagacagaggcagtagccacctcgtccaggtctgtgagagtggccgtgtgcaagtgtgtgtgcccacatctgtgtgcgccagtaagtgcggacgtcaaggctatttccaactccccctcccctgcccgcccctcctgggcagcacgcccagttcccagacacagcctatacacttcctctgagagctccacacgcaccctactcccctcctgccgtcatcgacagccgcctggcccacctggcatggcccaccccaggccccccaggcgggcagcactaaaaggcccttcttgtcctgcccgggcgggcaggcgtagggagggaggctccgttacacttgctctagaacagtttttctcgagtccgggtgggctgggccaagggctctggcccctgggccctgccctgctccggaggcctggggtggcacacaaggtgcacacaaggctcagtgcctgtcccgagcaccatcggtccccccaagccatcctcagaggcagcaggatctaccctgcttcaatttcttgtacctggtgtccctgtggccctgctcactaagatacccccatcagttctgagtccccacccaggtaacacacaagccctccctgccaggtactccccaacctgggtcccacttcaacccctcacattctgcctttcagtcagtgatgccagggaagaggtgtgggagccaccacccctgcctgccctgtgctcactgtgaccccccgactagaatgtcacctccttccttctctgcctgtccttccagtatcagctcaaatccaatctcccccaatgcttggctctctgctggggcctcccatacagctcagaaggagctggacaccgcatctgtcacccacactgtctcagtggcccaagcctaggccccgacgcaggctgggagcaccctcgaagcagggctgggggctcttcctgggctgctggggttcttggtggaactcagagtacttttcttcctctctggggcctcagtttccctctctatacaagtggaagattggcccagatggcctctagggtgctgactgccaggccccctgacctggatgcctcaaatgttgatgagtagagggagagcctcccagcacgcctcattcggatacgggaggacgagggcctttgcagccaggggcatccaggaggggtgggagggacgccttcctcaggcaggggctgcccctactgcagaaatcagggcaggcagctggaccaggagtggtgacagagatgggttgctggacgggagctctcacagcccctcctcatttccgagtcctcctaaaggcaggggatggtgtaactttataaaaccccacagcaccatgctgctctcttgccctaaaacccttgtggcatctcctttgccaacagggcataaggccgtgggcttcattttgccatttaaggcttctgtgccccagcccagtggttctccctggcctgtgctcgaaatacgcctcccagccaggctgctggccttcctgtctcaacacccctctgcttacgcccaccttggtgcctctgagtcagcgcccctgcctggaggactgactcccttcccatccaccaaggcttggtttgaggcccaccctgtgtcctgccccagcttgcccctgcttttctcccctctgtacttttcatccagatttttgctgtttgagatttaatttgcctttctgcctcctgaatgagtctcagttcagcctctcaatttcccgtgcccctgcgagcctagcaccatgcctgcatgctgtcagggctaagaaggtatttgagaatggctctcagttgaagcccaaggaggtgggggtactggaatccctccttggctggaggctggggcctgaatgagctgaccaccctggtcaccttggatgctcccttcccatctccctggcggcccagcccatccctcaggccctgagatcttaggggatctggtccctgcaggaacagggagcctggagatccagccctgattcaccccgcgggggtcctcccttgactcacttcccttctgggaaccatgtgatgccctcttttagagctggcttctccatctgaaggagagaagggtgtggcctgggcccttgtgaaggaggctcaggccctgcctttgctccatgttgctcttgggaatgatctcgaaggtgtagctgaagcactgaatcacacgtgggtagtgatgatggatgggccctaaggccacagttcttatggcataactagagctgccttcgctgaaggaagaatgctgtcatgttggggtttctggcatcgggacagagaggggatatatcccagcacttctcggaaagcgaacttccattcagcctctgctgggtcaggcatcagtgctgggatgaggaggtgtggcagggggtggtccagagctatctgtaggacaagccccgctgaggggcaccagctctccctctaggaggctgagagtgggtagtgggtggggggtcctgcctgtcaccaacaggaggagggagaggagagaatgaagaggggaggtggcagatagacggatctgcaaggaagcaaggggaggaaagaaggggcagagctggggggcagctggaggggtgtgggggtgctcctcacaggggagggcagggtggctcattcctcgtttcccaccttgtagcactccccattcctggcccagggcatctgaagctggaggacccacttctcactgtcgccgggtccctttggaccccaacatactcaccccaaacttgcctggcaaacaaagctcggccagcattggggtggccccactggtgtctcagacaatccaaacgggcaaagccacgccctaggcaatccatgcctggggcgcctgctcccgcccctaactggacagccttggctagctagaaaccccataacctgagatagcggggtcccgtgtccgccccaggattgaacccctggcgaccccagctagtggtgggagaagcgcagcctgcttgactcccgatctgggggccacttctggctcctcctgtcccttttccctcccggaggaacccctctagttccgccaggctgggtcggggtctcaggcccctcactcacccgcggatgcaagtctggccaacatagtcagggtcaaagccaaggccaggccgggggctggaagtgggggccgcggcccggactgcatcccggcgggctgggcggcaggacttgcgaggagccagcggagtcctgggagctgggagctgagtggagcgagcgcggctctgctcctgggcgcgggccggctccgggtgtccgcgcacttaactccgggggcggggcaggcgcagacccgcgcgcccgctcgggtttcaggcttggactcccccacctgcccccaccctcaaccttcttaaagggcccgtgcggggctgttcctctctggggcaggggtgagggggcccttgcagctgggccagaccccagccccaccctaaagacttagaacaaagtcatagagaggcccagacaccctgaactctggccccaagagccgagcccgggagaccccctcagggaggaggcatgaactgtcccagcccctacttccctcctttctgcctttgcgggagttcaggagacccctccacaggcacactccagccttaggaggaaggacagacaccagccaccctcacaggcggcttttgggctgctttgcctcggaggtcccctaggaacttctccagactccagaggcaccacccgaggtcctgtggggcactgcccatggctgcaacagtgaccttctctgcctggaagggcctcacctcagtctccctgtctgtaagggagagatgtctggatttcctcgcagggcagaagaattctcagtcccgccatgacatttgcctcaaaataaccttgcaaggtgggtgaggagcatcccctcccccatttcatggaggacgaaagtgcagctcaagctgaaagtggctcttacaagactccaggtggaaagtaggtccctggccgtttggtgccagaagcccaggcctcctgacccctgaatccgggtgtttcaacttcccgaggctgcctcctggaaatctggccctggatttggcttctacctaacagcttcaggctggggcccttctgctggctcccttccaggcagcaacatcagcctagtcccaaacaggaggagaaagggcaatgttacttagcttccggtgcctagaggatctgcgtgttctctgtccagtcccaatgttaccgggccttggtttacttcctccattcaggtccctccatctatctgctccagcccatctccagcccaaccccaccttgcaccctcttcccagctcttccctttgaccagtaacagcccagcacttcatactttgcaacgaaactgagacctgttttgcagatgaagaaactgaggctgagagagattaagggactggagctagtctacatagctgctgagatgtggggccaggtctttgaccctaagtgcagtgctcaggtgtgatggtgcctggtccatgtgggggttatgagtattggtcttgaaaccagagagacctgggttcaaatcccagctcccttacttggttgtcaaaccttgaacaagtcccctcacctctctgtggcagtttcctcatttgtaaaattgggttaatgaggattaaatgctttaatgtacctcaagtccctagcccagggcctggcatacggtaggtgctcaataaatgcttatcctttctcctccgtctctgtcatcctgcacattccctgtgattcatggtttacatacagctttacacatatcacctcccttgttgtaaagcttgaactttctcctccagaggctgctgcatacagtaggtgtacaataaatgcctgctgtagttgactaagaaaccaattgctgctgttctgtagggattttggcaaacctaagagcttccatccaggtgccctaggaggcctgggatggaggctgtgctaggctggcctcagtggcggtaaaggcattgattccacaatttgtcccttgttttttttttttttttttttgagacagagtctcgctctgttgcccaggctggagtgtaatggcgcgatctcggctcactgcaacctctgcctcccgggttcaagcgattctcctgcctcagcctcctgagtagctgggattgcaggtgtgcaccaccatgcctggctaatttttgtatttttagtagagatggggtttcaccatgttgaccaggctggtcttgaactcctgacctcgtgatctgcccgcctcagcctcccaaagtgctgggattacaggtgtgagccaccgcgcccggctgtcccttgtttttccttctcctcaagtcggtaggacacctggtcctcattaggggctaattactgacaagctatggggctgggggtgggggtgctgcttggaagactgtgtttggaggaaaagagctttcttttcaggaatgaaaaaataagacagaaggctttttgctctatgaatcaaaaatctgggtgaagatctctgctggccccatctcccccccccaccccctccccatcttccctgctccccacctacacagatgtctgtggagcctccagacagggtgctcccacccacagctgagattcaagtctggattagctgggagcctccccctgccttgttgctagctgggcagagaaacacaggcctggaaaataatggcaaccagcacagcggtaataacccggctggcgcatctctgctggggcttcccagtttacaaaaaacattcacttggtctcttgacaactttgggaagcgtatgtgttggccaactgtgtccctgcttccagatgaggaaactgaggctctcagtggaaaagggatgctgcggctccagcgcacacaggcctggcctttgctcagccgtaacctagggctggaactccggaccaatgctgagcagcatcatgccaggcagactggcagaaagtcgaggtccctgtgtgcctttggaactgacccctgaccacctcccactgtcttggaacaaaggctgctggaccagctgtgcctgctcctcaactgtcccctctccagctcctcagcaagctcacccaaggccctgaagcctcagtgctgaacagagctgacctgggcctctctggcatcctcaggtctggctcgggccttcttccttctgccctccaacctttcccatgactttgcttggccaggcatccttggtggccatccctgactgcccctacctccctggccacatctcaccttcctccagcaagccctcctagccctccttcgtgctcgtcgacttctctttcaaaagattccctggaatcctgatctccgtagctctcctagtttcacctggggcctgcttagctgggtcaggaggtgtgcgtccatgcctccccagccaagcatgggacagagcacagggtgggagggaggaggaaagaaggaggcttagaacacacttataagaaggaagaaggatgttcccacccaggggcaaaagaagattcaaacttctctgaagctacagtgacctgtggtatgtgctgcctccatttctccaattgttcttggagaacaagacaacagagggcccagtaatactcacctccctgccagcagagttcacccaaccatgctggccaagcactgctggtcactcctacctctagtgcttcttggactaagagtccccgctctgggcagtggctgtggtttggccccacccttggccagggtgttttgcaccctcgttgcctgggccccacccaagaagcctgtggccaaagccagcttgctgggaaatggtgtgtgcctgtgccctagatggggtggtgcctaagcaggggtgtgctcctgctgcccagggcccgccctcagggaattggccctctgccatgaaggtcacagaacctaggccactactgtgcaagagggcacgggctttaggcgctggctcagtggccctgcagttttctggccaagagctccatggcagcgggccctgggcctgggcctttgacctggggcctctgttaggagtggtcctgatcctgcttctggcagaggcacacacagggctcctccaagtacaggcagccaggctcaggatgggagggagcagccagtcccaacaattacacagttcgggagctgaaaagttatgtttgccactctcaggagccagctgtggaagggaggccagtggagggctttgccctggcctctgagccacacacaagccgtgctgggaggacaagggccgggggtggtgaaggaccctcttggagcctttgctttccaggagcaggcactcgtcttccatatcacactcacaaaggctggtggcttcagtggctgtgaccagctggccacagctgactcctctggggtagtgctgtttctaaatattagttcctgctgttaacccttgctgtgcggccccagtggacagccggctgcctgcagacagagcctcttggaagtagagtggacagtccccacctggatgaaaaatttgtgagtatatttgcttgagggctgggttggggctcccagaaggagggtgagaaatacctgcttagggctgggaatgaggcttgcagtagatgtcaggggatgtgggtctgagctggccactgggcagggcagtggaaagaatgtggggtcaggagccaggagcccggtcctgccaagcctttttttatgtggccccagacaagtcacttcgcctttctgtacccctttcctcatccgtaaaatgtacagccaccgaggtgcttggatgatggcctccaacagaagcgccggagctttataaactctgaagtgcctggtggttatgatgatttttatgccagggtcctgctgtctgtgactcccccgagtcccttggaggagaggcaagactgacaaccaagagacagctggagcaagctggcggggctgctgttagcctgtgtggagctttagtggggacaccaccctatacaagaatacccagcttggagttcagcccctactggccccattggctcttgtccttgcacagtgaaaagcctagtggtagccaggctccaagatggccctcagtgagcctcaccttctggcattcatgcccttgggtagctccctctcatgttgaatacagccaccttatgcagccaatagggtgttgcagaaatgatgaagtgacgtccaagatgaggtcagaaaagatatggtagcttttcccttgctctcttctgattgcagccaccatgatctgaggataattaagtagactgtggaggtgccaatgtggagaggaactgaagcctcttgccagcagccagtatcaactcaccactcatgtgaatgagccatcttggaagtggatctgccaaccctaatcaaatcttaagattaatacaacctctactttttttttttttttttttttttaagatggaacctagctttgttgcccaggctggagtgcagtggtgtgatcttggttcactgcaacctctgcctcccggattcaagtgattctcctgcctcaccctctcgagtagctgggattacaggcatgcaccaccatgtccagctaatttttgtatttttagtagagacggggtttcaccatattggtcagggtggtcttgaactactaacctcaagtgatccacccgccttggcctcccaaagtgctgggattacaggcatgagccaccgtgcctgacctctactgacaccttgactgccacctcctgagagacctggagccaaaaccacccagcaaagtcacttttaaactcctgacccacagcaactgtgtgcaacagaaggaagttgctgtttcaagcaattatattttgaaagtaatttgttatgcagcaagagattactgatagaagccagcacatcgtagatggcagtccagtgagtcagacctggcacgtgcctggggctcagaaagcaggactctgcttccatgaaaagaagtgacattccttgatcaacaaattcattcattcaacaaatatttcttaagcacagatcatatgtcaggcactatgctgatgctgagggctggggacacaggtgaataaacaggaccctggttttggggaactgacaggctccccaaagtgacttggcaattggttggatgtgggagttgggataagggaggtgtccaggacaagcctaggtttctggcttgggcacttagaagggtgggtggtggtgtcatggattgagatggacagggactggggggtatctcataaggaaatcttggggcatgttgatttcaaggtgcttgtgagaaacccaggtgacactgtgcaggcggctgtatatgtgagcctaatgctcctaagaaggtctagtcaggggaagttttacttccggattgctggggtatcgataagggaattaaagcaaccagaggagatgaggctgcccgggagagaggagcgcggtgcaaaatgggaggaagacccagcactgagccctgagacaccaacgtctcttccttaaaatgtttattttgacataatttcagacttagataaaagtggcaagatgattacaaatgtttcccacatactccacctagatttcccaaatgttaattgtttaccacattttaaattcttttctctctctctctctttttttttttttagatggagtctcactgtttccaggctggagtacagtggtgcattctcagctcactgcaacctctgcctcccaggttcaagcgattctcctgcctcagcttcccgagtagctgggaccacaggcacgtgccaccaagcccagctaattttttgtatttttttttttttttttttttttttttggagatggagtgttgctctgtcgcccaggcttgagtacagtgcagtggccccatcttggctcactgcaagctccgcctcctgggttcacgccattctcttgcctcagcctcccgagtagctgggactacaggcgcccgccaccacgcccggctaattttttttttttttttgtatttttagtagagacagggtttcaccttgttagccaggatggtctcgatctcctgaccttgtgatccgcctgccttggcctcccaaagtgctgggattacaggcgtgagccaccgcacctggccaattttttgtatttttagcagagatggggttttactgtgttagccagggtggtctctatctcctgacctcgtaatttgcccgcctcggcctcccaaagtgctgggattacaagcatgagccaccacacccggccatctctctctctatttttctgaaccatttgaaagtaagttgcagacataatgctcctttattcctaaatatttcagtgagtttttcctcttttttaattttttttttaaaatgagacagggtctcgctctgctgcccaggctggactgcagtggtgccatcagagctcaccacaccatcaaacttctggactcaagggagcttcctgcttgagtagatgggattacaggcacacaccaccgtgcctggctatttttttttttcttttttggtagtgacagggtcccactgtgttgtccaggctggtctcgatctcctgggctcaagcagtatttcctagaacaggaccttctctttcataactggagtgcaatgatcaaaaccaggaaattaacattggtacaatactttgaactaagccatagacttttttctccccagctttgccaattttcccaaaaatatcctttataacaaaagaaaacctcggctttcttctgagtgtctattcatcttgcatggttcttcagcgtttcattgtcttccatgatgttgccatttttgacaagtacaggccagttcttttaggtgaattttggtttgagtttgtctgttttcctcatgattaaattcaggttctgtattgtggcaggaatgcctaggaagtgatgccgtgcccttctcacgcagcctatcaaaagacacataactggctgggcgtggtggcttacacctgcaatcccagcgctttgggaggccaaggagggcagattacttgaggtcaggagttcgagaccagcctggccaacatggtgaaaccctgcctctcctaaaaatacaaaaattagctgggcatggtagcaggctcccctaatcccagttattcaggaggctgaggcaggagaattgcttgaacccaggaggcagaggtcatagtgagctgagatcacgccactgcactctagcctgggtgacagagcaaaagactctgtctcccccaaaaatcccccacaaaaaaaccaaacaaacaaaaccaagaggcacacatctattgtgcaatcattgggatgttgactcgtatcacttggttgaggtgatgcctgccaggcctctcttctataaagttactgtttcccctttgcaatgaataagcatacgccaacattgaaaggtcaggttgaggaaggaaggaagccaggaagaaagccagtgcaggggcagccgagagacagaaggaaagaaggagggcgtcctggagccagcaggaggggcagcatgagtgaggcagggctggcatttattgcattagaggatgaagagtgtcccttggaagcagctgccacctgcaggtggcgggcgtcgagttaagcctctttcgggtggagcagtgggcctggagccaactcaggctgagtcaagtgtgagagggaggtgagaatggagatgactggaaaacacctctgtggggaaggtggtctgtgggctgggcagagagggacaggcagtgacggagaagcatgtgggcttgggggacagtttgaatagatagaggggacttaggatatctagagtgtgacaggagggagccagatgagaggcgcaagtccaaggagaggggtgcaatccacagtgtcccaggcgggacgtgggagccgatgacaaaagacatggcggttctgaggctgtgatggggggtactcgtcagagcccagcctgatggggcaggtggatgggggggccggaaggatggccaggcgaacagaggagagtgagccatgcaggggatgatccctgggggtgggggagagggggagggcaggctgcccagaggtgggggtgggtggcaggtggcgaggagggcaggtccaaggttctggccatgagactgtcctgacagctttagctgcctgatgcagatggacaacgcagacctgggggacgcagtgctgggatgttccaggaaaggggctggatgaggagggtggtgaaagctggaggggcctgaaggatgacgcagaagtgcagggagtgcagggtcagcactggggtctcagagatggggggcaggggatggcctcccagagagactggctgtcagtgctgtgggaggtggtgagaagcccaggattgcagtgggggaccggcctgtgagggagtggagtggaggtgtttgcacatgaggaggtctgggaacggggaggccagggcattggtggtggtccctggggaggcctgagctatcagggtcatggcaggagttggggtggggtggaggtggcctcgagccacggctgctaggtttatgagtagggacccagggcagccctgaggagctgaagggggacacacctggatgccagtgccccagaggaatggggcatttgatggggagggcacagtctggggaccaaggcagccagagacccacggcactgtggactctgaggcatgagggatgtgaatgtcggagcagccagctttggacagggccgagggccacctccaggggtgagctgggtctccatcagagctggaggaaaggaagcatttggaacaaattggagtggcttgtgacctgctggggtgcggggtggcctagtttcctgaagagctgtgcaccaggatgatggggcagaagcagtgagggaggaaggcaggaggctccccgggcctgaaatacttggagactgcccgctcaccaggaaggtgggggtcccagccccagatccggcccctctcagcactgggataccatcagggctcgcagcttcctacaggaaaagctgacgcggatggggctgaggacatagcattggccctggcctgaggccagtgaggctgggtcaccccccagcctggctcagccctcccttacccagaaatcagaggtttacttgccccatgggcatatgggggcacacagggtctgctgctggggggactgggcccctgtcctctgttctgaggcctgtggtccctcaggggcttctggacaccctgcatgcctgtcctacctgctgctctgagccctcgctgtgcctgctgactggaatgcgttcagagcatggcttggtttctattcaatcagagactatgatccaaggagagccctgggttttgtgtcctggttccatctctgctattttgatgtagtaggagactttgggcaagtccttgttcctttccgggcctcagttttcttaactgtgtactggggtggtgacagacacccctgtctaaagccagcagtcatctggttcctgagatggacaccgctgacccggttcaggtcaaatccctagtctgttacgaacagtggaggtgacaggccccaggcccccaaaagcctcctgggttcttaggaatgaagaggttcccagcatgttttcaggcctggggctcatccatccgtcagatggggctggctgccttccctccccttctatgtgtcctctcataccgccctccaactccaactgctcccctgccaagggagtgctcttggtcacaggcacaggaagcagccccttgaaggctcagcaccacccctctgtcctcctttatttgcttcccactcctttttgtatccattgagctagacatggatctctaaagataccacaccctgggataggattctggggaggagctatcagacagtcacaccttagtgataattgacttgatattttgccaggggaaaaatagacttgacagaagagagggcatgtccagagcctgggaggtaggtgggagaggcagggggtagagagcccccagggggctgtgtgtgctgcacaaacccttcacccgtgacccaccaaccctttccattcctttccccaaccttagggcacccactgggagtgaagcgctagctgatacgtaacaccatctctccatttcccttccctgacccagggtcctggggacccccaggccacttggcctggttggtgatgggggacagtgggatagtcagggttccataactaagctcccagcatagaatttccacgccgcagttcaggcgccatggcaaccaggggaaataaacactacgagtttcacagtccaagctctgccgtgacgtcatctccagctccagcctgctggggcctgtgctgactgtgccccagacagccttagctgctcaagctggagaactgtcttccttcccagcttcctccgtgtctggggtgggggatgggggggtctcaggcagggatactctagccccttgactgctgtttagaccctgctgtagctgctgctgctccctgcccagccccagccatgaaactgcccaaggggaccaggagctctgtgtactttgcacagcacccagaaaaggagccattgccctcaaggcaggaggtcaagcagacccctgtcatcatggccaagatcaaaggtgagagccatccccaccctgggcttgggccccctcccctctctccaggactccttccagcctgcctcctgcaaagccccttccaacttccttgaagccttacagaagacctgagcctccaagctgaccctcacaggcagtgttggctgctgggattgtccaagtgggtgggggaggaggggagcatgggacttgcagtgaggcccgctttggaaaaagactaggagcctttgtcctagctttagctttcctcacttcccttcaattttactctcaagggacagcagacgctaattcttactatgttggtaatgactgactagtgctctaagtgggagtagtttagtgcagggattgaaggtttgggttctactggatgatggtcttagaatcttcacactactagtttgtgatatgtgggtagatatttctaagcctcaatattctgtaaaatgggaaaaacaagagcatttaccttacagcattgttcagaggcttaacggaaataatccacgtcggatgcctagtggagaacctggagcagaataagttctcaattaactgtaactattagcttcttattatgcattgtctgtccaagggaaactgcattttatctggaaatactgccttcccccaaacgaagcagctggatggatgctgggctcgtggcagtgcgatagcagcaagaacaaatacccccaatgttcccatggtgcgctgtactggggcttcccctgcctctgacctggtgggcccaggctgagggctgtcctgtccatccttacaggtccggggcccgccaagtacctccggccatcctgcacgggctacatagatcatgacatctccatgttcaaggcaccagcttataccctgcatagccggcactcagagaagcgtgagcgttgccaccccagtcatccggctggggttggagctgttgttggaggttgaggggagagacatggagccattctctgtagccactgggaatctgagacactcaaggggccccctgggtccagaggaagccagcggggattgagggtggggcaactccatgggcatcccctagccgcctctcccaagggagcctataggggatcctggccctgtccagctggcacagcagagtctcctttttctggcctttggctggggcccttcagctccggtcgccatgctctgctagggtcacttgccattgtggccaggcaggaacagctaggaggccagtggggaagtggtggcccccagagctcctcaggtggcctagaacccactggaagggcagaagcagaggccacagatgacctatgctgctgggcagggtgtggtggcgtgcacccgggggtctgagatctggggtgcctgtcaggcctttccctggggagaatacccacctcagcaaggtaagcccctggcctggctgggcctttgctgaatgcccacagcagccacagggctattactccccgttggccccaacccctgattgggtgggtggctgcccaagctgctgggcagctgttattttactgttcctctgagcaagttcttgaaaataccaggtcatgtgttaaaagtcccattttacagatgaggaaatcaagggtccccaaacacccaggagccacagaatctgaagtgggagggagatcttgcctggaggcaggccaggtgctcagtggggcagcctttggggctgaccaggccctctccttggttgccctgcagggatggtgtgccacagcagccctgggccttgctatctcttggatcccaaaataactcggtttggaatgtccagctgcccgcaggtccccatggaggagcgcatctccaacctgcgtaagatggggttatggacagatgttgggggttgggaggttggggggtggggtgcacccttaggacctgggcaggggcaaagggtcaagacttcctccttggaaatgtctggatgccggtatctccctgcaagacaccgacattgcaatgctgacatcaccatgtcttgaagtcaatgttatgacatgcagcatgtcaccaggtgacgttatgatgacatggagctcctgttgtggatgcaatattgtcatgcgaacgagctcacagactgtagtgatctcagaatgtttctgtgtcgctgtcagagggacaatgtctggatgctgacactgtagcaactgggggtaatccaaggggaatgttatgatgacattatggttttttacatgatgaccactgtgttgccatcctgatgtcaggatggcctaagtgaccatcttatttatttattatttatttatttagatcgagtctcgctctgttgcccaggctggagtgcagtggcgtgatctcggctcactgcaacctccacctcctgggttggagtgattctcctgcctcagccttctgaatagctgggattacaggtgcacgccaccacgcccagctaatttttgtatttttagtagagatggggtttcaccatgttggtcaggctggtctcgaactcctgatcttgtgatctgcctgccttagcctcccaaagtgctgggattgcaggtgtgagccaccgcgtccggcctaagtgaccatttggatgtccctgccctgctgctgaggtggtcagcctgaggtcacagtggataaccaggaccatcagttggctagcagagaatgaggtctgttccctgctctgagagccctcccttcccgccactccctttcaggcctgaaccccaccctcgcatcctgccagtactactttgagaagatccacccaccgggggaacgcagggctccccagtacacgtttggctaccggcgcccatacagagtgatggacctcaacccggctcccaaccagtaccagatgccactcttgctggggcccaacacccctgtcagccgagctgctccctgctacagtctggcctccagggacaagaactggttctacaaggaggatgtggcaggaggccctggacctaccacgtacgcccgacctgagccatccatctatcagaaccgcagccctacttacagcatggccaagcgcttcgcctaccctctggacctcacgccacggcctggccccggctcccacgaggtccagcaggtcactgtgcacaagccccacatccctgctttcaccatgggcatcaagcactcactccacctgtgcccactggtcatcgacattcgtgactgaggcccctcttggggcactcactgcccctcatccccagaaattatttttctacaccaaattgagcaatttgaccaagatttctagtagcagagccggtacctgctgagtgtccggcacacagaagacattagagatacattttcatgtatttgttttttccttttctgttcacagttgcttcctgtgggtcctgctctgggtgaggggctggggacactggaaggaatgatacagtccctgtccttgaagagttccattctggttcaccaggtggggaagccatgtgtctgtcctccaaggagccccaggcagagactcgggagagctgcattccagtcctaactgccattacaggctgtgtggccttgtgcagctcctgcccctctctgggctcaggattgccctttagacagtgcacagggtaggcttggaagaggtctaggttctcccaagttccagaactgtgggactgtgctgacagtgtgcagtccccgagacaggggcagggcaggtcggggtgcaggcagaggagcggagtccctctggttgggagttgggagaggagtttcctcggggagggacctaagaggacaagaggagactgctggggagggcgaaggtggaggtcaaggtgagagcaaagcatgcaggtgcagtgacagggaactggggaggcacagagcagcaggggcctggggtgcagggggcgaggctgctacccggggccacattgtgggcagccgggaggggcctcgggctttgccctgaaggtgtgagggccggaagatgctttgggagaagctcggacaggatgggcagagtgggaggcagctcccagctgggcagactgcagggaaggtcagcttgtcacatgctgtttttggggtcactcactatgtccccaacctcaacagcttagcctggcagtgcctgtcagaggagcagccgtgaattagccaggagggggcagcgctgtctcaatcttcaagcccaggcctgtgcctacccaccctggctggcacccgctctggctttgctgctgctgggcggacaggcgccagctcctgttggtcttgaggaggtgagggtctctggggctggcatttgtccttcctctgttcttggcatccagagccccaattcacctctactcctggacacaggaacctggcagtcccaggccagtgtgaggcatggaggggatgcggctgaggtcagcaaagaggctgggtgggagggtgggagccatggagggagtgggagggaggaggggggtgagaaagcccccagacctaatggctcaggcagaggcagactgttccgcagagcagagggtgacaggaagagagcaccgcctcagaaccagtgtctaatggttcatccttataaacctgaacaatatccaggttttaatttaaagtgaaaattgaggctgggtgcagtggcccaagcctgaaatcccagcattttgggagagcaaggcaagcagatcatttgaggtcaagagttcaagaccagcctggacaacatggcgagaccccgtgtctacaaaataaaatacaaagattagccaggcatggtagctggcgcctatagacccagctactcaggtggctgaggtggggggatcgcttgagcccaggaggtcaaggctgcagtgagctgtgattgtgccactgcactccagcttgggcgatacagcaagaccctgtctaaaaaaaagaaagaaaagaaaagaaaattgaattgaagccctaactttggtcagaaaggaacagagcatataatattctttggaatatttttaaaagcacacatacaactaaatatttagaaaagagcctgtggtaaaccccactagggatgtccttgattctgggccctgaggtctcctctccatcccacccgcccccaggccctgggctttgcatctgcccatcctctcaacaaggatggcctgggctggctcttgggaggctgtgggagctcggggacccgtctgtcttgtggcagattagaaagatgtcattttgccaacagtgccatttatcatggcagctgcaaaaattagtgatgcttggtgtgtaagtgttgggtgggggtgggagctggcaggtgacagcagccaatgctccccagtgttaccaggtcagggaactgcaggccaacctctgaataggggctttctgatttaacacttagcccaggtgaaggccctctgttggaaagatgaggaagctggcgctcggagcctggaaataacttcggccacgtgataatttttttttgtgacaggatcttgctccgttgcccaggctggagtgcagtggcacaatcttggttcactgcagtagctgggactacaggcacatgccaccaaacctggttaatttttaaatctttttgtagagacgtggtcttgttatgttgcctaggctggtctcgaactcatggcctcaagtgatcctcctgcttgggcctcccaaagtgggattacaggtttgagccaccatgcctagcccacatgacaaattaatggtccatctctaaataaaggtctaggttctgtgtgtgaccaggaccagggctcatctagggtgaagtgctttacttctattaggagtaagtattatttttgcctttatggctcagtctaggacagaccttcagcctggccccagctgccaccagacagaggcaggattgggagctggccctggagctaggactcactcttggggtaggtttatggtcccaagagaaggggagaaggaggatggagggttcagaaggaatattgggggggggtgaagatgttcagatgagaggtggccccgcaatcaaagggatgccgactccagggaagatgaatggggcctcccttgtgcctcggcctgcaaaatgacagggtcatttagcttgggattgacctttggatgaagcagtcccatcacttgacattgcctttcctgtggtagtgcccccagagaggtgacttgcagaaggtcaggcacggcctcccaggtctggccgactgctgcgtggccccttctgaacaactcagggggttctcgcttgaccttgcaggaagccctggtttgatccttgtaggacttgaatctgtatcttcaggtcactagactccggagcctggcacttgatcacacacaaagcccccatccgtgcattcattcattcaacaaacatttgctaagctcctgccctgtgccaggctctggctgggtccgggggtacgaagacttggtcttcacctggagccctggcctccaggaggtctgaggctgtgtccgtgagagggtgggaattcaccctctcccaccacgagcagatgttggagggtggatgaggctcggtgcctggcaggagacccacctgaggttcctctcttctctctagggggcaagacaggcctggctccatgttgggttacctcagccagggcttggtggtgacatcacagtcccacgagcctcttggacactggctggggtgggggctggtctgttgttccactgttgctggagggaaccccaaggccaatcaccactcaggttcccaggacctggggggatggtggccctgggccaggagcagaagaggggccctgcctgcagggacacatggacacaccatctggaggcacacaggtaggggctgtgcacacacacgtcccttaccgcacacacgtggggcaagacacacacacaaatgcacagacccacaccttactctacacacacacacctggtaccaccactgccttcaaacaccctgccccatccctctctcccaggcatctcatctcatgcacagatacgtgcccacccaggctcactggcgcccctcactgccctggagtagtaaatccacaaaccatgagatgtcccgacatgcagagagaggtgggatgggtgatgggagggaggtcaggagagtccctgcattcccccaggagaggggaccgctggctgctctcagcccgccagcctgggacctggcctctgggcgctgtgcacgtggtcgtgagagggcacccccatgaagacaagccaggtccccactcctgctcccagcactcacagacacccactctcggggctgctcaggtacgggaggactaaacaggagctcctgccacccggctcctttcggggtgtggtggggggctggtgggaggacacatccccctgagtccgtggccctgctcactggtggagagttgcccgccctcccgttccttctgctccctcttcctctccacgcccacatcctcccagctggcctttctctcccccagatcctctcccatgaccaggtttcctctctctctctctctctctctctcgctccctgtgtccctgtgacctacttatgctctagaataatgatcgacattttcaattacccccaaagtaacagccgttcttggggcctggcggaggacggctgcatgggcgtgggcacgggcgctggtttgagtgtggggcctgcgggtggtgggggtggggacgcccatggtcccactgtcctttgtttgctttttctcatccggagccttcaatttttcctggaagattggaagcacgtttcccttcaggggaggaagggagataaaacagagaaataaaaactgtcatcattctcttgtaaacagcgtagagccaagtgggggctcggcaggagagagcgacatgagggagaggccaggacagagaaagggggccgagagggatggggtggggaggtgagcaggagccccccctcaaggccgggtgggtgggtgtcctgcaggaaagactgatgggaggggaatgaggcgaggtgaggctgatccagggctggggccaggttggggggttgcggtttgaggagacacagtgtctgctgagtgccaggcaggccctgggaggcaggcgctattctccgaatcccaccctgcgccaggctctgggggtgctgaggtgagtgacagacatgtctttgcactcttggggcataaactctattggaaacaaagcggtggcttcatgtgttcagcacttatatcaattgaggctcagagagggtgggtgacctgcccgatgacacacagctggaggtgaggagaccaggatcccagccaggtccgtgtgaccgcagtctcctttcacaccacctccgctgtgggcacacttggctcttgcgtgaccttgagcaagtcctcacctcttggccatcagtttccccatctgaaaagcagccagcatgctggctctctgcagggctgaggggagcatcagatgtctggatgtgaaggacgctcagctctggctctctggcgagttggcggggggacggaggagcaaagaccaccggatgctgggagagggactggccggcagggaaaggaggccggaccgcagatttactccctgctgctgcccagtggcaataattgggtactgcagagggtgggtctggaggaccttcttcagcttgcaacaaggccagagcagaaaggtgcctctagggagtgttgtctagtcctcccggccccattttgctgatgcccagagaaaggagggactcctcctcaggtcatccagggcagaagcttgggctaggctttcagggtagggtgcttccctccatccctgtggcaatcaagaagcccccagtcagcttcagagcaagagaaacagagttctacatcctctgcttgatgccaccacctccagggagacttccagggtctcctccagtaggaagtggcctcactcctgccctgcagtcccacactcaaactctccttgctcctcctgccccacccaaccatgactgtcctcctgcccgcagcaaatcaggcagcggggccccttgagacacgagagatggtggagaaccattgttaccactcagggagcatgtgccaggggcccactctgtcctgcggctctacctgcatcctctcacttgaacctcgtaagaaccttggtaagttggggttattttgatccccatttttcaggtgagggaacgggcacagagagtttatgacctttacacacagagtggtggggcatggactcaaacccaggtctgtctgttctctggagaggcacctgcatttggaggtgaaaactacccctgtggccatatgacagtccactgtgaccggacactgaaatgaccagtccagggggcttgtgggctggggtctcagcttcaccactgtgctgctgggtgactttgggcaaggcccattcctctctggaccctggtttctcatctgtgtactgtgtatgtgcatgcatgcatgtgtgtgtatatatgcgtgcgtgcgtgcgtgtgtgtgttctgggctacctcagagatccattctggctttgagtgtggtatatcccatcttgggctggtcccaaggcttgggccctgggatggaaaggttttaaaggtcatggggagggggtgcagatggcagtgtgggaggcagagctctggctaagagctgggccccttgggtgcacctcctgcttgcgtgtcactgtgtagggctggggatcaaggggaggcatggactgtgagggcacgagggatccggctctgggacaggtatggggttggccctagggcctggatgtgtctccctccactgcctgccacagagggagtttgtcttacaggaaacagcctcatccatcagcggcaatggggggctgacagtggccactccccaccagccctggctggaggcagactcataaatcccatgccaggctgggctgtaaattcctgtgattcacatctggcctcttggaggacagagacatttggggctgtggggctggctgttctctcttggacaggacaggtgggtacccgggagaagcctcttcactggcccagcagtctcagatggcccccctgaggagatgcgatgctgagcccctggatgcctcaggcccagcccgagccatctctgcccacgcccaggccacctctgcctgggccattcctgtgctctggcccgaatcaccctggaggtcacgtgtgtggacacactctgtggcctcagagatctcatggggcctgtggccctgtgggtggaggattactcaggtgctggggcaagagactgaaggcacaaactgtttcaatataataaagaaaataattagaataagaatagtcataatacaaattagatatagagatgatcatagacaattaccaatcattactataaacattattaatcattagcttttaattactaatataacctaggaataacctgcgggtatagggtcaggtgctgaagggacattgtgagaagtgatgtagaaggcaagaggtgagccctgtcatgcccgcataaggtccgcttgagggctccttggtcaagtggtaacgccagtgtctgggaaggcacccgttacttagcagaccgcgaaagggagtctccctttccttggaggagtcagggaacactctgctccaccagcttcttgtgggaggctggatagtatccaggcctgcccgcagtcatccggaggcctaaacccctccctgtggtgctgtgcttcaatggtcacgctccttgtccactttcatgttcctcctgtactcctggttcctctttgaagtttgtagtagacagtggtagaaggaatagtgaaagtcttaaagtctttgatctttcttataagtgcatagaagaaaacgctgacgtatgctgccttctctctccctgcttcggctacctaagagggaagggccccctgttctgtgatcacgtgacttgcttcaccttgtcaatcacttagaagattcaccctccttaccctgcccccttgtcttgcatgcaataaatatcagcgggcgcagctgtttggggccactaccggtctccgcgtcttgatggtagtggtcccctgggcccagctgttttccctttatctctttgtcttgtgtctttatttattacaatctctcgtctccgcacacggggagaacacccactaagtcccgtagggctggaccctacatggcctggagggttggctccaagaaccccacagtgaggtctcctgccaatccgcatggcattctgtcttggggctgtgaggacacggtgggagatcacggcccagtctgtgcatctctcattccagggaggccggggccccgaatccactgtcccttagacaggaaggggatagggacactcagaccagggctgcagccatttgtcgcctttcatcaggacttttgccacactcagatgccactggaactctacttagcgttttttaaaaatcagcttacttttaaaatttaagtgtgtgttttagcctcgtctttagccatatttgtgaaatcagggtctgatgtactagtcaaataccatgcacatacacgctcagacacatacatatacacatatatgtgaaaatatacacatgaaatatatccatgaaagtaaacaaagttaaaatagcaaatgctcagctccatgtaccatctaaccctgctttaggtttagagtggctctagtctccccccattatgggtgattcctcactggtgaaacaaagcaggttcagatggctcacagagctgagcatttaccagccattctagccttcctccattttacagacaaggaaaccaaggtccagagaggtgtagggcctgcctgaggtcacacagcgctgggattagtggccagcctgcctgactcccagctgagtgatccttttacggaagcacactccctgtctgtggtgtgcagggccccttcctccagaagcatatgtggactcacagagccctttaggagactgtgccctaacatgcctccttccccgccacctcgcagtgcccagcaccctcactggccggcacgtgcagcacagatctgggtgtgcagccactcagcacactgatccacacacgtgggcagagtcacaacacagaagctcgcctgcacacagaggcatttgcaccagctccctgcacacttgtgcctggtgtgttcagaggaccacctgtgctgctcatggagacagggcttgctcgctaatgtccagctgtcatttctctacctcaggtcagagagtctgacccacctaagagccttccatggctccctacggcctgcagcattgagccccaaaagtcaaactcttcggactttgaaggttttccaccctatgcctcaccctccccacagagctcttcctcattccgtctctgttccctgctttggccagtggctgtcctggatgcggcccacactacacctctgcccacactgcagctctgtacccagataccctccagttcctcgccacataattctatctcagtcatgccccggactgcgttgaagccaggctgccttgaagctctcctagactgctcttttccccaaggaagggtcatgatttgccaaatgtttcgcatgtgttagcaagactggagtcggagcaggcatcaaaccttacatcccatatgtcacacctcaccacagacctggatgccaaataccctgaagagtctgaactcacattggcagttagcaaagtgctcctacagccacatctgcagttaacacagcatccctatggccactgtctctcttgatccccacggccactctgggagaaaggcagagagtcatcatttgatagaaaggatgctgaggctctgggagggaaagggacttgcctaaagccccagggtgaagcagcgtctctggactcccagtccagtgctcttgcccagtgctatgctgcttgcctctacccatctccgtgggtcatcagcgcatcatagggcaagccccaatccctgcctcattttggtttatgggcgctggacccacagccctaccctacagtcatttggagacaaaaacagatgctattgttcttccttagagaacgtggccagtggatccggcacactgggaatcagagtgaatgtccttgaaagaggccatgggtcaacaaggccaagccagaggatgcagaacgcttttccttagaaatctttgggagtgaagcaggcttcagactctcccatccctgcccctgcagccacccctaccacattggtttggacccagtaggttggggcgggggcgggggcgggggcggggtgggggtggaggaaaaatcagattgcccatgccccccaggctccttccccagctgcttctgtcctagcccaggcctggtgccattcttccactcacactcgtgtgcaaacccacacacacatcacacaccttgatgctcacagtcacagcctggcctctgctcctgtgggccagtggccagacaccccctgggatggctcaaaggagtcaggacttggaagtggggacatcagggtagctgaaggaaatccacacacccagaacatctcggggttcagactctctgacctgaggtaggctccccaggggctgggagaggggtttgacggaatggaggatggaggacagcgggaagaagaaacgaggaggaatgcaacgtgtggggcggccgccaagagtgaaaatagagggaagcgccatgcaagtgctggaaagaagggggcaggtgggacgagccccacagccccctccacaaaaagaccacttccgggactcagtgctcctttgggggcaggctccgccagctctccgccactcagggctccggtcccacggtcggagtgcccgggacggagacggccagttctggcggccaggtccgacgctctagaatccagccccatttccctcccggccacgcccgtccggcggcctctcctgtcatattcagcccctactcacctggggaccccgggaggggcgcgagggcacctgcagggggagggcctaaggggtcaggggaagcccccggtgtggagggtacgacgggcgcttcccccagggtggacgcagcaggcagaggcccaggagcagggctccgcaacccgggccgggctgggggcacggcggggagtcggcactgcgtcgtggggctggacttgggcgacctgcgggcgaaagggagccaggaacagaaagaggagcgatgagcggccccgcccaccctaaggccccgccccagcccagtgccagccactcccatgcatgcaagccccttcctgaaggcccgaggcggtcaccggagcttaagccccgccgccagcggcgccaacctcccagatccaccccgccccgcagcccgcgctccacggcaagccccgccctctctaagctccgcctctcgcttcaagtaggcgccaccccgggatgggggcgcgccctgcctggtccggcacttcttccgcggcccaggctggggggctttggggccgtgggggccgaccctggtacctgcgtccgaccgggacgctctgcacctgcagccaggagtcatccacaggaccccgtgggtgtgctgacgatggtcgtcttgatgtcaccgatgatgctgggcgcctccctcagcacgtggtgcatgcgccgcatctcgttgcgcccctgtgcctgctctgccgactcccccatcagcgtgttctgttccccacgcgagtacaagttggccagcagctccgagaagatgaactccttggtctgagagcgggcaaagagggaaggagactgggacctgattgatgcttgtgctgccctggccgccatagctgccccgccgggccctgttgggactgtgcgctggacttggagccgcgagtatggcttttcagacgcggcttctacaccgcttagactcgaagatccgcctccccaccgcccttttctcactcagatgaggacactgaggtccagaggaaaagtcacctgtccaaggtcacagttctgggaggggactgaggacctatcatgccaccaggacacctgtctactcagtttttaatttttggagataggatctcgctttgtcgccaggctggagtacagtgggcgagatcactgctcactgaagcctcaacctcctgggctcaaagtgatcctccaacgtcagcctgtggagcagctaggactacatgtacttgccaccaccaagcccagctattttttaaaatttttgtgttgagatgaggtctcattatgttgcccaggctggtcttgaactcctgggctcaagccgtcctcctaccttggcctcccaaagtgctgggattacaagcatgaaccactataatcccacattatatttctattggacaactctggtctggactgtgcctcccttcctgaggctggtcccataaggctggtctgcatctcccctaggccaacatggccacctgggtcccctctacccccatgaggcgacgcatgcacgttgttgatcatgaggtggatgatggtcttgggcatgaggtcctgcatgttcttgttgacaatggccatgtacgagtccaccaggttctgaatggtctccacttgccactccagctgtggtccatggagagcatgaagctgtcggagccattcccctcagtcttgctggcctgtcatgaagaacacaagggcatcagggtggccaggccatgtagccaggctccaggcatcccctgcaagggtacctggcacattgatgcacagagagaagcaactggcctaaacagacacccagctctccacatgctctaaaaggtttcaggtctctgcccatccctgtatctcttaggaccccagactcccctgattcagcctcatcttggttctgactctactgcccagaatttgcctcaattttccaaaccagaaatgagaaaaaaacatctgcagatcctttgcttaaagacctggccagagctggtgccaggctgcagacgcctggcaggaagcaagagagggtcacactcactttcttcttgtcctgggaggcccacacaccaacactgccaccactgctggcaccagggagcacagccaaagtagacacacacagagaggaaaaggggagaggttgagtgaacctgggacactgcaccccaactctaagtctcctctagacattgccacagtgaaataggggagaaaagagaaggcagtcacaggaaaccaccatcatagaaagggcatgcaagaaatgccatctgtggcagagacggagacacaaaactgccactggagaaggatgggaggaccagaagacttaactctgatctcaccccagagtaggtagtggggaggattcctggttatttctgagccaaacaagggctcagaaacatggcatgacttggcatcactgtggatggtgccccagggcccccctagtatcagcagcttgaccctcctctccttgccctgccgctcaccccaacacactcaaggtacacaccagccctcagaaagtaggacttccagctgttcacctcctcctgtgtctcatgagccagctccagctgccaataatccttgtagaggccaggtgcggtggctcacgcctgtaatcccagcactttgggaggccaaggcaggcggatcatgaggtcaggagattgagaccatcctggctaacacggtgaaactccgtctctactaaaaatacaaaaaattagccgggcgtggtggccggcgcctgtagtcccagctacttgggaggctgaggcaggagaatggtatgaacctgggaggcggaggttgcagtgagccgagattgtgccactgcactccagcctgggtgacagagcgagactccatctcaaaaagaaaaaaaaatccttgtagacattcctgcaagacagggcaggcagtgagggcagatgggcaaagccacaccctccctgggggttaagggcatgcctggactttggggtcatcacatctgagtcaagtcctggcttgctcatttcccagctgtgtgattctgggcaaatcccttcctttcagcctcagtttcctgattgggaaaatgggttaataataattcctgccttgttatggtttggctgtgtccctatccaaatctcaacttgaattgtgtctctcagaattccacttattgtgggagggacccagggagaggtaattgaatcatgggggctggtctttcctgtgctattctcatgatagtgaataagtcttatgagatctgatgggttgcttttgcttctctcattttctcctgctgctgccaatgtaagaagtacctttcgcctcccaccatgattctgaggcctccccagccatgtggaactgtaagtccaattaaacctctttttcttcccagtcttgggtatgttttcattggaagtgtgaaaatggactaatacaataaattggtaccagtagagtggggcattgctgaaaagatacctgaaaatgtggaagtagctttggaactaggtaacaggcaaaggttggaacaatttggagggctcagaagaaggcagaaaaacgtgggaaagtttggaacttcctagagacttgttgaatgactttaccccgaatgctgatagtgatacggacaataagatccaggctaaggtggtctcagatggtgacaaggaacttgttgggaagtggagcaaagatgattcttgttatgttttagcaaagagactggtggcattttgcccctgccctagagatttgtggaattttgaacttgagagagaagatttagggtaatctggctgaagaaatttctaagtagcaaagcatttaagaggtgacttgggtactgttggcattcagttttataagggaagcagggcataagtttggaaaatttgcagcccgactatgcgatagaaaagaaaaacccattttctggggagaaattcaagccagctgcagaaatttgcataagtagcaaggagcctaatgttaatccccaagaccatggggaaaatgtctccaggctatgtctccagaccttcacagcagacccttccatcacaggcccagaggcccaggaggaaaaagtggttttgtgggccggggccagggaccctgtgctgtgtgcagcctagggttttggtgccgtatgtcccagccacttagccgtggctgaaaggggccaacgtacagctcaggctgtggcttcagagggtggaagccccaagccttggcagcttccatgtggtgttgagtctgtgagtgcatagaagttaagaattgaggtttgggaacctccacctagatttcaggagatgtatggaaatgcctggatgcccaggcaaaagtttgctgccagggccttcatggagaacctctgctagggcagtgcagaagggaaatgtggggtcagagccccccccacagagtccctcctggggcactgcctagtggagctgtgagaagaggaccactatcctccagaccccagaatgatagatccactgacagcttgcaccatgtgcctggaaaagccacagcactcaatgccagcctttgaaaacagctgggagggaggctgtaccctgcaaagccccaggggtggagctgcccaagaccatgggaacccaattcttgcatcaatgtgacctggatgtgagacaaaggagataattttggtgctttaaaatttgactgtcccactggattttggacttgcatgggccttgtaatccctttgttttggtcagtttctcccatttggaacaactgtatttacccaatatctgtaccctcattgtatctaggaagtaactagtttgtttttgatttttacaagctcataggcgaaagagacttcccttgtctcagatgagactttggactgtggactttttgggttaatgctgaaatgagttaagattttgggggactgttgggaaggcatgattggttttgaaatatgaggacatgagatttggaggggccaggggtggaatgatatggtttggctgtgtccccacccaaatctcaacttgaattgtatctcctagaattcccacatgttgtgggaaggacccaggaggtggtaactgaatcatgggagctggtctttcccgtgctattctcatgatagtgaacaagtctcatgagatctgatgagtttattgaggtttctgcttttgcttctatctcattttctcctgccaccaccatgttaagaagtgccttccgcctcccgccatgattctgaggcctccccagccatatggagctataagtccaattaaacctctttttctccccagtctcaggtatgtttttatgagcagtgtgaaaacggactaatacatgcctcctcaggtcactgtgaggatttagtgaaacattatcctaaaaaaaataagttaaaagtcttgcttaaatatgacaagcttataaaaattaacagaagcattatattagaatttctaaagtcatttccattgaaatcaagaataagaaaaacatgctgctttccccaatgttagtcaacattatttaaaatgtttagctaatcaaactgaaaaaaataaaacaattggtatgtatattatataaaaaaggtaaaattgcatatttttgtatataatagagaagagaaaatctaatattttaataaaatacaataaataatttaataaaatatctcaaatcaagatatatggtacataaaaatcattagcctttctcaatatgaagaataactagtcatggatataaatttattttttaaataacacataaaagcattatatattgcttaggaatatatataaaaccattatctattatttagaaatgcaaaaatacatttaagaaatgtttaaatgtctgggaattatacacactggcttctagacactagtcatatatctagaaagggggaagatgaaagaatgtcatcatattctataaatatgtcaaaatgttaaaatctagtaagtatgagaagagggtacatgttgcctgtaatattttttttatatttctctgtatatttgaaatatttaataatacaattttaaatttgaaatatcttctctaaagtcatgataaggatgggcggggtggctcacgcctgcaatcccagcactttgggaggccgaggtgggtggatcaccttaggtcagaagttcgagaccagcttgaccaatatggtaaaacctgtctctactgaaactacaaaaattagccaggtgtggtggcatgcacctatagtcccaactacttgggaggctgaggcaggagaattgcttgaactcgagaggcagaggttgcagtgagtcgagattgtaccactgcactgcagcctgggagacagagcaagactccatctcaaaaaaaaaaaaaattggctgggcgcggtggctcacgcctgtaatcccagcactttgggaggcctaggcaggtggatcacaaggtcaggagatcgagaccatcctggctaacatggtgaaactccgtatctaataaaaatacaaaaaaattagccaggcatggtggcgggcgcctgtagtcctagctactcgggaggctgaggcaggagaatggccatgaacccgggaggtgcagcttgcagtgagctgagatcatgccactacactccagcctgggtgacagagcgagactccatctcaagaaaaataaataaataaataaaaataaaaatcatgattaaaaacaataggctgggcgcgatagctcacacctgaaatcctagcactttgggaggccaaggcgggcagattgcctgagctcaggagtttgaaaccagcctgggcaacatggtgaaaccccatctgtactaaaatacaaacaaacagacaaacaaaaaatgaaaacaacaacaataataatggctaagaatgtttgtatatgaagtcatttttaaagacagaaaacaagatctaagcaagtggagagacatgccagtactccagaaaggatagtgttaatgttaattcttagaaaaattaatgtataactatgatgcaattcccattagaatcacagtgaattatgtcttggtccattgtggctgctgtaacaaaatactatagactggatagctactaaacaacataaactgacttttcctaattttgaaggctgggaagtccaagatcaaggcacaggcaggtcagtgtccagtgagagcccatttcattgtttatttacggtgccttcttgttatgccctcaatgggggaagggactaggaagctcccttgggcctcttttataagaggactaatcctgtttatgggagctctgccctcacgacctagttacctcccaaaagctctaccttttaatactgtcaaccttgggggttagggtttcaacacaggaatttggggagggcacgaacattcaaaccatagcaaatcattttacaaaaactacatgaaatgaatgtaaagttcaaatgaaaaaataaatgagtgtccaagaataggcaagaaaactatgaaaataaaaaatagaaacagggagaattgccctaccaaatattaacctacattataaagtcactataatcaaaacaacattaaaagatgaataaaaatgtatctgtggatcagaaattgatcccaaaatcaatgtaagtatatataagaacataaaatatggacagggtactatttcaatgcagtgggaaaaggttaattttttaaatataaactggccatcaatctagaagaaaacaaaactaaatccactatctcatgccattcacaaaaataaggttctgacagtttagaaatttaaatataaggaacaaagaatatgaacatgcaatgcacaggagagaaacatgtgttttataatattatgaaaatacactcagtgtcattaaaactcaggaataagcaagctgaatagtttgtggttttaccaataacttggaatatgatgtagctttaaaaaatattgatccagagtctcacttactgagacagagagatgaaaaaaatcacactgcttaagtgtgattttttttatcaatcataaaacacactatacatgaatatagcaatttttataggtctgtacaagcataaggatgtggaccaaggtacatcaagctattaccattatttatttatggtgtgaggatggaagggactggaagaaagttattaatgaatacttattatatatatgtatatatttcactttttaaaataagcagacttgctgatataatttaaaaataataattttaaatatttaggcatattgagaaaagaaaaccaagggaggctttgcagacactgccaccatcgggagccctgtactatcagccatggttaaccccactgtgttttttgacatcgccgtcgatggcgagcccttgggccacgtctccttcgagctgcttgcagacaagtttccaaagacagcagaaaactttcatgctctgagcactggagagaaaggatttggtaataagggttcttgctttcacagaattatcagagtttatgtgtcagggtggtgacttcacatgccataatggcactggtggcaagtccatctatggggagaaatttgatgatgagaacttcatcctaaagcatacaggtcctggcatcttgtccatggcaaatgctggatccaatataaatggttcccagtttttcatctgcactgccaagactgagtggtggatggcaagcatgtggtctttggcaaggtgaaagaaggcatgaatattgtggaggccacggagcgctttgagtccaggaatggcaagaccaggaagaagatcaccattgctgactgtggacaactctaataaggttgacttgtgttttatcttaaccaccagaccgttccttctgtagctcaggacagcaccctccaccccacttactcgcagtatcctagaatctttgtgctctcgctgcagttcccttccatgcctagctggactgcagagttgagtttatgattatgaaataaaaactaaataaccaaaaaaaaaaaaaaagaaaaacaagggaaaaaatgaattggacttatgaggtataatggctattatcctagagtggtggtagaagaaaggagaggatggagagagattaaataaattagttgtttactgaaacttttttttttgagatggagtctcactctgtcacccaggttggagtgcagtggtgtgatcttggctcactgcaaactccgcctcctgggttcaagccattctcctgcctcagtctcctgagtagctgggactataggcacctgccaccatgccaaactacttttatgtatttgtattttttttttttttttttgagacagagtctcgctctgttacccaggctggagtacagtggcgcgatctcagctcactgcaagctccgcctcccgggttcacaccattctcctgcctcagcctcccaagtagctgggactacaggcgccctccaccacgcctggctaattttttttgtatttttagtagagacggggtttcaccatgttagccaggatggtctcgatctcctgacctcgtgatctgcccgcctcggcctcccaaagtgctgggattacaggtgtgagccaccgcacccagccacttttttgtatttttagtagagacagggtttcaccatgttggccaggctggtcttgaactcctgacctcaggtgatccgcccacctccgcctcccaaagtgctgggattacaggcatgagccactgcgcccagcctgaaacttgtcaagcacaggcagagttcctggggcccagagggatacacgaaatataaggcacagaccttactctctattggcattaagtctgatcgtggatgaaattaaaacacttgaaaccatttatatataatgacgcaagcccctccaaaactgtcaggtcatagaatggatgtatcagtttgctttaccattcacctattggggagtatttggttgtttccagtttggggctattacaaataaatctgccatgaacaatcatgtatgagtttttgtgcagacatcagttttattttctggtacaaatgcccagaagcaattgctaggtcatatattgaggtgtatgtttaattaaagaagctgccaaactattttctagagtgtctgtatcattttatattcccaccagcgatgtatgagttagttttgtctgcatcctcgccattatttgatactatcactatgcttgatttgagctgttctaatagatctgtagtgatatcttactgtggttttaatttgcatttccccagtggttagtgttgaagatctattcctgtgctttaagtcaattcatttttaaaacctaaataaatgtatttaaaaaggaaacttttgctttaggaggccaaggcaggtgaattgctcaagccgaggagttcacgaccagcctgagcaacatggtgaagctccatctctacaaaaaatacaaaaacatccaggcaaggtagcgtgcacctatggtttcagctacttgggaagtgaggcaggaggattgcttgagcctgggaggtcgaggctgccatgagccatgattgcaggattgcaccattatactacagcctgggtgtcacggcaaaaccctgcctgaaataaatgaataaaaggaaacttgtggttagtggttctcagagtgtggtccctgagccagcagcatcagcatcaccatcagctgagaacttgttagaaatgcagattctcaggcgccgtcccagacctcctgaatcagaacctctgaggcgtgggttcagcgacctgtggtttaacacgccctcccggtgagaatcggtctcattcactacagatagaaggaaatggtaaaaatcaattcatccgcatatcgcctaaaatcctcctgtgggccccaggttgccacagcacacttttgggcaggagccccactcacagaggccgtgacaagaatgctcctgcccctggggttgtgcagtgacagctcacacagctccacgtggcggttctgagtttgggaagcgctgatgtagtcctactgcagcccttcctgcccttcaccggactgaggaaatccaggctctgaggagggcgagacttgcccaaggtcacccagcaacatggtcagtctcctttcccagggccctcacaatgcgtggcctgtttaaagcctgcctctattcactgctgagtgaaaaatccagctccaaagtagaatatggggaaggatactatcttgtgcagcttatgtttatagctgcagatacatgggaaaacaagtcagaaaatactgttgaagcagttatttggggagagaaggggtttgctggttttttgtgtttttaacttttctatatctcataatttttatcacaataatgtttagttacataatcaaaatgtattaaatataatattaaaaatcgacatgaagcctgatctagccacggtctattgttggcagagtcaggaagccttccagatagagcaggccctgcacctgccccaggtcacacccttaccccatggtggcctccacatccatacccatgagcatctcctgtgggtgcggccctcccctgcatccagccctgggcacccccagcccagagggcacctcatggtctgagagtccacctgtctgtctctaaagagaggaaagctccttgggacatgtgttctgcttgacgcatcacccctggcctggtacagaaaggtggacagtgggtatttggtgaataaatgaatgaatgattagaacaagtccccaaaatggtgatttcctgaggcccttctccagcttgcctaggtggaaccagttccacttttcacaggaaagccaggtgtcaggagtggggcaggtatgtgtgaatggccaggttctcgaaggctggatggatacagggcttatggcaggtctggggttggcagtgctgctgtgggagcctgtaggagggctcgtctttggaatcccccagggtatcctggtgccctcagctgctgcatggtgtgagaaggcctggcttgtggggatgcacagggtcttgtttggattggccacctggtccagcccagggagctatgcttcctgcccctcagggaaaactcacttttgatgtgtaacaacagctgcaggcaaggggaggtagaggtgtgctgggcctcggccttagaagccagaagccagttcatgcccctacgtgggaaaaggatgatatacgtgggaaagggatggggccttggctagctctagggtcctgggttatggtcagaaccatatggacttatatgagtcacttatggactcagtgacttgggctgacccagcccctccctgaacctcatcagtgaaaccaggacggggccagggctctcgacgcctcccagctccaacctctggctttctcccaggagggcaggagatcagacagaggtaacctgggctcccctgtttacgtcaacctccttgtgaagcctccctctttctgcctgtgaggtgggtggggccagaaggagaggcattcacctgtgggtctctgacttctctgcccaggtgtgcctggagagcctggtctatacccggtgctttgctacaccccacagcctggccaaagcctccctgcctccagagcagccctggccctgggaagaagctggtctctgcattgaatgacaggtagaaaattaaagtggggatgatagctctggaaaggagtcaaggaggaggtgccttcccaaggacacagagggtttttccagaatggaacttgactggtgtgggcaaacatcaggaggtgggaagggtggctccctctgcgggagctggggcaacttgcctgggccaaatggtggtaggttgtgggtagggcaggcagagctggggtgctcagagcctgggttctctgtccttgcagaggactggaattcaaaacaagtgtcccctgccctgtggctgggggacatcctctacttccaagcccagacatacaccagctgccacaagcccctgaggctctttagaggaccaatggacagccacacccacaatgggccagcctgctgggccacctgcaccctggtcagagcccatgactgaggggactctctggggacaatgggggcagtcccatgctgccctcttacaggtggatcagtccctgggatctggtgttgggctagggtgggctgaggctgttctctgccagggtgcctggtggacagcaggtagagcaacttgtccttggctttcctggaccccaggacacagctgaacactgcactttaccctggatgccttcggattctcaggggaccctgggaaggaagagggggatgccccagcaggaggccagggccctgggctatgcttgctccccccagtccctccagcaggcacctcctctccacatcaacatcacctgattcctgaaggcctgggctactgacaagagccccaaaaccctcaccaaggcctgttcttgtatcagagcaactagtatgagttcagagctgaaggggccggagagaaaactcagggctctctaagagttctcagctccctactgtggtgggccccgtagaagtccccccagaaatctgcagctgctgtaagtcactgggaggaagctacagcagacatgtgtttcccagcctggtagatgcagaggggtgtccgggccccgagtgggaggcccaaacacagccttggatatggcagtgcaggattctagacagctctggggccctgggcaagtcatttagcctctcagaaccccattcctggtcatcatggggctcttgtgtggatgtaaagaacccccctggccacttatgtcccatcagtggaagcctagcatgggtggagacccccgagactgaactcagtggtgggatccagcctgcccagctctcctatatagagcccagagccaggaggatgggcttcctggagaagcaggcactcctgtgggctggagagcatgagcaggggtccccttggggaggtggaagaggctgcggtcagtgaaggccataatgaggcagagcttgggcaaaaaaggcatgatgatcaggggatctgaaacccaacagagactggactgaggacactgtggccacctcctccaggtgtcgctcaggaggtggaagctgagctagggctgggcccttgtcctgagtaacgcctcaccagtcttggaaggtatacccaaggtggcttaatgtaagggtgcatctgcgcactctttttgagatggggtcttcctctgtcattcaggctgcaattcagtggcacaatcatagctcactgcagcctcaaactcctgggctcaagtgatcctcccacctcagcctcacaaagtattataattataggcctgagctatggagcctggtttaaaatcttaataaatatctcctcctggtctgcttccctggctgacacacatgctggcatcttgcgcctagacagacatgtctctggacttggttccatttgttctgtcgggctcctctctctcaatgaccgcacattacagtatgtggctattcttacacatttctgtatagaactgagggttagtatattaacgtcaaagttctactggtttttcgaggctgggtggaaagtttgggttaatttaggagtgggcatcttgacaatataggcttttcttccaggaacggtgattctgggacgcaggttttgcacattctggtttattgcttgactcgctgccacagagggatgtcactgctccacacgccatgcccaagagatgtcccaccttatctttctaaatcaagctgaatgttttcagctgacaggatatcacgagtgctgcggggactcactcccctcaacccgagatgaagtgaggcggagactatggagcagatccgtgctgagtgcatttgcccttcctgacctgcactgctgctggctggggctgtgtctgagctgtcagagggcattgatttggggatggggtggggggcagtgctggagagatgcccctcaccttcctcagctcctcctgtccagccgacacttggccaccaaggcccctgacttccaggccccagtcaccactaacagggtgctgcatgggaacaaagtgtaggcccagaacctggagttcaggtcactcctccttccagtcgaagcctctgcccctcccaggtgattccagcctcgttcctccatgggccaaatatcctaaacaaaggcctggacagggggtctttatctgactgcccagaaaacacacgcagaaaggctctgcatgccctctgtggcctgccaggggtaagagcctgcccgtcaaaatgcacagtcctggttcttgcagggagttgaggagcagaagaagaaacaaaggtccatctcattctttcagcaggaacctaaacttgggaaagccagacgcagtacatttcttaatcctgatacttttataactggttatagctgggtcacatgcacaactgttttccaacatctttcaacaggccacataacatcctgtaacttctttttttaaaatttttatttcataaggccaggggcagtggctcatgtaatctcaacactttcggaggccgaggcaggaagactgcttgaggccaggagttcgagaccagcctgggcaacacagcaagaccccgtatgcaacagagaaaaaccctgtctcaaaatttttttagagtacagtggcttgatcacagctcaccgtagcctccagctcccgggctcaagcgatactcccatctcagcagctgggactatcagagcacacccccacatctggctgatttttaaatttttggtagagatgcggtctcactatgttgcccaggctggtcttgaactcctggcctcaagagatattcccaatgcgacctcacaatgcactggggttacaggcatgagccaccatgcagcccctgcaaaatctaactgttcttcaggtgctccttttggacctcctagctagactgccattggcaaatgccagttgattatccacccacatttatgttaatggatttcccatgttttatttgtctagaccaggctttctccacagcagcactgttgatgtttagggctggacagttctctgttctggagctgtttgcgcctcgcaggatgtttagcagcatccccagcctccgcctgccacatgccagcagcactcctcagtgtgacagccaaagtgatttcagatactgtcaaatatccccagggcggcaaaatcacctccagttgagaactgctgacctaaaaccctctggaacaatgttagatcatggtaacgatagcgcatactgctcctgaccttaatgggaatacctctagcatcaaagtatagtagtacctgtatactactgtctgggctgttattagtacactgtattagtccattctcatgctgctatgaagaaatacccaagactgggtaatttataaagaaaagaggtttaaattgactcacagttctgcatggccggggaggcctcaggaaacttacaattatggcagaagacacctcttgccagggcagcaggagagagaaggagagccgagcaaaggggaaagcctgctataaaaccatcagatctcgtgagaactcactcactatcacgagaacagcgcaggagaaaccacccccatgattcaattatctccacctggtcccacccttgacatgtggggattattgcaattcaaggtgagatttggatggggacacagagctaaaccatattatatcctttatattagcatactgtatcaaagtatacttttctttctttcttttttttttaaatttgagacagagtctcggtctggctctggctggagtgcagtggcacgatctcagctcatggcaacttctgcctcccgggttcaagcaattcttgtgcctcagcctcccaattagctggaactacaggtgtgtgccaccacacccagctaattttgattttttttgagtatacatggggttcgacatgttggccaggctggtgtcaaactcctggcctcaagtgataccaccactttggcctcccaaagtgctgggattccaggcgtgagccactgcacccagcctgaagtataattttcacaatgcgaaaagcttgactttcatacagataatgaaggaatatgtataagatattttaatttacaagggagtcagcaacatggtgaagctagttagaggagcattttgagagacagtgtctatagtgttccaggaagtgcattctgaaatgcattctgagatagagacaaaacttgttaatatcctgtagggaggccaggcatgatagctcatgcctgtaatcgcagcactttgggaggccgaggtgggtggatcacctgaggtcaggagttcaagaccagcctggccaacatggtgaaaccctgtctctactaaaaatacaaaaattagccaggcacagtggtgggtgcttatagtcccagctacttgggaggctgaggcaggagaatcacttgaacctgggaggtagaggctgcagtgagctgactcaaaaaaaaaattgtattgggaaataaaactgtcatccttgggaattatcttttccactgcacagaaatctgtaagttaacatatatacatattctccagtatattcataacatattctctagtatatttccctatatttgtggttttcaaagcatagtctcaaattggaagtatcagcgtcacctgggaacatagacatgcaatgctcaggccccacctcagtcctattgagttagaaactctggtgtggggcccagcagcccgtttcacaagccctgcaggggattatgatgcactctaatgtatgagaaccacggctctaaatagtcaaatcatctttaattgtaaaacaagtatctgtgaaataatgctccagtatgacattaaaatgctccagcacgccacccactttatttctgaatttaaatactttgtctgtctgatgttaaatttgctgtttttttcaaatactcttaagacagtttttcatcggttcttaattttctctttttaaataaaaaatggttttccaaatctatccatttttctcttctttaacctattgataggatgaaataaaagttgaaccattcttacgtcttttttttttttttttgagatggagtctcaccctgttgctcaagctgactgaaatgcagcggtgcaatctcagctcactgcagcctccacctcccgggttcaagcgattctcgtgcctcagcctctcgagtagctgggattacaggcacccaccaccatgcccagctattttttttttttaagtagagacgggttttgccatattggccaggctggtctccaactcctgacctcaggtgatctgcctgccttggcctcccaaagtgctaggattacaggcgtgagccaccgcacccagccttttttttttttttttctgttttcctttttttttttttttttgagatggtctcattctgttgctcaggctggatggagtacagaggtaccatcatggctcactgcagcctccacatcccatgctcaagagatcctcccacctcagcctcttaggtagctgggacgacacttgtgcaccagcagaagcagctaattttttgtagagactggggtctccctatgttgcccaagctggtctagaactcctgggctcaagtgatccactggccttggtcccccaaagtgctatgattaaaggtcttatgttcttaaaatttttctttgacatggtataggatagtctagtaacttaacatactgttgttttcaacaggctagtgcttatgatttgtaaaagaactcttcagaaatgagttcaattttaccatgaattgggacattttccatttctttctattccatagagcagtttacttgtcatgagctctgtcttttgaaaacctgaaagcctgcaataaaaccagctgcacctggtgcatgggataggcatggaattgaggagagagctcaaactacggtcagccctctgtatcctcgggttctggatccttggatttgaccaactgtgcatcaaaaatatttggaaaaagtaaaataaaaaaacaaatttaaaaatacttcatacagctatttacaaagcatttacgttgtattaagtattatagtaatctagaggtgatttaaagtctacggaaggatgtgcataggttatatgcaaatactatgccatattatatcagagcatctgtgaattttggtatctctggggtcctggaaccaatatcctgaggtttctaagggacaactgtattcaatttcttctctggttattagtctattctctaatgtatttttgttgttgttttgtctttttgtttttgcctcttcaagtcaatgtcggaaacttagttgttttagacaacccattagctcagagctaccagtaagcagactaccactgcaatctaagcaacggattttttcccccatcagactggcaaaaaataagcatctattgatgttgaaattgtagggagttttcctgagcatgttaattatgacagccctttttgctaggcacctacacaattcatcaaaatgaaataaaacacccatgcacttgaagaagttatctggttatttccttatctgggtgctggttatgtgaggtctacagttaatgaacacttattaagctttatatttctaataggtacaattttctgcatgtgtagtagatttcaatagtttttaaaatgtcttttgccgcagcccgcagctgtgtataatgctattcgcttaacagtggaaaacatggcaatgacctgaatccccctggctcccgggatcctacccccttaagttaaacaaatgaaataacttccactgtctttcctaatgtcttaattcggtcctcagttaaactggcggtgggcgctgctttttttccagggaaggattctggaagacataggaggagacgccagcatttcgccctccagcacctcctgcgggctgtggtccgcttccggcctcactcgagcagaccccgccctcccagaggccgtttgtccaagtcacgtgatcgtcgaatctgttgacctggcgccaccggaaaaagaaattcccgggccctggcttcttggcctgatggtgaggcaccagaggtgaagcgaggcatgggctgctggagcgggaatgagggggcgacagtggctccggaaacggggggagggtgtcttcactggcctctccgcaaacacagtgtgtgcgggtgtgagggctgcaggtctggtagagaagagtccaccgccatcccgctcctgagacgggggcaggagtggggggcaggagtgggggggcgggtaagacagagcaggccggccggcttgtggagggcgaggcaggcagatcccttgagctcaggagtttgagaccagactgggcaacatggcaaaaccccatctctactaaaaatacaaaaaattagctgggcatggtggcacatgcctgtagtcccaggtagttaggaggctagggtgggagcactgcttgagcccaggaagtagaggctgcagtgagccgagatcatgatgtcactgcactccagcctgggcaacagagtgggaccctgtctcaaaaaataaaaataaagtggaagcatcagtatgcatgattgaagtcatgctttccatctatttttttccaccttcccttttttctgtctaaaacattgtatcttaagcttttgcctatgttatcaagtactcataagcattatttgaatggttgtatcataatccattatctggactcattgtcatttatccatctgcagttgctggagatactgccctttctgccacactcagtcacccttctgaccttgcactgtgtccagttatctactaatacccatactggtcatttaggacttaagaatagttatcatagtttttaacattccaaaaagaatgtgtcttcctaaaaatagaatggcttggtggttatacttttaaagcaaaatagacaaagccatgttgaaattaatgttttattttcttcttgtatctattttcacttctcttgtcattttgatggataaagtttcatttggaaggatttttatttcaaaacagaaatagcatatgacatgagaaggggaactctgaaaggttcaacttcctagtttactaagtttgtcacaaaagctactgatagtcaatcatgattggcctgtattgaaagtgagttaacattatgtacaacttaagcactatactttctatccgatacagaaaaataggtggtgtgtttggaaaagtattgggctaggagtcaggaagcttgattgttagtctcaaccctgcttcttgagctgagcacccctaggcaataattcagcagctatttcttaaatacctaaatgaatttcaggctttgtggttgggctgggaatatagacatagatactgcattcatgattctccaagcctcccttcttcaccccggctcacagtgagctttcttatgcattgtgtaaatttgtctcctaacaggccccaactctgtctccaacctccttcccagggcagttgtgaggatcagatgagggagaatatgtgtgaaagcaaattgtaaattattttaaaatgcaataaaaatatgatccatggaaaattatttaaagatccttattaaaattattaaagatccttagaattttaaataaacagtacattaggccgggcattgtggcttaggagagcgctgggtcaaatcagtcccctccagctacgcattgcctggagctgctctccaaggacccctcagccacagaaggcgctggtcctcctacagtgctgccccacccccaccaccacagcctcctgggggtgcagtcaggggtgccctccttcaggctctgcccctgcacccactcctacacaactactctccctgccggcagccccagagaccagattggtttgggcctctgcctccgcaggcccgaaccaccatctcttctgctccccagaaagccagctcccagcacacaggcagcgttccctcttcattcctcaacacagagggcccctcacaaccctctcagcagatggtagagctccccacgcatcctcttaaagaggcttcaccgttgatggccacaagccccaccatgacctcctcccagggagtgaattttcttacatgtctcccaccagagcagggacaaaataaaacataaaagcagcagctgttaaattatcagcaacatttcctactaggatcaactcacggagtgggcagtgtattccattaggtggatcagtgcaggggttagcaagcgttttctgtaaagggccggatgggaactctttaaggctctgcaggccactgggtctctgtcaccacctactcaaaccctcccctgtagcaagaaagcagccctagcaacatgtcaacagataagcgtggccacattcccagaaacctttctttatggacatggaagtttgcatctcacgtaattctcatgtgtcacaagatacgactctactttccatgttttcaaccatttaaacatgtaaaagccattcttagcgcgtgggccacacaaaagcaggcagcaagaaatttggcctttacaccaacagcagctgacccctggatggagcattagagcttgggtgtgtgtcccactccagggcttccaggagaggggatgcaggccgatgccacctccacccctgtcgctctaggggagaaggcagagctggtgctgtatgaagtttggctgcagatcctgggccagccctacaccaaggccttggaggacaaaaccagccttgagttctgggcacttcaggggcaaccgacaagatgggtgaagtggcgggatgaagtgggggggcggggaagaagcctcgggaagatgggggatgactggacaagactttggtagagctgtgaccctcttcatcctctcctgaccccccagctgaccctcgtcctcagatctctgcagaactttgaccagtggtggtggaggaattccggtgggtccagggtggccctgggtgacccagggctcagacctgggttctggggttgaaggcaggaggctggaagagatgacctcccttaggccccccaggctgcccagccccctgaagtgggatgatcctcccaccaggctggacccactgaccgtcagagtgggtgccaccttcttcagggcggcatcagcccaggctctcgtgtgggtctgcacaccctgggggaggcagagggcctcttggtagacacggtcatctcagacctcggtcagtacctccttccctctgcaggccccctccctctgtccatctgcctcctcccttgggcttgctgcctctacatgccctgatctgaaacctgcctcccctcctcatggagccctccaagatgctcctagccccagctctctggtcccgcagcaacttctggtgccagattctgccttctcagaagtctgggaggcagggccccacctggccatagccttcttggtctgctctaggcactgctagccttgaagcctccagcctgctggatgcctccatccccggctatgctgtggctctcctcattctaggcctcctgctcgtcacattcacccttgtcctggtgagtgtctggctgggcccaggctccttcctgaggggcaggctgagcctttgatgccttgagccttgagccaagctgaggagtgagcaggcccctttacacccctgattcccccacccaagcccagcatctcctcatcctccagctggggctgcagggtttggggccagggggctgggcctgatcccagtgtccccacccttcttgtcaaggtgctaaagtggagggcctcccatggggtgttcagcctgggtgtgtagaagcacacagtgtggtacagaggaccctctccagacaggtaagtggagggcggttctccctgaccccaccccaattgtttgttctgggtggggtccaccgcgccccctgccaaggccttctgcaaacactccccaggggctgttgtgggcagcacctgggtggtgcagttggtgtgccagaaaagctccccagtactgggcagtggcccaggcagtcaagcagactccctcaagcaggccccacctacccctcgcctgttcccagctgcctcccaccaaccctagaaatgatgctgggagctgacagaaactgaacttaggagcacaggaggccaggagacctgggacagagaacaggaggtatggggagggaatcttccttcccccacttcccactgcatgagggccagacagtggcacctccaggtcctggaaggacatgtgtggacccaactcagttggccctttgtcttatggcctttcttctccctcccccggggccaggtggatgtgggaggagacgaaccaccatcctgggtgcactcagactcattccccactcctggccttcactccctttcctctacacacaggtgacccctcatgctgctgctccctctgctgaaacccaaactgcaaacctctcctctccctgccttcaccttgccccacggcttccacagacagtgcctcaaccccgaggaatgaatccgaagttccaacaccactgactttcccaggaactcagagccagagagggccaaggaccagctcgaggacacacagccagggcttcttccctccgaaacccccaaggactggacttgcagggctgggacagaggtggggtgggggaaagcaatgccttgtcaacccacgtggggagccccactcccatccccaaggtgcataaagttgaggaacacccctgctcccacgtccatgctcattcagggccctgctccaagtgcttggcactcacaccagcctcctgccctccacaggtattggtctcgtttacagatggggaaatggtggccaagagcctcccccagcacatatagctagaccacacagaggacttaggcacagctggggggtccgcagtctctgctgcctcacctgccaccaaagtgtggtcctgctgccaggtggcaggaaggggacagaagcccgccccaaagagggctggggcaggggcacccttacgcctgcctggtctggcccagtagggctggagagactgtcagtcctaagagaaacactggccttttgggagtatggaaaagtcaggaagcaatccaaagttggtatttaaaatattgatttctagatatttagatggtcatctggtgtgaggagctgggagggccccagggtagagtccacaagaggaggaagattgaaaaggggtcagagtggaaatgggagctgctgagggcaaggcccaaccccctccttgaccccccaaagccagccacagagccagtcagcctcaggccagagggtgtgagcaacggggaccctggctgctctacagtggatcagagccactgggtgtggggagtcttccagggcaggtgtggggccgccggggcaaggcaagctcccagggcagagactgaggccaccccctgcagccccactgcaggggggaacaccgggataggcaagggtcttaacccagaaagccccagcagctcccgggcccatcaggacaccattgaggcttggcggtggtggaacccaggaatggtctttgaacccatgacctggaagggggagccaaggatagtcctggcctgaaggctcctctacctgcaggcagtgtggaggcccagcgaggggaccccaggaacccagaccatgagcttacgtggccaaagacagcagccagcaccaagacatcaaagagggcgggtagaaagatcatcacataggggttgactgcagccggcaccaggttcctctgtacttctggaacacacaggcctctccttcctatccctgaagcgcccatgcccccaccccggcaccccgaaaaccagcctaacatatgcatttgtcctgggtcagccccactgtccaagcaactgcaatttctgactagagagccagggcagggcagggtgtaggaggggtccctggaagatgcccccagaatgccctgatgcctaaaacattccccgttgggccttctcagggagggagggttaagacagccttgttctctccagctacctccatcaccactggagcccttacaggcgtcaggggagagaattggctcaatggagccaggaacagcatggacacagccctggggctgaggctaagtgggctctgggagaccgtcactctctcttcaagctttggtctcctggccctctacaagccaggctgtttcaggctttgcgttaggccttgcacagagacagagttgaaacacagctggtggacacagtgggctttagggagggggcacgtacctgggggtgggggctgggtaacagggaacggaggccctggggctagcatggcctgtctggaggtggcacaatgggacctgcaccacctgaggacagagggtccacctggaagactggaccagccagatggccaccaagctggatggccaccgtcagagcctgcaggacagcagagggggctgggaagggacagaggacagctgaggggcagggaatgtgggttcctccatacagacacatgagtcttccctaagtgggtcttccccatgggggtgagggggcattcaagacacacctccagcccacctcaaaccatctcaggaggccaccaccaactcacacaggccagttgcattgtcacagtgaccccagaacagcacagccctgtccttcagatgaataaacagagggagagacgcatgtcacagccaggagctgggactcagacccaggtccagctgcagtgctttctcgatggctctgcctgcacctcctccaggacttagttcctgctaacaagtgagcacttgagtacaagtgaaataggtgctattatccctgtccagctgtctggctgctggggaaagggaagcaaggcacaggtgacttgcccaaggccaaagtgacagggctggttcaaccccatctgtctcagccagcacatccccatggcagaggctttactgtgatccaaacctggaaggtggaactccttccaatgtcccacccagggcacagagtatgcagccccatgtttggggaagtgaccgggtggggaggtgacagtgtgggaaacaatccagctaggccaaggcctcatggagcccagggttccctaggaccaggagagctctggagcccaccccgacacccattggaaacctggaatccgcacctgcaggagatcaggagaggggtttggcctccgatgcacctgcagcaaggtgagacaggcacaggtgggcgccctgcttccaaccagcgtcaggagagcaggaagcagatctcctgcctgaccttcctctcctgcctcccccaagcagaggagaaggggcagccgcccatcaggccattgcccagattgaagccactgaagctaggtcccaacaggtgagtgtgacccctgactatcccaggcccggcccaatgcagtcctgtctctggtgaggacctggtagacaggagatgtgacatccccaagtggctctataaacctcttattgaggataatcaaggaaatgggcaagaccatcacgctcagcaaagaacctggcaggcacgagggggaccaggggcaggcaaaagtcagtttgggcccaggcctggcccctggaaggatggtggatgaggggccagccacggtgaaggggaatggatggccacgggctgggtggtcaggactgtcagctcctgcagcccctgcggaatgtctgcccaggcctggctctgcgctcagccttctgcctggagccacaggtgcctggacaccagcctcaagtagggatggtggtaggaaaggcacttgtggccacacgtgggcacctaagcatgggacagaggggtattatgccccaaagagactatagaggccaagaacttaagcaggtctgacaccatcaataaacccccttgtcctgggtcacatcaattaagtcagcgcctaccctgaccctgaagctgcagctcagtctggttgagactcacaaagagatgttagtgctgggcagggggcctggcccagcctgcgatgtccagcaaagctgtgggctggacaagaatctctgaagattagtccaggacaaggacagctgtgtctgggcagggagtgggggcaatgctcagggggcaggaggcctgaggacctttaactaggtaggatgccaggtcaggacgtgcagaagggaaggtggcatgacagcatcctgcccgaggccaggctataaacctcggggctgccctgtctagcctaaaccatgctgccacccagatgccatccttcaaatgtgaggctgggctgggagagcccccagaccccttatccctcccgccccaagctggttcccatccctcaccagaaggaaagtgaactcttctatggggcacatcctgccaggttctctatcacctgggggaaggggttggggggagggggagctgcagctgggtgagaaagagcccaggtccactctgtccctacctgacaggtgacctcgggcaagctgctttctttgcctggggccaaggagagtcacaggggaagggccaggttaagagggctccaccctggagcccagagctacccacagagaaaaccgcccatcctcttgattctgctcccagctcatgctgctgggataacatcccccccatcagagaggccgtgggaggcagaggctgacctttgctccttcaggcacctcagcaggtttgggtccaccttcatcatgatcagggagtgggtccctgggatcacaaaggtgaggggcagcttcttgggctccaggtgctccaaggtacaccctgcagggcaccagagctagaagggcattggggaggctgggtgcagtggctcatgcctgtaatctcagcactttgaaaggctgatgtgggtggatcatgaggtcaggagattgagaccatcctggctaacatggtgaaaccccatctctactaaaactacaaaaaatagctgggcgtggtggcacttgcctgtagtcccagctactcgggaggctgaggcaggagaatcacttgaacctgggaggcagaggttgaacagggctaggacctgagctctgcctggccatggtgactctgagccaagtaaccctacattagtctcagtctgtcactgtgtctcataggggatgtcagcattacctttggagtcaaagtaggtaagccagggtaaccagagttccctgcagggaccaagaccaaaggatgcaggggtcaggcctgtcccagaaggtcaggctgaacaagaggctgtgtcaagctggggcagctgaggtcctgcccttcaggttataggcatctgggtcctggtctagaccctcatatgccatccagagacccaaccctagggacaattcctcccaagctggtagaaagagtagatcattgtactcaccgcaccaaaagctctgaaatgatagggcctgtgggtggggagaaagactcttcaggaaaatgttctcaggggcagggaaggtttgagctggatcttagggcagccagagaggtaggtgacaggccccctcacaaagcctgtcagataatgcaggagggacacaggtgtagtggtgggaatgttctggaagacagcaggaagcctcccactcactgatggggctgagtgaggtcaggtccacacaccaggagaagctggaatccgcacaccggtgcactttgttttttgttttagagacagggtcttactctgttgcccaggctggagtgtagtggcacaatcatagctcatcacagcctggacctcctgggttcatgaaatcttcccacctcagcctcctgaggagctgggactacaagtgcatgccaccgtgcctaattttattttttgtggagacagtatctggctatgttgcccaggctggtctcaagtgatctttccacctcagcctctaaaaacactgagattacagggacaagccagtgctcctggtcatgctagtgcattttggctgccatggtgcacaggaggtatgagctggggggtagaatctgctcctggacctctacccaggcctgcacccagactgactcctgggctgcagggagcaggtgtggagagaatgcagtgagcagagcgggctagccagtgatggagacccaggctgggactaggagagatagggctgcaaccctcggcctagtggccctgcccaacccactggggccaagatgacttcctaggagccaggcatggaggccagcatgcacctgaactgaggacagaagattctgatgagagggagggggaggcctctgacatagtttggatacttgtcccatccacatttcgtgttgaaatgtgatccccaatgctggaggtggggcctatagtgtgaggtgtttgggtcatggtgggggatccctcatgaatggcttagtgccctccccatggtaatgagtgagttttcttattttttttcttttatttatttatttatttatttatttttgagacagagtcttgctcacagcccaggctggagtgcagtggcacgatctcagctcactgcaacctccacctcctgggttcaagtgattcaatgagtgagttttctattagttcacaggagaacaggttgtttaaaagagctgatgcttcttctctcttgcttcttctctcaccatgcgacacgtctgctccctctttgcctcccgccaggagtaaaaacttcctgaggcttcaccagaagcctagcagatgcttgtacagcctgcagaactgtgaggcaaataaacctcttttataaattacccagtctcagggccaggagcagtggctcatgtctgtaatcccagcattttgggaggctgaggcgggtgaatcacttgaggtcaggagttcaagaccagcctggccaacctggtgaaccctgcctctactaaaaatgcaaaattagccaggcatggtggtgcatgcctgtaatccaagctacttgggaggctgaggcatgaaaattgcttgaattgggaggcagaggttgcagtgagccgagatcacgccattgcactctagcctgggccacaagagcgaagctccatctcaaaaccctgtctctactaaagatacaacaaattagccaagcctggtggtgcatggctataattccagctactcggcaggctgaggcaggagaatagcctgaacccaggaggcggaggttgcagtgacctgagatcatgccagtgtactccagcctgggcgacagagctagacttcgtctcaaaaataaataaataaataacccagtctcaggtattcctctagagcaacacaaaatgggctaatacagcctccacgcttggtgcccactggacctgacactcagggaagggctggtcttgactctgccattaacagccagactatgacagagttgttcccctgctctgcctcagtttgtcctctctcagctaagcagagcagggataattgcttctcatgtgggccccaggacaaaacaaagccctgagtcccacaggaaggtagatgggttatgtccaagggaagacagacctgaggcagtattttatgttcccgaggtggcagaggtacatggagaagatgcttcctttgtgggccagggagaagggaagataagcagagaggtgccagacacctgcctcacccctacctcccccaccccatgccaggcccattcccacttagcccccaactcaggcagcaccattctacttatggtcagcatgacttcccagccaagctgatgaaagctgacagcttggattcatcagggacagcatgtagtataggtgatgtgcaggacggaagtggagaggggacatgggagccacggtgtcaggtctggggctgccaacatggtacctgccttggctgtaaaaaaaaaaaaaagtcactgttttggggttttctggatgaaacctctgattccattttttaaaaaagggtcgagacagtatgtattattgattcaaagtcataaccagatgcttagagtaaatcattgcatctattgtttcaaaaaccaacctcaggattattaaaagttagttttattggatttttctttagctgtgcttattcactcaggtgagactcactcaggtctgtcatttccaagcccatgttttactactttgtaaccctatttggaaggaaaactgcagctaagattatgacccatcctgccatgaaaagtttcacacatatacaccacatataccccccaccacagtatgatgacacagcaacccaacctcgggcaaatggtaccactgccagcaaatgcatgttttctttatttcttcaaaatgttttttctttatttcttctaatagcagcaaatgcatttaacattttattgagattctcaacagctgtcatttggtttgtatagcaaattgtttacaaagtaacctttttccatttttgatattttaatgaaaattatgttcttcagttttaaagccccatccctctcccaaagaaaggttaataactaactaccaagtaatgattatttaggaaaagaagaaaagcaaaaccagcttgtaaacacttctggaatgtgggtaaggggccaaagtcaagcccttctgggcccagtgcaggtgctaggcttgcctcgggacaccatcagcacttccccatccacaacatcctcaacagctgggagccatgtgtggacccagggggcttcctgttccacaagctcccctctctttttcctctccacgcttgctgttgggcctcccttccaaatctgcctaacaaaggcagcaggatctttaatactgttcagctttgtcaatggagacaggatactctagaaagttgagagatccctggtccagtctgggggaggaaaaaatatacagtgtagcatagatggttttacttgtccattcagacacatgctcatacttattagatggatgtatcagatgcttcaaaagtcctgatgtgtagtagcacaaaagctgcttgtaaaaaaagaagttgcaaaatgataaaaatttctgcagcagttcaggctcctgatgacaaagctggttctgataagtagttcttttgacatgcacagcagctttcactgtaagtcctgtgttccagcggtttcatttagaccataggaagttgaaagtaaagtttaaatgttctctgctgacaaaatgtggtatatatccatcaatggacttctactcagtaatgaaaggaacaaactaccaaaacctgttatatgtcatggaccaacctcaaaaacattagctaagtaaaaaagccagacacttattgtataattccattgatttgaaatgtccaaaaaaggcaagttgatagagacggaaatggtctgatttacctcaagaggtagggattcaagctctctagagtacatgtgatacatacatgagaaaaaataaggaaaagaaaataaatttatatgtaaataaatgaaaataatacttctccctgattataaagaaaatcactttctttttgtaataatttggaagacaaaatatgaagaaaagtcttaaattttgccactcaaaacattctggtttgttgctttttgtattttttatgcatatgaacattttaaaaagtagaattgtaatatatagtcttttgtcactgtgttttgggcatatttctatggcagtaaatatatccttggcatcatcctctttaaaagcccgatgtatattaagttaatcattgccaccccagaagtaaattttcttatacaaatatagtttaatggacgcaagcaagcatttttgggctgaattcatagaagtagaatttctggaggaaaataacataaagcagttttaagatttttaatagaaattttcaaattatcctgcagaaaaattggttcagtttatactcccaacaggggcagagctccagtgtccccttccatttgtcctctttgctggtatttaagcagaaaatctcattgttttcattacatttatttggtttctagtgcttttgaacctttttttttttttttttttttttgagatggactcttgctctatagcccaggctggagtgtaacagtgtgatcttggctcactgcaacctccacctcctgggttctgggttcaagagattctcctgcctcagcttcccgagtagctgggattacaggtgcccaccaccatgcctggctaatttttgtattttttagtagagacggggtttcaccatgttgatcaggccagtcttgaactcctgacctcaggtgatccacccacctcggcctcctaaagtgctgagattacaggcgtgagccactgtacctggccttgaatcttttttatatgcttattggccatttttattcttgtgggaaatgtctgtttctccattgcctgttttctggccaacctccaaagtcacatttcacttttatcctgttgattgaaagcattttaacttagtgattttttaacataaccaggagcaggacagactgtaattatctagatcttgctctgtcacccaggctggagtgcagtggcatgatcatagctactgcagtctcatactcctgagctgaagcaattttcctacctcaccctcccaagtagctaggactacaggtgtgtgccaccatgcccagctaattttttaaatttttttatagagatgtgaattcgctatgctacccaggctgttcttgaacttctgacttcaagtaatcctcccaccttggcttgtcaaagtgctggaattacaggtgtgaactactgctcccagccaagagctcattttgtttgctagtggtgttcttggtatctttttatatttgaggctttggtgctagtgctgaagtattacactcaccatccgaggtttaaaggacttttgcggtaatattgaacagatggaactgttaagttctgcatctttgcaggcatacaaaatgtgcctaccaggactctgctttatagccattgatagcaagaagtaatacagtaaaactttgccttactagaggctttgaaagaatggagtattctgatttaattctattaacttggaagtatgaaggtaaaaagaattcaaaacttacatttcctgttgaatgcaatttgaaaatatagccaatgattccacttttcttctctagtaagtttggacattctgatctacttgctgttttattatagaactgctagtgtgcctgagacttacattgtgaagacactttttaaaaaacttgagcggtaagagggtgtaaatggtattgtgtgagatcaggctggatgagaactgacacttgtaaacatactttttaggctgaatctctgattgccatttgttttcttatttaactcataaaaataaaacacattggatggagggtgggagtaggaaggagatttatgtcttttaattgcatgtcattgtttcatatcaagacagaacatatggtatccttggctttggacctacagaggaaacacatttttctacctgccgtatgccagaggttcttgaacacctggagggatgactgcagcacagattgccgagccctactccagagtttctgattcaccaggtctggggtggggcctgagaatttgcacttataaaaggttctcaggttctgctggtgctgccagtccagagactacatttttgagaaccactcttgtctactaactgtaaattgtagaactctagaacaaagcttagtttggtgtaggaaaagacgctcacaggttatggagcaaatcatgaaagattcaacccttgatcccagcctagtgtggaattcaggtaacaatcaatacacagtgacataacacaattcttggttttcatgattgcaagtcatagccaagtatcaagtgagaaattcagtttcatttgcaaggcttagagaggccaggtgattctagaaaaataggccttgtatttactttaaaccagtaaagaactttgagtgcttattaaatggcaagctttgtgtttttatttatttttttactattttattttttttgaaatggagtttcactctgtcgcccaggctggagtgcagtggcatgaccttggctcactgcaaactccacctcccgggttcaagtgattctcctgccccagcgctgggattacaggtacccaccaccatacctggctagtttttgtatttcgagtagagacagggtttcaccatgttggccaggctggtcttgaactcctgacctaaggtgatccacccacctacgcctcccaaagtgctgggactacaggtgtgagccaccacatccagcccaaaagctttgtgtttttaaagatattagacatgtttcttgttttttaaaaaatcttaacaatgtaggagaataagagaaatgtttttccaaaaaagagaaatcatggtgatcattttaccttattggaatgttggataatatagtccgcttcattattcatcaaacatgctatggattttccatttttataggatttatgtctcaattgaggtaatactggtaattcttatactccatctgaagatgaaaaatgtaggccacaatcatagaccatgcataggagctggataatgaagacagctctggaggaacatgtagacacacacacactgacacacatatatataaagtataaatacatattttttaaagtttatttttaaagttttaaagcaaaagccggcccctcccctctcccagagtaggcaggccccacccctctccccaagtgggtggggacagcatttgcataggcagctttccctgtgatgccacaggttcctcgggacaaactgctgcctggccatgcctcctttccctttcatctttctcattgaccaatgggcttggagcattaaggccacacccctattctgtgttctagtggggccctggttacgcctcctctggctcagtcacacaggtgcctgatacgtgactggaggtgttcgctgatgtggccccaaccctgccttcctccccaccccacgatgttagaagaaactcaacagagtaaattggcagcagccaagaaaaaggtaaaacacacgagttcatggccccccaacccagccagagatccctccaatgacaagaccactgctagagtccataccactcctgaggcataccgggctgggcccccccaatttggggcctctggactccccccaccaaagtcttgtcagtcagccctgccccttcaagcaagcagcccagcccctgccctcaccaaccaccccagggtgactttgggtgggtgactcctagtgctccctgctccacactctgccctcatgtcctgccaccccaagcctgacctccctgggttctttgggctcatctctccaaggacctgggtccccagccccagcccctcccgtcaccagtcatccctgggtgactttgggctggtgattcctggggttccctgctgcagactctgctctcccctcctgctgacccaagcccaacatccctgggctatttggactggagtctccaaggacctgggtcccagccctaagtccccctcccccatcgtggatcggtgactcagccatcacactgatgaggtttcccccacccccaggaggagtggaatgtagtgatgtcacagtccccctaggaactgtcattactgctgcaagaccagcctttgatcttatgacccaatcccctaagcattctccccccatttctggttcctctggttgcagcacaaatttccagctggaaggggaatggggactatgggacctaagagcaagaggtttcaggctgctttattcccttcacatagacgttgacagtgtgaaaagcctacacttcccccgtgagctcaaaatgttgacagtatctctgggtgacaatggaaaatgggtttggttttgttttctcccaggcttctactctccagagagacttcaacatttttttctgagttctccacctcatattctaattctccatggttctgggaccagactgcccttcagtcagtggtctctgaagtgagattagctcatcttctatggaatagatcttggaaaactaaacttgacagcttgaatcttcctcatatcatctcaacttggggtacattgagtgccacaggataaatgcgggagatctttctgaagcatcagtttcccttgattctcttgagacagaaaaaacattaatatacttagggatgaccctcacataggtttctaagagtataccagacttttctctgaaatgagatgggttgtactctttctgataaattcccagatttaacaaaaaagctgccttctgccatgaggacacatagatataaaagtttgagaggtactggtgcacttcttcacactaacagacatgtgaggatgtatgactctaaaccacagagtgtgcagttcctgcctacttaatgtttacttttctacttctgcctctggttttggtccctggcagctgctgattcatggcaaaaccccagagcttggagtcagaagactgagtttaagttccattattgccccctccttttttagccataatatcaatctctctcagtcactaagtgattgtgacaacacattgtacagttgttagtggcattaaatcagatggtgtataagagtattttgcaaaaactgtaaaggaggctgtggctgtagggactggtagttctcatgtgtattactgttcttctttcccacagctaaaagaatatcagcagaggaacagccctggtgttccagcaggagtgaagatgaaaaagaaaaacactggcagtagccctgagacagccacttttggtggttgccactcacctggggctgtgagtcttggctggccaggctcctggggacagggggcccaaggggcagtagagggtaattgttgagattgctgggtactggttaagaattctgggtttgaatcctgcttctccatcttctagggatctgatttacagcaaattgcttgagctctttgggcctgtcttttcacatctgtacaataggggtagtattgtttgacttccatttgtaaagtttaaatgagattccttattgctgtttttatgttaatccctagtacatggtctgctgtaaagaccaaggatacccaggaaatggtcattgctctttgattttcctgatccccattctcaaggggaagctgggccaatgagtacagccacttgccatcaggctgtcccctataggagtcactgaaggggcctggtgtggtgaggagagtcccgggtactaggagtaagagaagatctaagttgccaccagcttgctgggtgaccacagaaaaattgcttcttcccctgggcctcagtttcctcctctgtaagatgatactggataagatcagtgcctttcaaacttgttttttagctggagcccccttagttccagtgaacccttactcagaagtctggtttttttaatggaggtggaggtctggagctctaccagattcatcacccacgtcctgggcctgaggagaggggttcagtgagcatatgaagagctgcattggtcaggtgactccactctgtgactgcattgttcaggagacttttccatctatttgttcctgccctggcaaggcagcaggtggccatttcaaagagtgggacaggccaaggttttaatctcctctgctcttcttcagcatttcattttcctgaacccacatcctcctcctaccctgactttcttgcttctctctaagacacttctgtctttctccccctgcccttgttttttccttttcacctcctgtagattcaggacattctgaaggtgctggtgtccaatcttaaccattccaatggggtagcactcccccattggataagtggaaggtgaggcagtgccaagacccttctctggcttgctgtctccggctatgcatggccctgaggcttctgtggtttgggggatacctttcctctgccttgttttatgttgctgccattgaccttcagcctgtttatgtctgcttcttcacctgcttgattgattgggttttttccttccctgcatcttttatcatcttagaaatggtgagatataccttaaagtttaaaagtaatttgggaataatgtacagagcaggcatatgggctttggagccttttttttttttttttttttttttgagacagggtctcactctctcacccagactggagtgcagtggtgcaatctcggctcactacaacctctgactcctggattcaagcaattctcttgccttagcctcctgagtagctgggattacaggcacttgccaccacgcctggctaatctttgtatttttagtagagatggggtttcaccatgttggccaggctggtcttgaacttctgacctcaagtgatccacccacctcagcctcccaaagtgctgggattacgtgcatgagccaccatgcctggctcattgctgtttttatactttctctatatccataactgtttcccatgtaagtttttgtttttttgaatttctcatttttattacttctgcatcatctgttaccctgaaggatctggaggtaagaggccctgggccaaggtgcagtgaccctgcaggccagccctccaacctcctttcacagcaggggctaggtgcccctctgccagctgagacagcccacacacaccccagccctaatgattgttctctccacctctccccacaatcctcctccaactcctcctctctgcatgcgcctcagagtcggtaccaagaactggaattagccctggactcaagctccgcaataatcaatcaactcaatgaaaacatagaatcattggtaagagtccagtagggtcccctgagtccatgcttctattcctgggctttagtttccccttggggtcctgaagaaaggggctggggggccctggtgccaagggcaaatggggagctggagcacccaggcctcacctggagggaccccagagcaaggagcatgcagcatggctcttctgttgctgccctctttgccaactctctcttctctagatatccctgctccagtccttgccacactcgccctggggttgtcgtctctcagggaagtactagcctgactggttgtcagggaacctgcgtttctaccctgagtcagtccctaatttgctctttgagtttggacaagccacctgtcctccttgggctcgtgtttccggagaaggtagagcatcaaaggtctctattagctctgagaatctgagatttaaaggcctccagaatggaaacctcagggtcaatggctcctgtctgtccttttccatcctatatctgctgtgaagaagcatacctggcccatacgtgctcagtaaatgtttgttgaatgaaggcacctttctaaatcacaaactggcagaagagtgggcatttctcagactccatctctagaggtttatgttactgtcctttcaagagaatccagattcagactttgagttctgtggctgtgggtgaaaaccaacaaagacccacatcctctgtccttgggagcttgaggagagttgaccagttcgtgttgccactgggtctgagaatgttgcctttaaaatccattgctggcccctgcctaccgcttcctggtctgggaaatagagttgagggggccactctcagtcacctgaatttgactctccccacagaaacaacagaagaaacaagtggaacatcagctggaagaagtaacgtgattttttgtttgctcacaacgtgactgctgggtttggggggcactcagatgcagaggcgccagtctcatcttgccctctcccagcctggggaagaaggctcacccctcagattccaccccatccccacagggtccctgataacctggtcccatgggtgggcctgtcctggggcattggtggcattctgggagcatgtctcttgctgtgccatctcggcctccccctagtaagagctctgtcttcctcttcctataggaaaagaaaaccaacagtgaaatacacaaagcacagatggagcagttagaggtgagtggagggtggggagctttctcctgtcctctggagaatatttctttccttctctttcagcatttgcttggcttttctcccaaacattcaattccaggcaatcgacatcctcacattggaaaaggcagacttgaagaccaccctttaccatactaaacgtgctgcccgacacttcgaaggtgggaacctgggcaccccatcatccttcaacctgtcactttgacaggtctttagggggagtcctttgggccccatctcaacctctctcattacagaagagtccaaggatctggctggccgcctgcaatactccttacagcgtattcaagaattggagcgggctctctctgctgtgtctacacagcagcaggaagaggacagggtgagtccaaccagcagccccatcccctggcagcctggcttcccagattgaggagtgagcctaaaggtcccttctgcaggacggagtgtcctgcccagaaggcagcatggtcatttctcgctacttttgtgtatggctgttagaggcagctgctgtgggtgagttggggggcactgtggagagtgagcactggatgcagagctcagaggccaagtgcttgccctgccctttcctggctgtggccttggccaagtcctaggtggggtattgggtacttatactgtgaaggtacagaagagtacctttagtatgttaccatttctgtagagagaagaaaggggtgtgtgtgtgtgtgtgtgtgtgtgcgtgtactatgatgatatacaaaaacatgtctgcaagggttcataaaaaactcaggagagagtaacagggtggctgggagactcttcccttctgtatcttctgagttttggactatgcgaatgtatcatcctttcaaaaagtgaacaaaagattaatttccccctcctatctgtgtccccacccccagcaagaaaaatgggcttagagaataggatagacctgggtgttcaaatcccagctctgtctaagtgatcttaggcaagcacttaaccttgaacactcgatgtttttcatctacacaatagaggtaatcctagtaactgtgtcatatggtggttgtgaggattaaatgggattgctagcatggaacctggtgaagcactccataacggttcaaacagtggtagtaataacagtaataacaatagcaatattatctgatctctctgggcctctgttagccagctgtaaattcgatctctttccctgtcccttccaactttactgagttcttttaaaaattgggccatgggcttggaaatgccttgatctttactaaccgagttgtatattgagcctagccctagcccttttaaggggcactgcccgggatccccagatcaaaacttctcactcttcaccctccagtcctcgagctgcagagaagcggtcctccagtggcggttacagcagaccataaaggagcaggcactgctgaacgcacacgtgacacaggtgatgctttgcagagggagggatgtggaaggaagatgaccccaggtggccaggagcaggtgaggaccagtgacagcccttcctaacttgtgtgcccattcttgcaggtgacagagtcacttaaacaagtccagctagagagagatgaatatgctcaacatataaaagaagagagggcccggtggcaggagaggatgtggaaaatgtcggtgggggtgaggtctgacccttcagcccccactttagataggtcactggatctttctgggcatctgtaaaatgggaatagtacagccagaggtggtcatgggtctcggctttgtggaggtggggacacagagggagatggtagcctgtccagccaccagcccctctctccagggccctttcccatgtgctttgggcaggctcgcacattgaagaaggagaagaagcgtgtcatacatcagatacaggagctggagaggagcttgtccaaactctctatgtgaaagtggcttggaaattggctaccgtcgggtgggaggaatcgttagcagtgaggccaagtttgggaagcctgagaggagctgtgcatcaagaggagggttttttttggagggggggtggggaatccagaggcccttattgtctgctttgtttctcagctgagcccccatccccggcacccccagcagtgacctctgtggtggagcagctacaagatgaggccaaacacctgaggaaggaggtggagagtttggagggaaagctccaatccaaggtggaaaacaaccaggccttgagtctcctgagcaaggaacaaaagtagaggctccaggagcaggacgagaggctccgagagcaggaggagtggagggtgcgggagcaggagagactgtgtgagcaaaatgagaggcttcgggagcagcagaagacgctacgggagcagggtgagaggctgcgaaagcaggagcagaggctatgcaagcaggaggagaggctgcgaaaggaggaggagaggctgcgaaagcaggaaaagaggctgtgggaccaggaggagaggctgtgggaccaggaggagaggctgtgggagaaggaggagaggctacaaaagcaggaggagaggctcatgctctcccagaaccacaagctcgacaagcagctggccgagccacagtgcagcttcgaggatctggtgggttgccccacctggggagcctgccctcatccctatctatccaggcctttgtttccccacctgtaaaatggggcagtgtagctctcacatgaaatggtacttctaaaggcacctgtgagccagagctcatcaggccttgctctgatggctgtgggggagaagggatgatttttctaacctgcctccacccttcctggtgacatgggaggcagacaccaagttctggtgtctccagctgcagtggatggccactgattgcttctctctgtccagaataacgagaacaagagcgcactgcagttggagcagcaagtaaaggagctgcaggagaggctgggcgagaaggagacagtaacctctgccccatccaagaagggctgggaggtgggcaccagcctctggggaggggaggtgccaggccaaaggcagctccagctggggggcagctgaccccagcaccctccagggcagccctatgactgtttcttgcttcctgccctctgacttttagaggtgggtagccctgggctcctcccaggtctcaaaatcatcatcccagctagaggcatggattcccccagtcataggggaagagacagtggtataagaggctccttatgccaggcatggtggctcatgcctgtaatcccagcactttgggaggctgaggcaggagaatcacttgaggtcaggagtttgagaccagcctggccaacatggtgaaacctcatttctactaaaattacaacaacaatgaaaaatggtgatgtatgcctgtaatcccagatatgagaatcacttgagcctgggaggtggcggttgcagtgagctgagattgcaccactgcactccagcctgggccacagagtgacactctgtctcaaaacaaaacaaaacaaaaaagcctccttggattcaaactggattctggcctcggttccactggtgaccattcaactacttttcatctctaggtctctgtttctttaacttcaaaaggaagttagcattttccttgcagaggtgctgaggattgaatgagagaatacatggaaagcattaggcatgtagcacacttagcagatggtggttggctccctctgcttttccaccagtctgtggcctacagtttaaatgggggggaaaaggacatgagatttgaggctagggaaggaggtatggggttctaggcaagggaggaagtctcttaagcctggagcaaggggccaggggcctgggcaggtgacagagccccacaggccctctctaccctattaatgggcccagaatctggaagccagccaccacgtgccctcatgcccagggccttcctgcaggtgaagctgaagagccaagagtctcagagtctgcagcagcagcgagactagtacctgggacacctgcagcagtacgtaaccacctatcagcagctgacctctgagaaggaggcgctgcacaggcagttactgctgcagacccagctcatggaccagctgtagcagcaggaagcttggggcaaagcggtggctgagatggcccaccaaaagttgcaggagacctaggggagggtgttgctgaggacagggccccgagggggatgacctggcaacctctgtgccttctcactctgttttccatccccttaggaaccagctgccagccaccagaaccaacagctagagacccagctaagcctcgtggctctccctggagaaggtacaggagaccactcagaggaagaggagagagccccaggaggaaggggggactgttagcagcataggattgaggggttggaagagatctttagaacagctggtcgttatgccaaccgggtgtccgcactaagttcagcatcaatatggtgacctcctaggagcagggggccatcaggttgcctaaggatgagtgaactggccagatcagaaagggagcaggtcagaactcctgcactgaccagtaatgggactgtgcctgggcaatatagcaagatcttgttcttaaaaggaaaaataaaggacagcagctcattcccctctggggagaggctggctcagggttacacattgagggtggggacagaggtaggcccagagtacctcccttgttgggttgtctgaggatccctctggccacctccccacaggagatggaggacaacatctggacagtgaggaggaggaggcgcctcggcccacgccaaacatcccagaggacctggagagccgggaggccacggtgagcctgactttccctgccccgctttgccaccttcctctgtggtccctcccagacccccttatgctcttggtttcccaccttctgatttctctggcccctcaccccttccgggagccagtgatcagacaccatttcacctgtgaccaacaggtgcgctctctgaggccccaagggaaggggctgtgctccacctccctgcctcatttgttctgtgtatgcccctacaagaatactcacctcttgccttcaagtggcatttttcaactctgctggagccagttcccaggaggagcaggcacggctatgtgggcagtggaaggtgcgaaggctgtgccacctgcacctggctcatctggtggccttggcctggaaggagccagaggcagaggccccagccccagggactgggggtgactttgtgtgtggggagagctaccaggccctcaaggaggctatggagaaggtgaaggtgagtgagtcctggcaagggccaagaaaagtaggggcagggcaggacaggtcactcccgagatgtgaccccattattttggctccagagcggctttatggacctcccgaaggagaaggtgggcaggaaggagcaggtggaaaaactagagcttggattcatccagctctctggagcgacagacggcatgagtgagcgggaggccagggcacggcagggggagctgcagggctgtcggagggaccccagcgtctgagccgtgtcctctcacaggagagtacatcactgaatatgagagccagggggcagtgccaaacacgcggcaccaggagaaggaagacatcatcaggctggcccagaaggaggaggagatgaaggtagggcgtgcaacatctctgcaggggtaggggtgggcgtgggcactggagccggctccggtgtggcggctgagcacccctcccttcaggtgaagctgctggagctgcaggagctggtgttgccccttgtgggcgaccacgaggggcatggcaaattcctcaccgctgcccagaaccctgccgatgagcccgctccaggggccccagccccccaggaacttggggctgccgatgagcagggtggtgagtagagccctcaggcggggtgggcaggcaggagcaggggaggctggcgctgccctcagacccccgcctccctctctctgaagatttttatgaagtgagcctggacgatagcgaggagcctgcaccgggagcggccggggagggttctccccatgacaaccccactgcacagcagatcgtgcagctgcctcctgtaatgcaggacacccaggagcacccaggcttgcccggcaacccctgtgtgtcattcttttaccaggcagccgagaacagggagataaacatcatcatctaagagctggtcaagaaattaaaaaaaaaaaaaacaaaaagttatggggttcatctcctacacaattcatttactccatttgaatgttagagccactcatgtttatttgtgtttctaatttacagtttaaatttatttgtaaaaagttaagggagagtgggtctttccctgatgttcactctggcatcctttagcatttttgtttttaatttgataattgtaggtcattagcacgcatatcgagtttgcccttatgtggtgggagttcaaacacacaaagacctactatttgcgcaaaactattcttgctggtttggaacaggctgccatgcttttttaatgttattgcagcacgtatattcattacagaattcagataaaatgtgcttatgttctgctattatgtttgatcgaatcctaaccacagtgagctcttcattagctcaatatgtggtttgccctcaagtgcgcaccgtttattactttgtaatatgccactgtgagtactgacatttagagttgtttaaaggccgagaactggaaacagcatttcccctattttctgtgtattggggatgagagtaataacattttggggagcttttaaaatctcacagaagaggaaagtggcctgctctggcaggtgtgtgcaggatacagtgtgtttcatttgttctggtgccaagaatgagcgctgtactgtggtggcttccttaggatttgtgtgtgctctgggctcatgaagatattgtatcatgagctgcagcagttgtaccctttctcgataacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacaccaaaaggcactgcttggcattcttcttaatgtatttagtgaggatcataagaaatcctttaagagtttaaatgtccctggaacaggcatacgggctctagtcaagaatgaattcgagtgaaggaaagctgtgtgacacttggccttcctctatgttcatggagcttctttgaggctagaagattgattttatcatctagacctctctggctaatacctattcttcagccacgttggtttctctgacataggaatttacttctttcccttgactggaaaacactttaaaaataataaaaaccattattataaaccaatatatgtgagagtacttagttgaaacaaaaaggagttttagtagacagtattatactacacatgaaaatcaacgtgaagtttatgcaacttaaaatgtttacaagctgccgtgcaatctaatgtttgtgaatgtccaagtattatgaggaaaagtgtctatacaattatagagttatatttcctcacagggttctttacaaagagtgaaatatgtttttatacctctcggtttcagttagaggcatattttgtgccatatttatgttaatgtgcctatacatgatgaatgaattatttcagtcatacattgcctaaatcataactttaagatgcttgggaaagaatcaacagctaaaatttcatgaagttctaaagtctgtgttccaaaatacgtcacattattaggatgcagggagagatgcatgtgtgctccctggggtgggcatttctagtgattagaccatctccatttttagcatttggcatcttcattgatacttttatacatacgacattaataggagagcaataataagattttacagatgaaataacagatttgcctgcagtcactgaaagagtgcaaatattgggttattgtgacttcaactgactcttccaaattgtttgaatttatcaatgtattagataaacccagtttcagaatgataaggaaaaactgttagaccaaataatgtggctaattaacagtggtacaatttctagcctgagggtttaaaatggacttaaggtcctgttcttgcctcctattttgtgaacttgccgcttttgcattatttgagttcacttgaaagacagttactttaagtccattttaaaccctcgggctagaaatcatactactgttaattagccaacttatttggtctaacagtttttctttataattctgaaactgggtttacctaatacatttataaattatttcaaaggtatttttatagttcagatcacttcacttttaccctgataaatataaatgactaggaatgaccttcagatagcctttagcacctgtaaccaatctgacaataatgtgttcatcaggtacctatggattaaatcacacactggcatatttaagctgaatgtcagtctggaaaatgaatgtactatattaactgaaataccactctttgtgtaggtattctgtcatatatttaagaaaaattaaatagcatgtaaatcgtatgacaataacctaagtctttcttcaaagtgcatgcgttcctttgcaatacctcattcagccaagtatttgttctcttcctcattcagtataaggcagctttcaatttgcttagaaggcaatattggaaggttagagtttatcagaaacatagaattttaaagtgtgagttcaactgaataaattagaatttctgtagaagtgaagaattaaaatacctatttaaatattgcaatatataataatttttaaagtatttgattaaacctgataggtttttccagaaatgaaaaaaaatcagttctaaaaccaaagctgatatttagaaaatctgaaaatgtaaatcagccctatccataatatagtttctctaaaactttatcttaaagagtcgttttaaaagaatataactatttaaaaatgtaactgctatcttaatgttttgaaataagttaaaacattttaaaatatgaatactgtagtttaaaagaaaccgggggaaggaaaagtagagaaagaaattccaattccaatgcaaagctttatttgccaagttttcttagaatgacttttaccaatttatgaattcttgtaaacagaatgtataatggaaatactgaaacactgttgcctaaagtggcataattgactgctactgtgatgctactgtaatgtaataaattattaaattgttgcaaagtgctgtttttgccttaaaattttgtgtgtcttgaaaactatggtgttaaaagtattgaaactgtgcaaatgctgggcacgcttggcatgagataatcggtttttatttttacaaaattgtaactatgcaagtgtgtttatttaaagaacacaaaccaaagttatgggataaaaaatgttgtggaatgaaaaagttacgggacaaaaaatgttgtggaaaatttgtggcaaaaaaaagttgtgcaaaaaggtagaataaagttttatgaaaagttttaaaaaagtattatgaaaaagaagttataggattaaaaaataagtcatgggataaaaataaaagcgggcccttgtcagcataagcctggagaagtggggctggagtctctgcccccaccatgtccctaccaccccttcccagtcacccatttaccattagggtagcaagacaacacccctgtctaatggggggcagacaaacagaccctttgccacctgaccagggctgagtccttacatttctggatggcaacgtttgttacttaagagctagaggctggtggagttggtttgtttggaggaggcctgatgatctccctactctcaccaaagcaacttttccctcagggcggctcccatcttcttattcagagaggcagctgaggcgggacagtggggctaactgtagagcaggcaagggctcaggctgctggggtggacccccttccgcagtgtacatataatgtctgtgtaacattttgtatatgcttgggggtagggtcaccccctgtatcatacctagcggaggttggagctggcatatggggaggaggttctaatcattatttggggctgggaaacttacttattgatagcataggacagaggaaggaggcggggatggggtcctggctgccttggtgatgtgactcctgcctggcctgtgaggtgtgttgtgggatgaccatgtgtatgggactgtcaagattttatcctagatcactactggattgccaacagatagaggaggtgggaccctgactatcacccctgctctgcagtggatttggctctcggcactcccagactgggagctggataccctgacctggcagcatgactcagactgcacgacagatacggcgtgcccaggatgacgttcctaggcctctggcagactcagattccagccccacacacaatgccctccaagttccagcccctacaccatgaaccacgagctctctgccctctctgacagctccagagagcacccacgtctgccaccttgggcatggagcctgttccaagatcccacaggctcagccatggaggctggggcgctttggggccatgggggccagccctggtacctgcgtcgggctgggacgctctgcacttacagccaggagtcatccatgggcccccgtgggcatgctgaccatggttgttttgatgtcgccgatgatgttgggcgcctccctcagcacatggtgcatgcacagcgtctcgttgcaccattttgcctgctccgtggaatcctccatcagcatgttctcgtctccacatgagtacagtttggccagcagctctgagaagatgaactccttggtctgagaatgggcaaagaaggaaggaggttgggacctgatgcctgtgtcaccctggccaccccaccaggccctgctgggactgtggaatggacttggagccccaagcatggcttttcagacgtggcttctacaccacttagactcaaagacccacctatccaccgcctttttttcactcagatggggacactgaggtccagaggaaaagtcaagtcaccagtccagggtcacagatctgggaggggacccaggacctatcatgccaccaggacacctgtctactcagtttttaatttttggagataggatctctctctgtcgctaggctggagtacagtgggcaagatcactgctcacggcagcctcaacctcttgggctcaaagtcatcctccaaggctagcctgttgagtagctaggactacaggcacgtgccaccaccaggcccagctattttaaaattttttttgtagagaccaggtctcactatgttgcccaggctggtctcaaactcctgggctcaagcgatccttccgccttggcctcccaaagtgctgggattataggcatgggccactgtgcccagtcccacgttatagttctatgggacagctctggtctggaccgtgaccctctccctgcacctggtcccacagggctggttgtcatctctgccaggccaacacagccacctgtgtccccagtgctacaggagcccctgcccccatgaggtggtgcatgcatgttgttgatcatgaggtgcatggtggtcttgggcgtgagaccaaccatgaggtcccacacggtcttgttgacaatggccacataggagtccaccaggctctgagtggtctccatttgccacaccagctgtgggtccatggagtgcatgaagctgtcggagccattctcctcggccttgctggcctgccatggagaacacaaaggcatcacggtggccaggacatgcagccaggctccaggatctcagcccttccaagggtacctggaacattgaggcacagggagaagcaactggccagaacacacacccagatccccacatgctctagagggtttcaggtctctgcctctcaggaccccagatgcccctgatcaagcctcatcttagttctgactctagtacccagaatttgcctccatttcccaatccagaaattggaaaagaacatctccaggtccctcgcttgaagacatggccagagctggtgccaggctacagatgcctggcaggaggagagaagggcatactcactttccccttgtcctgggaggcccacacaccaacattgccaccaccgctgccacctgggagcacagccaaagtagacacacacaggaaaaggggaagggttgagtgaagctgggacactgcaccccaaatttaacgtgttgatgaattcaatttgctaatattttgtggaggatttttgcatcaatattcattagtgatattggcctgtagttctctgttttggatgtatctttggttttggtttcagggtaatactagccttgtggaatgagtctgaaatagttgggtaaggtctctattttttgaatagcttgggtaaggttggcatgagttctttaaatgtttggtagaattcagcaatgaagcaccaagtcccaggcttttctttactgggagactttttattactgctttgatctcattatttcttattggtctgttcaggttttggatttcatcacggttcaatcttggcaggctggatgtgtctacaaatttatccatttttagtaagttttcctatttctttgcatacagttgtttattattattattattattattattattattattattatttttgagatagagtcttgctctatctcggctggcatgtggtgccatgatctcagctcactgcaacctccgcctcctgggttcaagcgattcttctgcctcagcctcccaagtagctgggattacaggttgtgcaaccacacccagctaatttttttgtatttttagtagagacgggtttcaccatgttggtcaggctggtctcaaactcctgacctcgtgattcacctacctcagcctcccaaagtgctgggattacaggcgtgagccaccacacccggccttgcatgcagttgctttttaatagccactagtgatcctgtgaatttttgcgttatcagttgtaatgttttcctttttcatctttgattttattcacttgagtcttctttttttcttagtcttaggcttaaagtttgtcaatgttgtttatcttttccaaaaaccaactttttatttcattgatgctttttattgttttcttcattttaattccatttatttctgctctgatctttattatttcttttcttctactaattttgggtttggtttgctcttgcttttctatttctttaagatgtattgttaggttgtttatttgatgcttttctgctttttaaaagtaggtgtttatagccataaagttccctcttagtattgcttttgtcgaatctcataggttttggcatgttgtgtttccattatcatttaagaaatgtttcaatttccttcttaatttcttcattgacccactggtcattccagagcatattatttaatctccatgtgtttgtgtagtttccaacatttctcttgttactaacttccagttttattccattgtgatcagagaagatgtttgatattatttcatttttttcctaatattttaagacgtattgtgtgatttaagatatggtctatccttgagaatgatccatgtgctgaggaaaaaaatgtgtattctgtagcccaagggagaagacacccaccctcactctgctgcaacagcactcttctcagggatggggcagtggagtgctgttgttacacaaggggctctctgtcggggagggaacagaagtctgttctgtagtgtttgccattttcggtggtgcaaatattccatggctgatttcaagctgccaccatcttctcagcctgggcttgtttgtcccacccttgagaaggctttccaggtatttgaaaggatgcgggtgttgtgatctaaactgtatctttattaggggacactccaagcccagttatgctatggttcttgcagactcatagaggaactaccttggtggtcccggataagatctggaagaattttctgagctaccaggcattagagactcttattctctacctgtaatttctttctaaaaaacagtctctgactctgtctctctgtctctgtctctctctctgcggcccccccccatctctctctctctttctctctctctctctgctgagccacttggagctgggggtgagctgacacaaaatccctatggccaccaccactgggactgcactgggtcagacctaaagccagcaaagcactgggtctcactcagggcccactgtcaacactacctggctattgcctatgttcactcgaggccctggggctctactgtcagcaggtgtcaaagccagccaggcttgtgtctttcccttcagggcaacaagttcccttaggccctagcatgtccagagatgctgtctgggagccagggactgcagccaaaaaccttagaaatttacctggtgctttattctaaggcggctgagcagacaccgaaaccatgagacaaagtccttcccactctgtctttccccttccacaggcagaggagcctcaccctgtggccaccaccacaggcgcacacggagtgctgccaggctactgtcgatgttctcttagggcccaagggctctgaaggcacttgtggtgaatgcttccaggcctgggactcacccttcagggcagtgggctcccctctggcctaggacgggcccagaaatgctgtctaatagccaaggcctaaaatcagtgaccacaagagcccatttggtgctctaccccattgtggccaggcaggtacgtaagctgcaaaacaaagtcccttttacctttccctctgcttttctcaagcagaagaagtctctcaccacagccaccatagctgggaatgtgctgggtctcacctgaagccagcacgtcgcagagccttactccaggcccatagcacactgcctgggtatcactgttgttggctattcagggcccaaggttcttgagtcagcaggtgatgaatcctgccaggattgggttgtttcctttagggcagaagattcccttctagcccagggtgtatctagaaaggtaattcaggagctaggtcctggaatgggggcctctcaattctgactggtgctctgtcctactgtggctgagttgctatccaagatgtaagacaaagtcctctttgcttttcccccttctctcctcgagcaaaaggaagaagtcactttagttgttgcaagctgcgttgcctggggttgggggagcggtggtgcaaacactcccttggctgtcctggctggtgtctctctaggtcgtgtgccccctgagtccactggctctgagcccagcatggcattaggatgtgcctaggagttgaagtcctgatggactagactgcctttcaagtttatttagggccccagggcataacagcctgccatgccaaggcttgtcaaaacccaagcctcaagccttctaactactgggatgggtgaacccctctgggtagggctggtctaaatgcttcctccatgggcaggtgtcacgtgagttccacctggttttgctttctgctgtgacaggacagcaatgagttcaaggcaaagtcccacagttgctgtattctccctcccccaggtgcacagattctcagcaccacagtgaccactgctgggggagggggaggggtgatattggtgtttcaaggctgtctctcccaccctcttcaatgcctctttcagcaacatgaagttaaacccaggtactgtgagtcctcgcctgatttttggttcttatgatgatggttttctggtgaagacagtcgttaaatttgattttcctgcagggggaatgattggtagagactattattcagccatcttgctctgcccctcctccctcacttcactttaattacctcctaatagccctatttttaaatacaatcatatagtgggttagggctccagtgtatgaattttgaggagacacaattcagtctatagcatttggacttgggaagagggaggaaaagaacacgcacaggaaagtcacagtgtaagcaacagtatggaggtggggaagttcagctcatggataggaaaaattgatccaattaggcagggcccacagggagatatggtgcggtggtgagaggtggccacatcagaaagaaccttgaatgccaggctgagatgggaggcatttcctgttgtgtagaaggtaccatgaggtgatgggtagggtaacatgatgaaaggacatttgggaggatggatctggcatcagtgatgggtaggggtgaggagtgaacaaatctggaggccaggaaactggacacatggcccagagttcaggcccagagttaggctgttcaaaggcagtttccacactgagttcccatgtggatccaagcatgcagggggagatgatttggaaaagcaaaagcattctcttcccattaccacacagtttcccagctgagctcatcaccagagtcctacaaatcagacagtcaaactaccccaaactctgtccctagaagctgtgacccagagggagcccttgtccagctgtagcccagggacaccgcagcctgagcaggactgcacctgttcccccccaggagcctcatctctgtctggcctggctttggcttccaatgccctcagctttggcttcagaatctgttgggtcagattcatgagagctctggccttcttcggtttagggatttttaaatagttttttcaagcaggcagtagatgagctctgcttgcttacctctaagaattggctagaactcacagaaggctgttatactcatagttacagcttgattacatggaaaggatacagattaaaatcagggaagaaaggtatagggctgagtccaggagggcaccaggcatggagtgtccattatcccttccccatgcaatcagagtgcattaccctcccggctttgctatgtgccaatacacatgaagtattcccagccaatgaggctccctcaagcctcagtgttctgggtttttactggaacttcatcacagaggcatgcttgattgtccatgtggctgcgctcagtttccagtctccagtacttccaggagtgacctaaagcccagactctaaatcacatagttgcttttttgccctggctagtccctaccctaaatcttattattaggctgtccatcatgagccaagatccccaggcaaagatattcctatcaggtattacatgttgacagttacctcccaggagtctaggacaaaggccagatctctttttggtcaaggttaattttttttccttattttttaaaactatacgacatgccatcattctattattcaatctttctattttatcttcaaaataaccctaattggtgggtaaggatgtttattattataaacgagatctcgaaagaaaagacacttgggcaaagttgcacagtctatctttgactcatggtgcaatactctttccactctctgagaacactgagtcctgtgaagaaggtgaaaggaaggtgtgtgcgtgtgtgtgcacgtctgtgttggtgtgtgtaaatgtatatctaataagtgtgtatagatatgtgtatgtctctgtatttgtgtttgtgtatacatgtggatgtctgggtgtctatatgcatgtttgtgtgtgtgtacacatgctcatggggaaggttaaagagaaaattggcccggtgcggtggctcatgcctgtaatcccagcactttggaaggctaaggcgagcagattgcctgaagtcaggagttcgagaccattctggccaacatggtgaaactccatctctactaaaaatgcaaaaaaattatctggacgtggtggcatgcacctgtaaacccagctactcaggattgcttgaaccagggaggtgaaggttgcagtgagacgagatcgcaccactgtactccagcctgggcaacagagtgagattccatctcaaaaaggagagagagagagtcagcagtgtgcagtgatgcacatctgtaatgccagctacacaggaggtggacggaggaggatcacttgagcccgggagtttgagagagagagagaaaatttcaataatcttgcagttagaaggaaaaacctggggctgagcacaaagagacataaagcacagcataaagaggcagagaaatgtctaatgaaaagtgacaaagaattaattagttcttatataaagaaatataggactttagcagcaggataaaactggaatataatttcttctagaatcctgataatctttgtgagaaaactgttggtcatatatgttaattgccaaaacttgcaggaccctatgcaatagaactagcaaataaaaccatctttctgaaactcactatgctacaagcagcattcaactctttctcaaccaagatttcactaacctatctccagcttccagatggtgagggaaagtgtgatgagattttatgataaattgtgcctgtctctgagtccatctccttctattgaagagaaggaaaatgaggtgagcacattacagccctgctgacaaaagtcacaagataagcaaataattattacttaaaaccagggagtcctataatttattcatgaatgccacacattctatattagatcttccatttcaatttacttgtattatttgaagctaatttataagattcaaattattcagaaaatgctcccacgtaaatagaagaaaacactttaaccagaggaagtatcatgctacacaatatggtgtggtggtgaagggtgcaggctctaaaaccagaaaacacaggttcaagtcctggccttaccaccttgggaaagttacatggtctctctgtgcctccatttccccatctaaaatgtggggatgacaataatagtgtctatttcacagagcagttttgaggaaaataatatatgtaaagcactgtgaacagcagttagtgctatgtaagtgtttgctctagttattttaacatttcagatgataaatatctaccctgttattcagatgacaagcgtccctaagctgataacatgatgaagagcttttgggtttcttaatttccatcagttttgtgagggaaaaaataccacatgaagaagagcaactgaagcaggcgtgaggaggaaacttggcttaagattggggggcttggggttattaggctttcatcttctaaaatgtcctaagctccattgataagaagacacttagtatcaatccagctaaaaaggaacaatagaccccacaagacactgagttagagacaaaaatagcagggtaataaatgaaatatggaaaactacacaaccagaaaaataaacagctaccagtacccaaaacgtggttaaatctcacaggattatattgaatgaaagaagccagccacaaacgtgcacatactgaatggtcccatttatatgaagctaaagaacaggcgaaactaatccatggttgcagaggtcaggatcctggttaactttgaggggacagcaactgagaaggggcaagagggagccctctgtgctgatgggaacattctgtatcttgaactgagtggcggtcacataagtgtgcacatatgtaaatagtaaggagttgtagcttaaggtataggcacctcgctgaatgtaagatactgtcttagtccatgtgtgctgctgtaacaaaatatttgagactgggtaatgtgtaaagaacaaaaatgtatttctcacagttctggtgggtgggaagtccaagatcaaagcgccagcaggtttgtagtctagtgagggctgctctctgcttccaagatggcaccttaaatgctgagacctccagaggtgaggaatgctgtgtcccagcatggtggaaagaacagaaaagcaaaagaagaaaaccgagctgggtagctccctcaagccctttcataaggtcactaatcccattcacgagggggctcctccttacagcttagtcatctcctaaagactccacctcttaatactatcacattggggtttaagttccaacatgaattttggaggagacacaatcattccaaccatagcaaatatactttactaagaaagaaaaaaacatagtctctaaatatgatattttaagagtttatatatttaaagctcaattttctgcttgcttacatacatatttgtgaccatgagtgtcattcttggctgagaaacatttcagtaaattttaaaaagtctcacattatctattaatatcttattcagataagatcaaatttctaacctacattttaggttgagacagaaacccagtcatttgttgcaatgtgagaatgacagagagatagtaactagcagaatccaactataaaactaaatttaagggcacaattctctactaatcactcccccagacaaatcattacttggatagcaatgaatcaactaaaaatggaagtgagaaaagttcgagtcctttttgcgatggatggatgcttatgagactattaagtgaagggggttcggaaataaggggataaatggcatactaatttgaggttgaatggagtaatgagatgaccttggaaatataagaatcctgcttaatggggcttgtctacttgcaattcgataaactaatatacgtaaattcaaggagataaaggacatgagcactcagcacaaaattacaggaatagatttagcaaagaggaaccaaagttgagataagggccactgttccaggtctgacatctttaattcttgagtcatggggatggtaaaccagagaacagagtcttccgactggaagctaaaaccagcctttggggtgggttcagagagcctgttcagactcaagatgcgaaaacagatgttgcatggtcgaaaacatcccgagtgcaagggcattttcaaagacagcggtgctcagggaaaaagaatactgtgtgtttaaaaagaaaaaaaattaaaagaaagaatggaaacaaggaggaaaaagtgaccggagtgtagggtgaccatacgttctggtttgcaaggtacagctaatgttatgtctgctgtcctggtacaattattatagtgccccctttcactctccgaagtgtcttgatttggatgataaagcatatgatcaccctattaaagagaggaaattagccagaagacctttgtgtcgattttaaacggtgtggactgatccgcagtcgcgctcttgccgctgcccagctgagcagcgtgcaccacctctgcgtcgccctaccccgccctgcctgggtctccaggaaggttggagcggaacccgcgctgctctggtgccacctgcaggttatatgggggaactgcttctctccaccccactacccaccaccccacatccccaccgccaccttggacagccttggacttggccaaaagacattaagagcacgcgaagccctggctggggagtgggctggaccctgcagtgaagcccgcgttacagaatcagacggtcccggcttaagccaacaaagccaagctcctctacttcctacccactcctggtctttctcattttgtagacaggaaactgaagcctaattcagatttttcattggtaggattgtgaagcatacagcgggagcctcccaggtgccattccccacatctctgtctttccgctaacactttagggtagtggggagcttaagcttactaagttcctactgtgtactggccagagtgggcacttttatctccagcctcgcaattgatgggaaataggtgattatacaactaggagacaggatcagagtgggctagcgatgtgctcacagtctctcagctgaaactggaacccaggggtctttgattctaaagctagtgctctttttgggtctccagcttgagtaatagttgtaaaatacaaagagcaccatgaaaatctaatatcaatccatataagactgtattgcaaacagaaacatagagtgtcttcgtgggagtgatggggaggggggagattacctcaattctatgtaacctggaaactctccgaggaaaatgaatgaagcatgaccaagtgcaatttgtctgataaaatctgtcagaacgtggggccttgtgtgtcctgggtagtgaagatgagaaatcatggtgctggacatttgctaaggtgttccttatgaaatcactcagggcctcagtgcctccactctctccatgaccccaggcagtttccccatctgtcttcatcctactgcctggcacactatccatcaaactgtttttagagttatgtctcgataaaataaaaatcatggtgggagtcatttacaccctagtgagagtcatctaagattcccttatcttttcagaccttttagctgaagttggttatgagagaggatggggagggggaaaagggttggggcaagcacttggagcttgcactgtttcttgccggtgccctggcacagtgtgaatatgtccatctaaatggagagctctatgcatgttcctctctactccctttgtcactaataccagttcccaaggcagagccccaggagggctggactgaaggacctggaggtaatagcaaacgcttggctttgggtttcaggtcaagctctgccagtgacttgctgtgtaagaggagacaagtcagttcacctctctacacttcagtgacctcatctgtaaaagactggtctggactagattaatgattttcttatttattttattattattattatttttgagatggagacttgctctgtcgcccaggctggagtggagtgcagtggtacaatctcggctcacggcaacctctgcctcccaggttcaagagattctcctgtctcaccctcccaagtagctggaactacaggtgcctgccaccacacccggctaatttttgtatttttagtagagatgtggtttcaccatattagtcaggctggtcttgaactcctgacctcaggtgatccacctgcatcagcctcccaaagtgctgggattacaggtgtgagccactgtgcccagcctaatgattttctttaggttttgcaattgttttttgttttaacattatactcaattcttcctccagcattattaaggtataattgataaataaaaattgtatatagttacagtattcaatgtggtgttttgatatatgcatacattataaaattattaaatcaagttaattaacatttccatcacctcacaacttattattattattattattgtggtaagaacatttaagatgtatttgcttagaatagtgtttactagcagtgaggaaagttaagcgggagagagtagccaaaggctggctaacaggttaacagatacaagagtacatggctgggccgggcgcggtggctcatgcctgtaatcccagcactttgggaggccaaggcggaccacctgagggcaggagttcgagaccagcctggccaacacggtgaaaccccgtctctatgaaaaatacaaaaattagctgggcatggtggctcatgcctgtaatcccaggtacttgagaggctgaggcatgaaaacaggaggcagaggttgcagtgagccaagatcatgccacttcactccaccaccctgggagatagagtgagactctgtcaaaaaaaaaaaaaagtacatggctgagtttggtggctcatgcctatcatcccagcactttgggaggctgaggtgggaggatcacttgaacccaggagtttgagagcagcctggggaacatagggagattcccatctctgcaaaaaatttaaaaattcgccatgcacttttagctactccggagggctacagaggtcaaggctgcagtgagctgtgattgcaccactgcactccagcctaggggacagagtgagaccctgtccgaaaaaaaaaaaaagaatacagctagataggaggaatagttctagtttctttagcactatagggtgactataatttatgacaatttattatatattttcaaatagctagaagagtggattttgaatggtcccagaacaaagaaatgataaatatttgaggtggtggagacgctaataccctgatttgatcattatacattacatacatatataaaaatattatactgtaccccataaacaagtacaattattatgtatcaaataaaaataataataaaagcaaaaaatctactctctcagcaattttaaagtatacattattattaactatagtcatcatgctgtacaacagatctccagaatttataagattctatttaattccattcaaagtactacatacatagagttaagaacaaaatggtatctggagcaagaaatcctcggtaaaacaaaaaaagaagaaaaaaagaacaaaatggtaataaaaggcttatatcaaaaagcatttcctctgccctttcctttcttgcattgagtcctaaatcccagaggccatcactttaaactcattttgctatttcctctggtatttatcatcatatttctaaataatgtttatgttgctatttcttgatttgttttcttcagtatctgtctacctcctggcatagctcagtatagggcttacctcccttatgaggtcttaacaatttccttgcttccaatctaccagtctgattggatcatagtcttatgaaatccaaagcatttccattattgtaggtatctaaatattgttccctaacccaactcctgcactgaaattgtctaatttctttcctttttttccctcagagttaataattgctttgtatttttttccttcatttgcttatatgtttttgtacctattacctaccttttttttttttttgagacagagtctcactctgtcatccaggctggagtacagtggcacaatctcagctcactgcaacctccaagtcctggatgcaagcaattctcctgcctcagcttcctaagtagctgggactacaggcgcataccaccacgcctggctaacttttgtattttttagtagagacggagtttcaccatattggccaggctggtctcaaactcctgacctcttgatctgcccacctcagcctcccaaagtgctgggattacaagtgtgagtcaccgcttctggcccacctactattttattttcagatgctccaactgatttatcaaatgcctagtgataatgatccaaaaactaagaaacaccagatactgtatcagacctgttattttcctggaggcttccctttctcccttgccctccatccttctgctccaatctggactcagctctcagcccatggcacatctggcatcctggcatgtctctgcaccatcgtgtgaatttcctcctgcctcttctgttgcatctcctgttccttggccccagatcttcttttttcctggtttactctctcactgtgttgcagcacattttccagtggcttcctgagaaagagtgaatggaagccaagctttctgaccctcacacattttagaatgtcattgttctaccccaactcctgattactagtttggctggatgtaatgctctaatttaaatgtaacttctcctcacattgggaaatattgctctattattttctagttcccagtgttgttgggaataagtccgtgtcatgcggagtcttggctctttacatgtgacctgtcttttctctctggaagattttagggttttctctctatccttagttttctggaatttcccaatgctgtgccttgctgtaggtctttcttcattcactgtgctagtcacctggtagactcttttgaactagaaaattatttccttctattgtgggaagccaccagcaggttcgtgtgagctggttaatcacattcttttcttccaaggacggaggtatcaaggccctgggaaccttataagtggatgtggggaaagggggcctgaggtgaatccaacaaagctgcagcacccactgagctcatgtcccagggctaggctctgcctgaggacaggagacatgggtgagacccacttcctgcccagtcccatggtggggctcaggacacacatggtccaggaggcccccagccccagctacattgacatgcacctacctgtatgcagcgatcagtgagccacaggacaacttaggggaaggggcagctccagagtgcaggataggagggaagtaaataatcatggggtggggagtggccttgtggggaaggggcaaaggcagggctgtgtgtgtgtgtgtgtgtgtgtgtgtgtgtgtgtgttgtgtattggaggaaatggggagagcatctgtagttttgtctgcccccttttttggccactgcacccctttcttcgtgaatagtttttcttctcttcatggactgagtgtctctgtctcctccaaattcatatgttgaagccctaaccctctgtatggctgcatttggagatgaggcctctcaggaaatcattaaggttaaatgaggtcctaagggtggggccctgattcagtaggattagtgtccttataagacgagacaccagagagtgcactcactgtctctctgcacaaatacaaagaagaggtcacatgagcacacaatatggcagccacctatgggccaagagaagaggcctcagaatgaaacctaccttgctggcactttgatcttggatttcccagcctccagaactgtgagaaataaatgtctgtggtttaagccacccagtctgtggtattttggcatggtacactgaattgactaatacatctccctgccctacttcaaccacatgacactagaggggtcggcagttttagagtcccagctactcagccaacccagaccagaccaagcagaaactttcttctggaattttctgaataggaactaatagaggggagccccatcctttcctcgggggcaaagccagtaagacagaagcctcatgctgccaacagcctgactctaacctcgtggggagagttgctctgagagcacaaaactgatctgcagactgaggtggagacagagacaagggaaggagcctgcaaatcctaacagcgctggtgattctgagtccaggtattcctgaggcccagctgttccctgtcctgcccatggctaacttactgaccaatgagcttcccttcttgcctaagccagtgaattttctgtcactcacatccaaagagcccggactgtaatggcagggtatggcagggctgagctggctggggcagaggacggtgtgggtggaatcagcagtgacaggcacacaggaagtgcaggtatcgagtggcctccatgaggtctccctccagccccgactgtgagcaaggctgggctcatacgctcagtaggtcagagtgagggatttggtcagaggtgccatgctcagggccatctttctatgggccagactcttcgtcatcaaaggttttgccatcagagacagttttagtcctatcttgggttcacttgatcaattgctgttctcctgctttcaggatctttacactaggctgccctacctgggggttaggaagccataggcatcctggtcataagtctggaccccaaaaagggcttctgccagcctgctaagggttccagagggcaggactgaggggtggtgggaggagcccagcctggacggccgagatatatatagtgctcttgattcatctcttggaacttttcacccatcaagtttaggctcccagtggggcacacatgggaaagacaatgcccatgtcttcaactagtttccccatcagaagtggtcattgcaccaagcaccctcctccattaaaaccggacaggccaagggccgctttcctaatggatgagtcttcttggtctgtctcatgttcccaacagagctccctccatgggatgggaaggtgccatcccagggccgccgttttgacccagcctccagccaaagctggtccccctgccaagcaggccctagagttacactggagagtgacaagcctcatctgaagatttcttgctgaaaattgtcagtttcctgcacaagtacatcctggcagtttacacatttatgcttagcgttccattactggaacgctaagcttgtggagttatttatatcctactgctcagtgtcatcgccaaggtctgatttttcacagaaaaacatttgcaacctctgacataatgagttaattcaaattaaacccagaaggagactgctgcttcagtctcaactgcttggaaattgtgctatgtagagctttcgtttactgaaaattgtgccttcagactctgtgcagattaacctactacatagagcaagtacacacatagggcaccaaccaaggacaagtgtgtacctgtgtgcacacacaaatagaaaatccaaaaataaatattttaatttcagctatcatggaagttttgtgtcatttctccaaaaatgcccatgtcaaattttattttataatttagtcttgtttttatttagaattacttaagaaaaaggggagctgagtgtggtggcttatgcctgtaatcccagcactttgggaggctgaggcagaggattgcttgagcccaagagtttaagatcatcctgggcaacttggtgaaaccccatctctacaaaaaatacaaaaattagccagatgtggtggtatgtgcctatggtcccagctgtgcaggagactgaggtgggagattcatctgagtctggtaagttgacgctgcagtgagctgtgatcgcatctttgcactccagcctgatgacagagagaaactgtctcaaaaaaaaaaaaaaaaaaaaaaaggaaaaggaagaaagaaaggcaaagaaagaaagaaaatgaaagaagaaagaaagaacgaatgaatgaaagaaagaaagaaagaaaagaaagagaggagctctgcacaataattttgcagtgtcttgggtctctaaagatcttaattaggacctaaactcagattaggctgggatcctgggcagtgtggccccaaatacagttatgggaggcccttccaagataagtctagactgagatagagtaggtctcaggagaggggctgatatgcccatggttctcaacctggctgcacctggagagcttggcatcacctggagagcttgaaaacattctgatgcccaagccccaccctagagattctgagctaattggtgggggatggcctgggcaccaggaattttcacagctcacctgatgatggcactgtgcagccagggtagagaaatactgacctttgctttctccacgttgtgtctgccttggttttcccatattcccccaggctccaggatctgaatgaactacaggaattgagaattagccctcccacccagccactttcttcccctgctggggaatctttgagccttcattttggctataggcctcgatataactcatcggcccagggatcggggcaggagtggggctcctggcagagagcagagtgtgggctttgtagttacacagacttgcattcaagtcccagctctgtgatgtcagaagaagatctgatccatagttggttaccctgcgaagtggagaaagtgtccgcctaaccggcaagatctctttgagactgaaatgagagaaagctggggcaacaagtgagttccttccgcgccatttctgtgagctggccctgtagcttctccttggtcctttgagttctcagctttagctctcttactcctgctccttctcctcactctctctcttttccaccctggataagtgccctgcttctccccacaggttaaccaccctcccccgtacccagtgggtgatgaaagtcttccctggttgtgccagcatctccctgatacttcctttctctcctgcattcaaccatgatgaagcccagcacagtctccctctcttgtgccccatttccaccacaaggtcactgtcagctcttacacagacatccccagtagcttccactttggcctcttccaaccagccattctggtattgcagccatattcatctttaaaagcccaatattattaagtcactctcttgctaaattctgcaatggctttgactcacccttggcctgcaggatctggcccctgcctgcctctgcagccaccttttgcttcattctttctctcttactccctctatcacctcagatccctgagggttccctccctcctacctcaggacctttgcacatgctgttctctctgccagaaacacttctctttgacagtgaatgccttctcaaatatcccttatttggggtgttgactacccaccccatcagattaggtccctcactatatgctcttatatctctttatactttttcaattaaataaattttgatcacgtgatttatggccatctcccctactagactgtaagctccataacatcaaggaccaggccagtttttgttcatcgttgtaacccaaatgcttagcactgtgcctggcacaaactaggggccatttggaccaagtgtctaggttgtgtagacttgcagcccctgtggaagtgtgtggataaacatgagaaacaggatgactgcctccccagcatggcttgagtgtttcctggatgtgtccaggcgggtatcacatgctgggtggcatcagaggagtgccctgttttccttttataagagaaggaaaggttagagactatgaacagtcagctgtgggatcatacagtgtctgccctgctccacttggctcaaggcctctggggaatggggatatgggacagggacatggcgcatggtgcaagtggttgtggcagcgagccttatggaggaacagcagtgagtcagtcccttcttggcatgggacgctgcctctgcaggcataggaggccatattccccactctcacacccagtcagttgggtgcttctaacttgagctgtggcatttggcatgtaaaaaatgcattcctggttttccagcttggatctcatggtaagcaggggtgtgaggtctgaggaggatgagtgtttcagtggagatgtctggataacttttaggataagtatatcccaaacattgcatgggatatactcatacaaaaaaactatttgctgtttatctgatattgtaggttaactgcatatcctatagttttctttgctcaatctggtgcccctaagcttggggcttcctcacttcaccgtggtgctgttgtgcccttccttcattataccacactaggctcttggggtacacagaggagtgagacaggacccttccctcagggaactcacagtctaacataagagataagaatttgaacagagatcgccaaagcaatgcaaactctatttctgagaatttggggacccttgttggaatagaacagctttagaattcagaagagatcagaaatcatggaacagaataggaagtccagaaacaaacctgaaggtttttcttttcttttttttggagatggagtctcactctattactcaggctggagtgcagtggtgtgatcttggctcactgcaacctctgctgcctgggttcaagcaattctcctgtctcagcctcctgagtagctgggattacaggtgcctgccactacgcccagctaatttttatatttttagtagagatgaggtttcaccatcttggccaggctggtcttgaactcctgacctcatgatccacccacctcggcctcccaaagtgctaggattacagacatgagccagcacgcctggccacaaacctgaatttttataagaatatattgttttagcgtgtgataaaggtggcattaagacctcttgagcaaagaagaattattcaataagttttgttagagcaattaattaactacctggaaaaaaattaagttagaatcattactactttaaacctcatgccagaaatgaattccagttgttgtaaagatgttaacaaataaaactgtaaacatactaactaggagaaaacataaaaaaagaatatttacatgatcttggggattatgaaggactttctaagcatgatgctcagtactgtacagaaggtataaagaaaaattgttctattcat

SEQ ID NO: 143 - DNA, 1356 bp, Homo sapiens
gtgtttgcacctttgtctggattcttaatacagatctcaaggtggggtgctggggggctgccaggtgggttctgtggagtggaggggaccctgctgctgacttggttgctgcatgactttgggggctctctgccatgcctgggcctcccctttgtcagccacctttcttacttgaaaatttgggtcagggtccagatggtctcttagccctgggttgctgtagggcatgtgcccccccttcttacctctgagtcctgaggccctgaggaagggtggctggtggccagcccggccccaccctggtctgtttgtgttgctggtgccaagagccaggcccagcatgttcttcctgccaggggtgagtgggagagggcgacccaggctggattccagagctgcacctgcattctggcccagagcccccctgctggtgccagctgcaaggggagaccctgctgagggcaggccatcaagtgtgacttctgcctgccttcccccagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaaaaaattccagcccctcccactgccttgcctcttgagggaagagaaaggcaggcagcagcttggatgaagagggaagacccctcacacagcctctcctgggctcacaggagggcggagcccggggagccagttcctgaaacatgccccccattccccccccgcccaccccccactccccg

SEQ ID NO: 144 - DNA, 3834 bp, Homo sapiens
ctctgcatccgttgtttcgtttcatgatcaaaacaacattatctacaaagatcgtagagagcttggaaaacagagagcaacatgccccagtccctctctctggccagttcttgtggcagccccattggcctggagacatggttttttgtggttgcagctgcagctgtccccccgtcttttaactcgacatcaaaagcctctctcctgccagtgccataggtttgttagagctactgttttgtaacagctgctcaggtgtccccaaactcctggagttttccaccctgagctgttaaaaacctgccctgcctgtcacccatttctgtgccaccagcccaccccctgcctccactctcctccctgccaccttctgtccctgccataggaatatggggacaccgtgtacaccattgaagttccctttcacggcaagacgtttatcctgaaggtgagtgaggggagcgggtgtcctggagccccagacagcacaggaggctccaggaaggtgccgaggggccctctggtgggtgccccccaccaagagggaagggttggtctgcccgagcccatctggcaccacccagccctctgccgccctgtcccagaccttcctgccctgtcctgcggagctcgtgtaccaggaggtgatcctgcagcccgagaggatggtgctgtggaacaagacagtgactgcctgccaggtgagcccagtctggctgcctcttaaggcacagatgggggcacagccacgcctcagtgggatcactgaagcactcagcgcctcagctgccccatctgtacagtgggtgtgatggtaacagtgcctgctcgggagggtcgggaggagggcaggaggagtgctcatcaggcgctgcccagggcctgcctgtggcaatagcagttagtaaaggggcctggggtgttcccatccctggggttttcctggggcgacctgttccaaaagtctccgttgacggccctcagatcctgcagcgagtggaagacaacaccctcatctcctatgacgtgtctgcaggggctgcgggcggcgtggtctccccaaggtgagtccatgccgggccccctcctttcagccaggtcttctgcactttggccttgggtcattgtcccctgaactaaccctccctcccgcagggacttcgtgaatgtccggcgcattgagcggcgcagggaccgatacttgtcatcagggatcgccacctcacacagtgccaagcccccgacgcacaaatatgtccggtgagcctcactttgcctggggtcacccctgccagcccctcccctgggagcattgagcagtgcagggtacagcatgtacagctgggcacttcccctgctgaggctgcgttcctgttccctgtcccgctgggctctgctcctcctggctactaatcctgctaatcttgctgctctgtctgtggagatggggggtggtggacagctggaaccaagccaccaaggctggacgggatgtgcggcggtggctggctggggtagaccatggatggggacccgtgcagggaaggggcctgagagccatgtgctcactctgggctgattgacctgagcaggaggctctatgctctgggtttcatcttcctgcctaaggagactcgggtcccctttcgtcctcctcaccctgtcctcactccgtcatctttctctggagtggctcaggagttcccccaaagataaagggattatggccttcccgcatctgtgcctgggcttctggagtcttcccttttgtccagtcaggctgtggtgctgcgggtggccccctcccatagaccccactcttccccatcccctcctgggttccagcaggagcactgttctttgaataggatgccaggctctgctttgggcactggacagacttgctgggtgcagggaagctcacttcctctctggatgccaacttccttatctgcagaatgggcttaggtgtgctcagtggagctgagggagaatgaaatggtgatgggatgtgaaccgtgcctcccaggcttagccttctcctgagcaggtgtcccctcctgaaggggaaggggtaagaagcgccagcccagcctactctgccatagcagggctgacctagaatctctggacagagtgtatgagggctgggaaggtggtgagctctctgtccctgggggtgtgcaagcaccaacaggccgttgtaggaggattcaagcatcacagagtgggtgggggtggagggccgattctgcagcccatgggacacctgtgctaagccttgttcagatagggtagctctgcctttctgcttccagcccagtcccagctgggccaagaatggagtgtgagtggtaggggctgcgggggggtgtcagggcctcactctgttccaaagtccccccaatgatgcctctttccataggggagagaatggccctgggggcttcatcgtgctcaagtcggccagtaacccccgtgtttgcacctttgtctggattcttaatacagatctcaaggtggggtgctggggggctgccaggtgggttctgtggagtggaggggaccctgctgctgacttggttgctgcatgactttgggggctctctgccatgcctgggcctcccctttgtcagccacctttcttacttgaaaatttgggtcagggtccagatggtctcttagccctgggttgctgtagggcatgtgcccccccttcttacctctgagtcctgaggccctgaggaagggtggctggtggccagcccggccccaccctggtctgtttgtgttgctggtgccaagagccaggcccagcatgttcttcctgccaggggtgagtgggagagggcgacccaggctggattccagagctgcacctgcattctggcccagagcccccctgctggtgccagctgcaaggggagaccctgctgagggcaggccatcaagtgtgacttctgcctgccttcccccagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaaaaaattccagcccctcccactgccttgcctcttgagggaagagaaaggcaggcagcagcttggatgaagagggaagacccctcacacagcctctcctgggctcacaggagggcggagcccggggagccagttcctgaaacatgccccccattccccccccgcccaccccccactccccg

SEQ ID NO: 145 - DNA, 9280 bp, Homo sapiens
ttaggatgcacttcttgcttattcaataaagttaataatttctaatttttctacttttcaaatgtactcaaatgtgctatttttagtaataaaaaactgagtaattaaaaaaacatagaaagtatgaaaatttctgccaatgcagaaatcataaacagcattaaaatgaatcaacacttgtatgggcagtaaggttcagacccctagaagccaattcattttgccttggttcctgagttttattatgggattgtcaataaggagaaagttgttcctgatttacatgctgacaatcttccaggtatagggggttgtgtgtgtgtattacacacacacacaatgtatatataaattttttttcttcaggtagacaattattccaggaaagtacctcttcagaatcactcattacagagaattcctgtaactccatttgctgataaaagtcccattaaaaattaccatgtggttctcaaccaatagggatacctttggcattgaagaggctgagggttgattttagtactgcttgtaagaccatagtgttccagaggctctgtagctggcttctttgggaatctgaagttggtcctgtctttgagacatggccaaaagcacatttttcctcacttgatgcagaagaaaatgttatctcctgcttgctcagatcatagcctcgaggcagatcacacagctcaggatgcacatggactggaacagcaccagggcaagcaccccaaatcacaaaataatcatgttaggatgactaagttgggaggctgaacttaaaaccctatagctttgttcagaatatttttttctttgcttttttcattaagttttactgaccaaaaaggtggaaaaaagaacctaaattttctgcacaaaagcagttctctgaaacctgaactttaccaatctgtgtaaaagtactctacagaaaatacacaagcagaaaacagtaatgtaagcttcatctgaagtaacggtttagtcacatgacaaatttggttgtcgatttagtatgctgtagcccttatctatctaaattcagtatgactacatagacatttattctctggtactgaatttccatttgaatagaaacggctgctttgtggaagaaagaaacttcaatttaaaaacaatttcagcatcgttgaagtgccaatcagttttcaaattatgtgtgtgtatacatatgtatgtatgtgtgcatgcatgtatgtttgtattatgtgtattttttcctcctctctccctctcttgctcgctctagagagagataccaaatactggcttggtgctatactgttttttcctagttaatatttttattatttctgtctacgtaagaaacttcaaatattctgaatgcaaccacacaatcgagtaagttgacagacatgacaaaaactacgaaaagagggaggtaactagtattaatacttggcaacctttcgttatttttagtttagagcggcctccctctgacattttggagtcaaagatgaaaactcaactttgaagcataatggacataattacacatttaccacagtcatctacaattttatataacatcacaaaaagacatctaaacatttttctacgtctttttttcatttgttaaaacagctatgttaaatacattttcagaatgcatttgttagccacttgataaacatactaaaagccatacaagacgaataacatcagttacctttatatctaataactgtaccaatcactgtaagaagatacaactgaaggggaagtattagatcacccatgacgtactgcaaaggtgttacaccttagacctaagaatgatctgaaggtgctgaaagaggtgattctctagaaggtgacccagggttttcttcaggtggaaaaactgtgagtgtacaggctcgaatgccaccaagtgactctggaagatcaaaaactttatgccactcatctttttctgggtcatatttctggacaatttctaccatacaacgattattccaagaatatccaccaacaacatagattttattttcaaagacggcaactccaacatcactttggcctcttaacatggcggcaattggggtccactggtcaagggttggtgaatagtattcacagcttagaacatcatcataatcacttgttcctctgaagtgattgccaccaatgacatagagcttatctccaactgtacacatgcaatgcagacctctgactgtagtcattggagccttttgcatccatttatctgtatctgggtcaaaacacatgagctcattttggaaagtgtcatgggtaattcctcctgaaatatacattaagcctccatatactgttccagcatgaccatagtggggttcactcatttttgcaacatagctccactcattcattcttgggttgtaacattctactgtggccagttcaccagctgcactgcgcccaccaactgcatacaaatgtcctttgagggcactcaagtgaaagaatgtgcgcttttcatttaatgatgcaacctgcatccatttattataccgaggatcaaatctgaaaactgtatcaacagcagtttttccttttgtatcataattactctgaccaccaactacataaagaaagtttccaatgacagcaataccatgctggtaacggggagcatccattggggctaaagatctccattcttgtgccctttcatcatacatccgtaattctttactgacaaccagctgctgcctcaaaactcctcctaatgtaaccaagtgagtggagtcagatcgaatggcagttctatctgactgcatcactggctgcatatatggcatcatttggtaattgctagcttccaaaagcaaattcacgcaggtattgtctgttctcatgaaatctactgtctgcacgtaattgatgagatcctgtggtgtcatcagtggaaatcgaatattcttcattaactttgcagcataatccatccgagggtcttccaaccttagccagcgacaggctgccttaaagagttcaagttcggtacagtgcttaagactattactggaaagcacaaatgcaagtcgttcaaaagggagttttagaaactccccagtactcaataaagcaggaaagttcttcaggatgaaattattaacatatttatccacttctataagattgtaggtgttagcaattcgtccaacctcaacacagttatccaaagagactcctgatataagaaatactttacagaaatccaaaacgggtaatatttgtaaaaagctagcagcttcaagtgtgtcctgaagattgtccatattaagagaaagttttgcagtataaataaaatcaatgattttcttcagaccaaccttgttcaccccatgaagcttaatgcacatcaaatcttgttctttcattccacctgtgaacatggctttgaaataatcactagcagacgccatcatagctctgtgaacagggaagatttcatctccatcacctggtaccagggtcacatcacaaagcaatccttctattctaagctgatcaaagccttgcaataccaccgaactgtgagtattgctggtaaaaaagcgtgtggttcctgccttacaaggctgcaaatgggcagagacgcccatttcgccgttaccaagggacactttcatgtgaaagctttcctcttgcacagagatgcaagccggataaagaagttataaccggaatgttttacaggtaacgaggtgtccagaaagaacagaaagctcgtttccttatcaagggaaggcagtcactgcggcacccctcgggccacgccagtcagtcatccactgaaaatcaccctgtagcaggaccacaaagggctgtggacctcaaatctgattattagacagatgattcatcacctgaaggcggttaaatgacctggttcacctcgtccggcctgcgctgccgctccttcagcagttccgcttcgggcaaggaagaggcgccgccacgtactgtggctccacggcccgctcggcggcgggtccggacacctcagcgaacggcccgctgcgccctccgctgtacctagagtgtcgcagcggccaccggcctgtctttgagcaagggccgggaacacaggcctgggcctgggcttgggcctagaataccggcctagccccaacaccgagccgctccttccggaaaagcctagtcccaggataccacggggtgggagcggccttagcggctactgcggctgcgcggcctccagacctcgtcagtcagcgggagggtgggggtggggaagggggaggaagtacccgggaggcgggagggcgagggttggggaagcggagctgtgtggggtgggcgccagcccggcctcttagagctgccttgtatgtgggaccaaataggacagaatgtgtgcaagcaagtgtgttatgctgcacgtttgatataagtttttcgcatatctgagctcttacgttccccaaatgcataatttttcaaagctttacgcttcctagcttctgtttttttgaataacagtgaaatgcggcatttgtataaattgagaggaaacctggatgcttaattttttttttcctctacaaaacaataattgttatcccacattatgtagtagatacttcagttacaattttggttcatattttcaaatttgttacaatttcaaacgcaaaatatttgtctttactagattgttactttattatgtaaatgatatattctaaatttttggcttgaaatgcctttgttttccacaattttaaaaatggctacataattttccaataactatacatactatagtttcctttgcccattggtttgttcctgaatgtgtaccttcttatcctccattgttttatagactcggtagtaaacttatacaatctggtagcaaaattttagccctgttatggataatatttagtaaaatactgatccaagacaatatttccaaaatattatcaccaacaatgtttgtgtctttcccttcttctgacttttccctttgtgagtattttattaacttgcatttctttaattagtggtaaatttaaattttgacatacaaataaatgtatactttgacacaatttcttccattttccaaattttgaagtttctgtcttttaaatccttctagttctttatgcatatgcaaagtaagaatgtagtcatgtttttcttacactcgcctcgtttttatgtaaaagatagcataccatgtacactgttctgcatctttttttttcacttcaagatcttcctgaattagtgtagagggcttatttatatttttaaacaattctgttgttgccttctgagttgttacatcataagttatttaaccagtgccctgttgatgggcagttcatctgttttgaatgttttctattgtttccaagggatggcagcaaaattcagaaggcttagactaccactgtcctccacaaggtgctccagcagattgtcaccttattcaacacaagaggttggttggaatgaaactggcctggagaaattattcactgaatttttatcagcattgggaagtcctggagccctgcttgttgaatgagttaggggtggaagggctctctcaggccatgacaactccctaatgctgtgaagagctacttccaaggaatcagtctctatctggaaaagaaagaagagagcctctgtacatgggaagttggagcaagaaatcatgagatccttctttttttcatcaaacttgcaagtaagattaatagcttaggaacagacttgtgtcttcatgaaatgattactatagacactcttcattatattcccatatgtttagttattttaaaagactatcttttctgcctgcataatgaaatgattgaatcaaatttgtcacaatacttgttggtaatgtcaagcaactgtatgataaagcatccagttcttaggggcattagctcaccatggatgatattattaatttacccatgtacttaattattgattctactacatttattgtattcagtatttttgcttgtatgaaatgttcacttttaacactgtgctaattacattaaaaagtgttcactttatgtatattttgtttgtttgttttgttttgttttgttttgacggagtctcgctctgtcacccaggctggagtacagtggtgcgatctcggctcactgcaacctccgcctcccagggtcaagcaattctcctgccttagcgtcccgagtagctgggactacaggtgcgcgccaccatgcccagctaattttttgtatttttagtagagatagagtttcaccatgctggccagtctgctctcaaactcctgaccttgtgatccgcctgcctcagcctcccaaagtgctgggattacaggcgtgagccaccatgcctggcccctcactttatattttgaaaattattctctttattatttcgagttttactttcagatcattttgcatttgtttatttaaaaaaaacaaacacaaggtcttgctctgtcactaagctggagtgcagtggcaggttcatagctcactacagcctcaaactcctagcctcaacaatcctcccacctcagcctcccacactgctgggattactggcatgagccaccatacctggccttactcaataaatcaatgccaaggttggttttgcaacctcaagtgaagttcagttcattcattccattcacactgtatgaaacacttgatatgtgacttttcaggatagaaaagtgaataaaggaaacacagcttcagccctcttgaaactttttgctgagggagaaataaaactattaaccaattaattaatttcaactctatcataaactcaaaccataggcaaaagaaaagtggtttttgtcatcagaaactggaagactttaagccttgaaaattggatacacagttctgggatttagagtgcatggctagagatgttcatttgggagctgggctatacctttttcctgaaggcccaaggatggatgaggtctggtagaaattgagtagtgaatcagaagaccaaaacctggatcttgaggacctttacatcttaatgtagtgaacagagtgaggaacctgaaaagggcatgtgaatgaaatgataggaggacatccaggagcaaaataggaggacaaccaggagaaaattgtgataagagggtgtttaagggaagaaatgtgtttaaaacatgacgttttacatttaggaaaagaaaggactggtttgccagaattaatttggcaaaatccagattggaatatattgactagagtaaatagcaggagaggttggagacacagtggatggaaacttcttttagaagtttatctgtgagtggaagaagagcaagaaggtagtacctggagaaaaatgtgtgtttgtattatcggatataattttgtaacctttttacaaacttttatttaggattgatttcagggaatggatataatggcacaaagcatataaaattaatactttatttcataggctatattgtcttactgcttatttaataatctaaaatttcaagaataattgtttaatagtttttgagtactagtgggctataatgcctttccatttgcttcacttgctgttcttaattctatttagatttcattttatggcattaattgtagtttttattgttcttatgaattatgcttttatacgcccctcttaaaagtatatataaaccctttatgtagatgttagctatattccctatgatgcaactttctcgattttgtttacatataactgttattttcctttacatttctcctattgccagacaattgagaacatctaaaacttatggaaaatgcgtttgaaatcctacttctttctttcaaacaaatgggctctctttattaatgtggataaataaaatccaaatactcttcagagagagtgtagatgactgctcagagagctcatttatcacattcttcgtacaccagggatgctaattgtgcaaaaatactgaaacctaagtaaggctggacaaggatggccatcgtagtaaaggccatctctgaccagatggggatgcttctagggaagtgtatttagctgccatgcagagaatgtctgcaaaccaccacgttgtgagtttattgattcactggtttcctattctctactgcctagtcatgaaacccactcatactttggtaacattttataaatttctctcttagcagagatgatatgaggagtgatctgcggatcagtattgataagagatgtcttgaagacatccatttagtgaatggtgaggggcagagataggattcatagctggttctacctgtatgtacagtgttcttttctctgtgtttaatgtatctaagttagactttgttgtttgtcatgaatgcagaattgacaagagcactcaatactaagaaggcattaaaagaaaacattgtttttgatttctttcatcagtgttaagaaagaacagggaaagaaaaaatctattattatgtgccatctataaaataaataatatgttacatgttttaatccaccagttacagtgtaaatagtaatactatcaagcttactttatcaatgaagaaagcaggacgctgagagaaaaggtgatccacgtagagtgcacaagtgattggcagagttaggatttgagtctaggtgtgctgatggaaaacttcatgcactcagtggatatcatgtttccccaaggttgggggctatcaggatcgggtaggttcttctttctttctcttcttcacaagttaccctgttggagacccaaactcacagcgtctgccctactcactgtgcttcactcatttcctcaattattgtcttacctgcctgtggcatctgtctgggtcacagacagacctcctatcacctgcataagtgcagtgaagaactcaggtaccccaaggattctgaggggttgagtaacacataaatcttcagtaaagagacgggcctgaataggacttcttacaagtttagcaccaaccatgtccagagtgcctagctggcctcactggagaaaaggattactcatgaaatcctcttggtctattttctcctgtcctttgtgaaatggtgaagaaaataatagaccccaaactgttctcagctcacatattctcctttttagctgtggcctttgggcaagtctttttccctcagagatagatgcctgctcacagggtctgagccgtaagtaggagga

SEQ ID NO: 146 - DNA, 11910 bp, Homo sapiens
acgtttgttttctgtttgctcacaaataatgtcatgttttgctttttaggaaagttcaaatgagaaactaaaaatctgaaatcttgaaaagtacagaggaaaactatgtggcttatttgccttttacttctttttatttgtgttacttcatcatgaattagaatgtaatacagaaagagtaagacaaactttgcccagtaagtaaatcatgtgaacagaaattatacaaaaatttaaaatggaaaaccacaaatgagtaaaggaaagaaggctatttctccctgacataatagcctgggcctaactgccttgcattaccagggtgagacagagtaacaaagaaccctaagagaatcatgctgagtggatgaacaactgaaagtcactagtttctgtcatattagtttctatgagagacaaaatcatcattgaatcccctgtgcctagctctgaaaggtcaaatataacaagtattcaatagttttaagtattggataataaaaataagactggagcaataaaagctatacttggcaaaatacaaattgtttgcttacttgagtaaaaattattgcaattgaataattcttccacctacttagacaaaacaaattttgctatcagtatctgagcactgtggacacatttgatacctggggatatggggtcaggacaggaggaggtaaccactgagaagcagagtccttcacacaaacactctaggggaaagggcaagggtcttagaggactaattattttggctcaaggaaatagtcccctccttagtgaaagagttcaaaagttgtcagcctgcctcagggaatgagctggggagagcttgagttgaggacattgtcactctagaggaaagggtgttactggatgtgataaaaactttgtgagtgaagtgatggtgggaaaatacaattatcttagaatttgaatcgccgtatccccatgcacctggaaaagaccaggattcttgctagggatattgttgggaacaagcccccccaaatctggccataaactggccccaaaactggccataaacaaaatctctgcagcactgtgacatgttcatgatggccataacgcccatgctggaaggttgtgggtttaccagaatgagggcaaggaacacctggcgcacccagggcagaaaactgcttaaagggattcttaagccacaaacaataacatgagtgatctgtgccttaaggacatgctcctgctgcagttaactagcccaaccttttcctttaattcggcctatcccttcatttcccataagggatacttttagttaatttaatatctatagaaacaatgctaatgactggcttgctgtaaaaatatgtggataaatctctgttccaggctctcagctctgaaggctgtgagacccctgatttcccacttcacacctctgtatttctgtgtgtgtgtctttaattcctctagcgcccctgggttagggtcgccctgaccgggctggtcttggcaggatattatcacagactgaggagcactcagtaagaacattatgggaagaaagggctatgtctatagtaatcctgacctggtggccccagtgaggcgtaatcatatggacccgcatgaatgtattttagaagaaagagaaacatgatcacagcttctactgtgaataaaagagttaacaaaacccaattatttgttctaaagagcttattgtcgcagatggtctggtaaattgccaaccaaatacagaaacctatccggtagagggcgcctgatttcctatgtaaagcatggagagtaaaatgtagcttagaatcagggcaaaaattttgctcctgacatagaagagaatatttatatatgaaaaaaatgtatgtgggcatttttgtgtatgagtattcacatttctacatacacttcagttttttaggaaaaaagatatttctaatttaattaatgaaaatctgatatctgatcaaatcctcatcccacgcactcaatatataattaccctggcttgcctttagaaagaattatgttcaggttagcaaggatccccctacctttgatgtctccttttagtgattttctatccactgaccccctcattctgcttgttgggtataaaccccaggctgtctttgctgatttatgagctgagcaccaatgggtctctctcccgtattgatatggtttgggtcagcatccccgccaaaatctcacatggaattgtaatctccagtgttggaggcggggcctggtgggaggtgattggatcatagggcggttcctcacggtttaacaccatccccctggtggtgtcatggcaagagtgagttattccaagatctggttgtttaaaattgtgcagcacctcccctgcttctctcctcctgctccggtcatgaaggacatgcctgcttccccttagccttctgtcatgattgtaagtgtcctgaggcctccccagccatgcttcctgtagagtctgcagaatcgtgagccaattaaacctcttttctttctaaattacccagcctcaggtttttctgtatagtaatgcaagaactaatgcacctatcatgatagttttgacacctgttgcaatacttttaaataaagccttccttactgttataccaagtgtcagaataaatttttctttaccagatccttaaattaaggcagtacaatcaacactgcagcatactctggtgacctacaacataaaaggcatgaaccagctggcaagtcaggtgactcagggtcttttgtcatctcagtcctcatcctctaatgccatggactctcctcatttctccagaagtgtttccatttccacacctttaataattcctttactttagttaacctttccaggtgtgctctccctgagctctgagccttagttcattggtttagctctgatttagttcatgtctgtagcctgacaatgacttgttctttcttaaatttgtgctacacaggtggaaatctaaagtatggtgcatatttgattaaaagaatagtactatgtagaattttaaatggatagaaatatatagggtttatgaatacatttactggggcaaacaacatgttttacaaatacactcatgtttatgatagtgtatcctcaagaagacaaaactagaatataacgtatatactcctttacaaggagcataagtaaagcggggcccaatttcattgtaatgttgccatgagcaaatggggcattacagtgaaggagacaaatggaaactgaagagaaagactctgtcattacataggcaggactctactaggaaaggattgactggtctataaatcagctctggttcttatggcccgaaatattcccagagagcatgtaagagctaagacttcagagttgaattttctgcatccaaactgtagctccaaaacttaatagcttcctgtgctttcattgtttcttttgtaaatggggacaatagtaaaatctgtcactgtgtgccttggtcagtgatatctccagtgaataaatggggttagggacatggtagatgttcagtaaatacgaaaaacaaaagtattctttattggctaagtgagcatcgattatgcaagtgctaaaaacagtgtctgactgaaaataaagactgtctagagtttagatatctcattcctcttattaacattatctttattatataactctattaagttggggaagtgtcctttgaaattatcaagtctcttgtttcttattagaaatataacaagaaaaaaattgatctttggagtgtacttatccactagtggagagcttggtgcaatgaacacttaactattttccagagagaatattgcactctctaaagtttgcctttcttgtgtataaatgcttgcagttggtgtgtttgcaagatgggcttcagtaaatctgaaaacaccctgtggaccaggagtaattacttttcttccagcccatacttatttgctacctttgacctatatcccttctaccattttgcttctgttctttcccaccccttaacctccatcatggctgggctgaatgcagctaaggtacattttgtcattgttttttcttagtgggatattacttccatttacattttaatcacatttagatatatttttgttttatttttgtccccattcattagggtgcaaaaagtgacaatttttgctttttatgaaaagagaaagaaagatatcatgtctggcatgctatggaaaacaactgtacaagtcatttatgttataacatttacatctcattatgaacatttaggacaaagatggtttcctttagttggatcagaatcaacaaagaacctctgaagtttctttggaaatttgaattttcatgcaaaaaagtgtttttaatcaaattgaggatattttttcaattgtgtattctcattgagtatgatgctactcccaagggtgtaaaagtgtagttcttgagagtgggaacaaatcttacagatttaaatgatttgtggcccttcaaagttcaaccctatctaacaaagtcttattccttagttttttgttttctccccattgggttttcttgtgtatcacatgagaagcattgacattaagttcatggaagatacacaaaatgtatataagttcagtgttacaaacctatggaaaatgagtggctgtgattgcagtactttccaaggcttactagatctcacagtcatatcaagagatgtgtcctctgcatacatatgttttgtcactggccatcttatagttgttgcttatttttgatccttagcatttctaactgtgttgtgggctttgaggataatttatattttattaattctacaaaaattgttcagcacatcaataattaggtcaagcatcgaagaaaaaagtcttgacaatatttaggtgactagcagctagtgaagttaaaaaatttcacacatgcaacaaaattaaaagttaagtacaaccctgccacagaggccgggagaggcgactggccctttgttggtctgtgagaaatcaaacttccaacatgacaagcaggaagcctgcggttaagggagtcagcgtgtcacaaatacaagcacctggggtcttccaagagcatcatacctcctccagcccctggagccacctgctttcctaactggctgtgggaaatggcctgaggtcccagatgctgccactgtgctgctgccttccactctctccaagcagagcgcaagttcagccacctttgaaagacacccaccccctggcctggggatgcacaagttcagagctttgcagggagtaaccatgggttatggcttcatgaaaatgtcctactcaccagtgcctttttcgcagatgtggatgtggaggcatgagggagggtaattattggattaccaaggtgctgctaagagcagaggaggaaacccctattcccagtcatatgtctggtgtgacatttcactaacccatttaagtgcacaggcctccaaatatctacctaatgagtatgatggtttgggcattttacacttaaaatcactggcctcatgtcaactgaagcctgactggccagtgtctcaaagtcacagatgatgacctgatccctcaggaacagatggtgtttcagctttgtgggagtgactgtcaaggtatggagcacttaggtggtctttgaaacctgtcaggtttcacatctctgctttgagtgaaaagctcatcacccacagtagtgaggaatgtgcctatacttgctggggctgatctgttgaaactttatgtgtagacaatggaaacatccaggagcatttctgctttcatgtagcctcttaataattgatgtccctgaagtcctgtgtcctcagggacagttcctctgattcctggattgtaccagctttcatgatgttaaatctaatctgtaaaactctgagcattaatctccatgaaaataagaccttgttctttctcatttaaatgccccttttttttcttgtctaatattctgagtaggatttccagtactgtgttgaaagaagtagtgagagtgggcatccttatcttataataaatctcagaaaaaagattccaacatttcaccactgactatagtgttagctaatggcttatcttatagctaataaggaatgtgtctctttattctgaggtatattctttatatacctaatttgttataaattgtattagagatggattttaaattttgtcaaaataattttaggcatgcataaaaatagttatgatttttaatcttttattgtgtaaataaggagtatggcatttattgattccaacatattaaaatattcttgcatcccaggaataaatcaagcttgatcataataaatgatccttttatagtgcttttgaatttcatttgcaactactttgtggatgattttgcatctgtgttcatcaggaatattggctgtaatttttttttttcttgtaatgtccatctctggcttaggtatcaaggtaatgctggcttcataaaatgagtttgggagtattcctccttaattttttcaaagatttggttctgtttaaatgtttggtgaaattcaggagtaatcagatctaaaaaaacgtaagaacactaaaaataaatgataaaaatattttaaagttttaagtgtttatcactttcaaataatttttaagtattcattacttagaaaatgtttatctataaacattagaaaatgtttataatttgttaatttgcttatgtaatttgatacactacaatttatttgtttgtttgttttttgaaacagagtctcactctgacacccaggctggagtgcagtggcacaatctcggctcactgcaacctccacctcatgagttcaaggaattccctgcctcggcctcctgagtagctgggattacaggtgcacacaaccatgcctagctaattttttttttgttttttttttgtttttttcgttgagatggggtttcaccgtcttggccaggctggtcttgaactcctgacctcgtgatccacccacctcggactcccaaagtgctgggattacaggcgtgagccacctcgccaggcctacagtacaatttatatcagtaaataaattacgttgaagtccataagcaaatttagttataaagttaagaaaaatttgaatagattttaaatttaacttttagcttaaatttttcatttggttatttttaaacctgcattgaatacaaagattaaactttgtactttttgattatagagatatacatatagtatataaatagatacatattgtatctgtgttattaaattttcacggtgggttcaattaggaaaaagatatctaaaaagtctctgggaacaagatggggaagacaataatgaaaaacaaaacatttgagaaacacggctctaaactcatgtaaagagtgcatgaaggaaagcaaaaacagaaatggaaagtggcccagaagcattaagaaagtggaaatcagtatgttccctatttaaggcatttgcaggaagcaaggccttcagagaacctagagcccaaggttcagagtcacccatctcagcaagcccagaagtatctgcaatatctacgatggcctcgccctttgctttactgatggtcctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacatctggtccaacatgaaaacaattcttattgactcatacaccaggtcacgctttcatgaattctgtcatttcaaagactctcacccctgctataactatgaccatgctgataaactgatttatctatttaaatatttatttaactattcataagatttaaattatttttgttcatataacgtcatgtgcacctttacactgtggttagtgtaataaaacatgttccttatatttactcaatccattattttgtgttgttcattaaacttttactataggaacttcctgtatgtgttcattctttaatatgaaattcctagcctgactgtgcaacctgattagagaataaagggtatattttatttgcttatcattattatatgtaagatgtaagtaaaaatgacctttctctaaaccaggttgtatgttgtactcaagatataaagctgaatacaataaatctacttcctactctcttgcatatttggtttttgtatggaataaaactaaagatggtaatcatacttaatatcagttatcctaaatactatgagaagaaggagcaactaatgatttctctcagcagcgggtaaactgagacaggtgaggaaataaaaataaacagatatcctcaaaagttgactggtaaacatctagtagaaaatgtctattgccagttggatatatgagtttgcaacttacaaggaatgcagttgctgggggttcatacatggcaagcaaaatcccagaaatggaagtgctcatgtgtggagagagtgtagacagagaaaaggacttaagcaggattttgaggaccttccacctttaaagtgagggaagagaagagacacagaggaaccagaggtggtgtcccttatattagactaacaacaagagagattggtgattaatatggtttggatctgtgtccctgcccaaatctcatgtggaattgcaatccccagtgttggaggtagggcctggtgcggggtgactgggtcatggctatttctcatggtttaacaccatcccctttggtgctgtcatggtgatagtgagccctcctgagatctagttgtttaaaagtgtgtggcacctacccctacccttcctcttgctctcgctttaccttcctctctgaagcctccccagaagcagatgctgccatgcttcctgtatagcctgcagaattgtgaggcaattaaacctcttttcttataatttacccagtctcagctatttctttgtagcactgcaacaatggactgatactgtgataaaagtgtatttaagaagataaatgtgcggggaagatgaatcagtagattttcccaagatacggattaaaactgcccagtaattgggaaatagatagccttggcaatcttagtgagagagctggtttggtggaattaataagtagaagtcatactgcagtaggatccaagtaagagaagttagtgactctgaagtgaagatggaaatagaatggaatttgaaaagaatgtggattattgtttttgtacacagtttttttttcttttttgcagtatattttttccggatagatttcatgtaactgatgtactggcaaccatattgatatgtttagtatatttatgttaaattaaaatatttaattacaatgataatttttcattttttaaataaatactactttgaatatcagtaagctgccttaattctgtaggtgggaatagaaaactaattcaatccgtcatcacaatatttaattaatactgataatataatgattcctggacctactggctttattaattaagttacttaacttgcgtaattgtaacactggtttactataattttacttcagcttttaacacattttattttctggtagagctcatatattacttcttggcaatttttcctgatgttatgaatattacaatcttatgccaatccaaaaataactaaattaccatcaacataaagactgaaaacttccttcacaaattaataatgaaaagggaatcaacgaatctctgtctcaatacttaagataaagaaaaagttggtcataaccagctgaaaatacagtatgaaccatggaaattcagagagcaagaaagagttgtgtagaattcacaaggaaaaaaaaagatttaacaattataactgggccgggtgcagtggctcatgcctgtaatcccagaactttgggaggccgaggcaggaggatcacgaggtcaggagatcgagaccatcctggctaacacagtgaaaccccgtctctactaaaaaatacaaaaaattagccaggcgtggtggcaggcacctgtagtcccagctactggggaggctgagacaagagaatggcatgaatccaggaggcggagcttgcagtgagccaagatcatgctactgcactccagcctgggcgacagagcaagcaagccgtctcaaaaaaaaaaaaaaaaaaaaaaaaaaaaaaaaaaaaaaaacaaaaacaattataactgaaactcagaatacaaaactgacaaaatcacccataatttacattatattacaaagaatttgacattgaaatttcattctgcttacatgtatgtgtggtgttaagaaactcaatctctttgagcctgagttttctcataaataaaatggattcagaaaatttatatagttgtgatcataaaggaacacatgcagtttaaagcacctaccacagtatcttccaccatgttgcctggtcaacatgatgaaaccctgtctctactaaaaatacaaagattagctgggcatggtggtgggcgcctgtaatcccagctactcaggaggcttaaggctggaaaattgcttgtacccaggaggtggagattgcagtaagctgagatcacacctcactcaaggagttaaacgatgttaagtattttcctccttttcttcatacagctgtagatgggaatagtatttgtctttctgtaaaatttttaggatctgtggtgtcatacctttcaggaattgaccttcaaaggaagcagcctaaaaaaaaaaacccacagattctgtcatgaactgtagagaggctgaaaaattgtcattcctcacttcagagtgtcctatttatattcagtcaggaaatggtggcttgtataaatacctgagacaagagaataatcatgcagattgatgcgcagaagacatgtgatgtttcttgactgattatggcacctggcacattctctctctggctttactcccttcaccttcctgcccattcacacagagctgttttctgttctgttgtggtttcagcttgatggcttccctaaagatcagaatgccacaagtgctaagcagaagtgaaataaaatttctaggttttgcagaactacctgcaagagaggatttcctgaatttccgctgagtatgatgtaatagtaacttaatgaaaaggaaagagaaagcagaatgtagtttatgtgcagtctcctgaaaacctctcagggaatcacaacctggtaaccaaaggtgacaagggcagccaccaagactggagggctgatttctgatctatgcagaaacccatcacttctgggcatttctctttatgctgcaaaaattatacttcttggcaagaaaagatgctaatgctgtcataagcctgttccttacccttggtctaatacaaagagaatcagtttctggctaccatcagggcat

SEQ ID NO: 147 - DNA, 22181 bp, Homo sapiens
agcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagatcaccactctattttggatctcactgagtttctgtttaccttacaagtaatcagggtaattcattatgaaatatagtatttcacttaaaatactacggaagcaaaaactactataaaagtaaaaaataaaaatgactcaaatataacaagagttcttcattaggccatgatggagtaatttggaaagcatttcctgccataaacaactcaaaaaccagaaaaaatatatgaaaaatgcttcacagatgttggataacaagcagaagtaaaatatttatttctctttaaagaaagagaaatatttatttcgcactaaaaagtttatttctttctctttacttcctacatcttgtgtcatggccagggtattgcctacaagcagtatgctctggcaatcatagagcctacacttgtttctgtttcttttagagtcatagtcctatgctgtcacaggatcacagtgtaatgctgcttggtatctagtatccataaagcattttttattttgtttttttttttttctggtttctgagttgtttgtggcaggaagtgttttctaaattactccatcatggcctaatgaagaattcttggtatatttgagtaatttttgctatttacttttgcagtattatcctgagttagttcatgtattcatgcatctgttttcaccactgtcttttctcattaatgacctacttttgaaccagtggtttacttttttataaattgagaatatgataaagcacactaccaaattgaaaaaaaattcacgcatatgcaaataacaacagaggataagaacatatgttttctgaggtgatctatatgttgttatcttgcatgtttattgagaccagttggttccttagagcatatatacatttccaaatgcaaaacataagaagaatataatgagaatgtgactcaaattaatcttgcttttcaaatttgtctcctgtgtgggaagacaattgtttccttttaatttttcacctgaaactactataccacttatgaattccttgcctgaactgctagtgactgaacctagagaaacattgaggtagtacaagaatgcacattttggtgttagacctgtgtcttcgctcttacaattccaaagtttttttaaaaaagtttatcaagtagttaagtgaaatactgtatttcataatgaattatgccgattactggtagctgatcactagtagtgaacattatatttttaaaataaactttttattttgagataaatgtagttacaggtatataattgtaagaaataatgaaagtgattctgtataccctttacacagttttctctcatagaaacatcttgcacaaatgtgtaacatcctaagtctagatactgacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccctttaaccacacatacctcctttctaccctggctcctcacaaccaccagtttgttctccattttataattttgtgattccaagaatgttttatatatggatcatttacatttaaggtaattttgatatattagtgactaagtctgctgttttattatttgttttctgtttttttccttttcttgtgcctctttttctctttacttgcttcctgtgggttatgtgaataatttttaggattcctttttgatgcacttgtatagtgttcttaatagtatctctttgtaaaattttgatagtatcttctgtataattttcttagtggttggtctgtgtgttaaaatatatatatttgacttatcacagtctactggcaccagtaatttaccacctcaggtgagatgtggaaaccttgctttcatttacgtcactttagctttacttttctcacttttaaatatcattatcttgagtatcggatggtgttataatttttttccatcatcatatattatttataaacattcatgagaaggataatctgttgtttgtattcatgtttctgctctatttgttgtcctgacttctttttttttttttttaattatactttaagttttagggtacatgtgcacattgtgcaggttagttacatatgtatacatgtgccatgctggtgcgctgcacccacttttctgatgctccaagcttccttcctttatctttctgtttgaagaagttcttttaaccattatttaaagagagacctgctaatgacaaattctttttttttttttaatttaagaattttttccctcttaattcctgaaggatagtttcactggaggtagaattcatactttacagttctttttctctccagcatttgaaaacagttgtgctacttcttttggacctccatggtttcagatgagaagtccattattattaaaattattgtttttctaggtaatttgtcatttcactctggctgctttcaaggtttttttccttgtctttagtttttagaagtttaattatgaggtgtcttggcatggatatctttgggtttaacctatttaagatttacttagtttcttgaatctgtaagtttatgtcttttacaaaatttggaagtatttggccatcatttcttttttttttattatactttaaattttagagtacatgtgcacaatgtgcaggtttgttacatatgtatacatgtgccatgttggtgtgctgtacccattaactcgtcatttaacattagttatatctcctaatgctatccctcccccctcccctcacccacaacagtccctggtgtgtgatgttccccttcctgtgtctatgtgttctcatcgttcaattcccacctatgagtttaaaaactctgtaagccccatttctttttcttctccttttgggattatggtgctacaaatgttggatcatttgttattgtcctaagggtctctgagactctgttcactgttttctctatttttcatattggataaattttatttatttttatttttaattttttgtttatttttataattttaacttttattttagattcagggggtgaatctcaatgcaggtttgttatgtggctgtattgcatgatgctgaggtttggagtatgattgatcttgtcacacaggtgtactgagctcagtacccaatagttattcaccccttgccccactccctctctcttgataaattttattgttctgtcctcaagtttaacaattctttcctttgtcatttccactccggttttgagcctatcccgttagtttttatttgttattgtagttttttttaaacttttttttttttgctgagatatttttgtttgtttcaagataatttgtaatagtagtgaggttgcagagaaaaaggaatgcttatacactgttggtgggagtgtaagttagttcaaccattgtggaagacactgtggtatttctcaaagacctaaagatggaaataccattcaactcagcaatcccattactaggtatatatccaaagaaatatattaataaattattctattataaagacacatgcacatgtatgttcattgccagcactattcacaatagcaaagaatcaatctaaatgcccatcaatgatagactgaataaagaaaatgtcgtacatatacaccgtggaatattatgcagccacgaaaaagaaagagataatgtcttttgcagggacatggttggagctgcaggccattatccttcacagattaacacaggaacagaaaaccaaatactgcgtgttctcacttataagtgggagctaaatgatgagaacacatggacacatagagggaaaaaatgcacactggggcctattggaggtgaattgtggaaggagggagaggatcaggaaagtaactaatgggtactaggcttaatacttgggtgatgaaataatctatacaacaaacccccgtgacatagatttaccaatgtaacaaacctgcacttgtaccccaaaacttataataaaagttaaaaatagttatagttacatgttggagtatttttatcatggctactttaaaattctttttagataattttaacatctgatccattcatctcagtgttagtattacttgattgtctcttctcattcaagtcgtgatttttcttgttgtcggtatgacagggagtttttgatcatatctttacattttgggtttcatagtgggagtctctgggttctattttaaatcttttatcttagcaggtagtcacctagtttgggttttgcattcaggtcttgtggtgagatctctctttgcagtcttaggccttgtggggaaggggagtgctttccctgcatatttactgtaagtagtatttggcaggtcccttttgctagggctgccagggtcatctggttttgtccattggactcgtgttcagtttggctaaggaataagcctacccaagtaaccttttgttctaaggatgggggttgagaagtgctgggcctcagtaaccttcttctgttgggtgagtgagtgtcatgagacacacattctccagtccctagccagtctgccttcgtctttacactttagattttttctttggttgtctcttacacagtttctaaggtctgtggggggagcagggaaaaatcagtctacactatcttgttccacttattaacttttaaacttttgatgtgttattcaatttttctagctttgaatttcctaatttgtaaagaagagatagcaataatataaccctccaaagattattattaaatgagataatgagatagttactgagaactgtgctctattagagaatgatgctgctgttgattgcaaggttgtttattgcaccattgtttctaagggcaaattgaaacccaaatgagtaacaaagtagagttatttaaataaattgtatattatcaacacaatgaaatttagctcttaaaaaagtaataaatgggacacagaatgatgccccaaatgtcttgttaagtgaaacagtagttgcaacatagtatttttagtacaaatatgtacacacacacacacacacacacacacacacacatatatataaacatatctatctaaaaaacatgtacatgtgttttatgtatacgaaaatattcagaactgtagtttgaaaatagtctgtatgtaacaaattgtgaaatgtacctctaggtagtgggctgggggaaagggtaacttttacattttatacctcttaattcaatattttttggtaaggatcaagtttatctttattaaaaggaaatgaataaaactatgaaaatcttttagttcaaatatatatatatatatatagttaagtggttaaagaatattaatcaaattatttctgataagttgtcttttacttcattttttggaaattacctccaaaatgtaatgcctgttagttacatatgagttccgcaaagtttcttaacatagattaagtaccagtggcttggatgacttttttggatatttctattttttatgatcattgtagaatcattttctttactaccttagaattttgtaaatgcaaagaatttttaagcattatcattttctattagttgatttgggtattttcaatgagctgactaggatgccacattttaggtggctggttagaggaatgatggagatgtgatctatatgcatatttaaaaacaaatgacagatttttatatagctgctttttataataaattttctaaggccaagaaattgtgggcttttcgtatgcatttcttaaaagcatcccttgcatatgattggtgtttttattagtgaaactgcattgggaaatgaatctattgtagatacagcaagcagagtgggattttaatatcggaaattagttacaaaagtgttagaaggactagagataccaaagggaagggatcacccagaaatccagaagtgctacatacctaggctggagcctatgatcacatttgccactgagcaactaaacataccagttttgctactgagcagggaatacctattaagccagcactgccattacttactgtaattgccttcctgttcctgctgctagaggcaaaatcagaatctttcctcttgccctttaatctcatactagtactcccattggtggaacctaatgtaacacaattgtcaagcgagtcttggaaattttattgtttaggttttcatcctctgcaatacaaaggactttataaaaaggaaagtggggcttataaccaacaaataaaggaccagcacagtactaaaaatgtgttcaattaattttagatttctaagggtagggatcatatcattttatctttataatgtcagtgactaactgtcacatagtaggctctcaaaatatttgttaaaaatttttttcagagctatttatgtaatataagaataaagttttcctttttctcttgcaaacacataaaatgttctttttagtatttcagagtttaacttcatctatggaaagaccagtgttactcaacttcaaacccagcacctaacctggcacatacttaataagtgtttcttgattaaattaatattagatatacaatgtttactcataaaaatatgtcattagaattaacttgttggtattttggtgatatattagttatatttaaaaatactacttgaaatttataatgtattttatttctgttacagcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggtgagtacacaaaataacacattttctatgttgccattattattgtaaatgattgactttaaaatggtttctgacatagaaatacttactttatatgcattcattgtaaatgctgatatcgtcttaatttcagatgagtaattttgtttaccagtatgacttcgatatcatctgttcagggatttgttcttctttgcactcatattttattgtcatctgtaaattttaaaaagcatttatttagtttcatcatctaacttcctgtgaaatacagagcttgtggcatttaggtaaattttcaccttttgttgttataaacaatgctacactgcacttcttgcactgatcttttcatgtacatatttaagagttgctctagggtgcatacttaaaagtgagatttttgtatctgagagtatttatatcctcaactttattacatgttgccgaagtgcttttcaagtcactgtggtaatgtgtatatacttccaccaacagggtatgtgtccctgatccttcatgttctcaccaacacttgaaaattgtgagaatttttacttttgccaaggtgatgggtgtgaatagtattttaatgtgcattttcctgattagtattgtaaacatcttcttatgtgttgatttcctattgtttcctgtttagtgaattgcctactcatatccataatattctctttatgtttgaaatattattaattaatttttcatttattggtttttttggttatagaagttttaaaataaaatttttgttctaatttttctttgtaaaatctgggaaatgacttttttttcttttaagacagtatacattcttttaaacttctagcattaagttactttatgtgatcaaaggaaatacacaggtttccatcaaatcatgatttgttctaccctcttcactttcatacatatatcctaatttctactttttaaaaaaatatagaattataacaccttttttcttttggtaattttgataattcttatttttagtctaataaaatgtagttttattctttatatttttatattcatttttattttgtataactcataaatagcatcttctgtacatttaatatttgtaaatttttctctgacattttgctatgttagcaagtggaattgtggtatagtgatgaaggtactatcagtctgttacacattttaaacatgtatttaatttaatttaatttatttatttgagacggagttttactcttattgcccaggctggagtgcagtggcacgatctcagctcactgccacctccacctcccacgttcaagcgattctcctgcctcagcatcctgagtagctgggattacatgcacacaccaccatgcccggctaattttttatttttagtacagatggggtttcactatgttggtaagcctggtcttgaactcctgacctcaggtgatccacccaccttgacctcccaaagtgctgggattataggtgtgagcaactgtgcctggccctaaaaatattttttcaatgctgtgtcataccaaaagggaagaataacttctgtatgaaggaggcagtatagttcacagtaataataatgggtatagcaatgctcaggtaagaagaatcttaatgaaagtgaatggataagagagcagaattggatattatttgtgtaaagtcaaaatgagagattcagttgttgctcactacttgaataaaattttgttaaattttccatgattttctacctgaaaactttacatagtgaaagttttgcctagatgaatattattgtcagccctggcaattttagtatgtgcacaaatggcactggatatttatatgtaaaacaatttactaaaataatttgtaaattattttaaacacctcattacaaatatgttgtagatgtatgatgctttaatattttaatgggtcttaaatttctttaaacacacaaagttatcagtgagcactaattgattttttcattatccttaaaatttgtagtattctttaagcttagatcttttttagcatatttgtcaagtttgctattatatatggattatgtcagtggtccccaacctttttggcaccagggactggttttgtggagacagtttttccatggacccagggaggggagatggttttggaatgattgaagtgcattatatttattgtgcactttatttctattatttttattacattataatatataatgaaacaattatacaactcaccataatgtagaataagtgagaatcctgggcttgttttcctgcaactagatggtcccattctgggggtgatgggagacagtgacaccgaaagtgttttgcctatgttcagtctactccataatctcattttggttgctgtcactgcagaaaactctgctccacgaagacaggatgctggaaatagaagcaggctttttggtgcttttgtggcaatctcaggatattctgccttgactttaactcacaatgtatagtgatttgaagttgtcttaaacatacttttaaggctactgtcatttgcgatctcatgcagttgatcctcttctagcatggacaaagtcgattcacctggcttactcgcaaatgggtcgcgtatccattccttcccagtttggggtctttttgaagttgggaagtaatgctgaaattcttttgtaagctgtaatagttgttcatgcaccagctgggagaaagatggtgctgggagaaaaaaatctcttctaatgtttgaaacatgtcagaaattcgagagtttacttgtcgcccccataattccagtttggcattgaatgcagccactttacctgccaacttgaatgcagttgttattctctcctgaagtgacagaatgagtttcttgagcaggttgaatatgtcacacaagtaagcaagttttgcaacccattctgtgtcactgaaatgtgctgccagtggtgactgtttttctaaaagaaatctctgcagtagcccttgtaagttgaaaactctgaccagtgacccacctttagaaagccacctcacttctgtgtataagagaagacatgcggccgggtacagtggctcacgcctgtaatcccaacattttgggaggccaaggtgggcagatcacgaggtcaggagttcgagaccagcctggccaatatggtgaaaccccatctctactaaaaatacaaaaattagctgggcatggtgatgtgcgcctgtagtcccaggtactcgggaggctgaggcagaagtgcttgaacccaggaggcggaggttgcagtgagctgagatcgcgccactgcactccagtctgggtgacagagtgagactccatctcaaaaaaaaaaaaaaaaaagaaaaagggatgacgtgtgtgctttgcacccatctcctcacagagctgtgtgaacagatgtgagttgagggcatgtactttaatgtggttgataattttcatcacatcttgctaaatattgttaagttcaggtgacatttttcgcctagccagcatttctctattgatgacacagtgagtagactcacattcagaagcaacctctttgacccaagcagtaaaaccagaaagctgcctagtcatggcagatactccatttgtgcgtatattgacaaaaaatgaccaattcagttttcctgatatgtaatcattcaaagatttgaatacttctgcagctgttgtgttggttgtcaacaaaagttcacataatagtctgggcatggtggctcatgcctgtgatgccagcactttgtgaggcagaggcaggtggattgcttgaacttaggagtttgagacaagcctggctaacatggtgaaaccccatctctactaaaaatacaaaagttagccaggcatgatggcacacacctgtagtcccagctacttgttggtctgaggtggaaggattgcttgaacctgggaagtggaggctgtggtgagccgagatcgtgccactgtcctccaggctgggtgacagattgagaccctgtctcaaaaaaacaaaaaagagagagagagagaaatgtgcacataacatatcctcgtgcacagcctcctgaaaaatatattgcacaaaaacaaacgttttattgtcaacatcagttgactcatcaacctggattgcttaccaaggtgacttattaattctctctaacaattgtgcctcagtatcctctgctatttcatcaattcctctagttatggtgctagctgaaagaggaacacatgtcaccttttgaactgcagtctctcctaaaagactacaaatgtcttcagcaataggcaggatcaactcttcatcaatagtaaagggcttctatggtttagcaatgctgttagctactaagaatgatgctcttagtacagacccatttgatgaagtggtggctttcaataattgcttcggctcttcgtgttcactttttttcttttgaaaaactccaaaggcttgttttttaatgcagggtgcttggtctccttgtggtgaagcagttttgaaggtttcatggtttcattggatggctggttgcaacgtattgtacaaagtggacttggagaatgtgaatcacctgttgtaatgaacccgtaatttaagtaagactcttagtattttctttgaaatgcagctttctttttgttggcagtctaagagtcttctgctatctcatcattcccccttttcaaagaagctctccagtgatgtttgttttttactcagtttggctaaggtttgtttgtgggcttaccaaaactgtaactgaaacaagtgtgcagtgtgggaaagaggtgtggacagaaatggtaaataaaataatggggggggggggcggggtcaggcagtgcccgcatggactaaaataagtattagattctgccttcaagcttgctaccagatgcgactgtaaaattgaagtacatcatctcacttgccactataaagcctgctaccagatgcagcttaattatcacttgccactcactcactgatagggttttgatatgagtctgcaagcaattgatttattgtggtccctgtgcactcaaacctctctgctaacattaatctgtatttgcagccactcccaagccctatcatcatcacctcagctccacctcagatcatcaagcattagattctcatagggacatgcaacctagatccctaacatgtgcagtttacaatagggtttgcactcctatgataatctaatgttgccactcatctgacaggaggtggagctcaggcagtaatgcgagtgatggagaatggctgtaaagacagatgaagctgtgtttcctcacttgctactcacctcctgctctgctgcctggttcctaacagggtgttgagaaccctgggattatattgtataggatgtcaccattatgtgtccattatgtatcagtattatgtatccactgtatagactgatatttattttttaccacctcagaactggtttcggtttttagtagatatggttacatagatagggcactttgttgagatactaggaaatgtgttttgaggacttattctttttcagtggtgaaatgaattcttttggactgttacttcccctgagaaaaattaggaattttatttgcctaaagcatgagagaactatcaaaaccatgagaatttgtcagagatttaggagaggtacaatgtcaagggatacaagacaggcattttgtgtaattttaaccttgagacagttagaaatcctggaaacctcctgagacactgagcagtccttttgtcagccattacagaggaacaaaattagatatccagatgtgccaaggaagaggagccttggtacatacttaaggatttagtctggccc

SEQ ID NO: 148 - DNA, 28862 bp, Homo sapiens
taaaataactccttcagttcaaaaattaacctttcttccttccagaaagtttgggcaagggaaaaaatggaagcatcagggcttccagataaccagtccatgggtctgaggcatgcacttgatctctcaagtcaccttctcggccctcttctaagtgtactttatttcctttcattcctgctttagagcttttaaataaacttttactcctgctctaaaacttgcctcagtctctcattctgccgtgtgcccctcagttgaattgtttattctgaggaggcaagaattgaggttgctacagactcatgtggatttgctgctggtaacatactttggtgccgtgacttggatacattctgctaataacataatttgttgctgcgtgattcagatatgttccccagttgtaagatactgcgatggctcaccttctttggctggaggtgttaaaccccagtacatggttctcttctccctttttgctctaatgctcactaaccaacccctagaattacttttctcagccgcaagtggctgttcctctgttcctccagctgatctctcagctcaacctgatgggtggctcgcaggggtgtgaaggaccttggggttcacaccaagtagacctgagacactaaacatcttcctggacaggaggcttatgagagtggtatggtgaaatcctgagaccatgcaatgtctggggtttcctctgctttttcacctaaaatcagctctttcccccaaaccttaattgcctattctcctgttttctctgtgtatattctgaaatgaccttgcatatctctgaccatctgccttgggggaagtctgactttttgctttcactttgcatgccacataacttcttaaacacacactccttgttatttgggcacctgtggctcttgctgcatttgcgtgggagcaaaaacatgggctaccttgtggatatcctctgagatttatgtttgtttttaccctaccagctcagatgacctccaacccttcccctgtctgctggcacattgctgggacagacactaattggaactctggctctgtcggctacttatgacttaccatatgtttttgttcctgttatgccccagggacaagttttccagtggcccttgaagcaatctgtccacctgcataaggcctcactctgtggccccacttgctttttctgagttagcacccctttgggaggaggagatagtctttctttgtcatttgtgagttcttaccccaagctccaactcttctagaggttactactttatgtcaagagggcaaatagacattgccctcttgaatccaagggcttttggtttggggaacatacgaaggctttccatgagtgttcctctttcttcctcctatttcttcctgtagcctccatttctcaaatcactttcacacccttctcagtatgcttcaagacctttatggtcttatttgaagggtgggggaagtctagctcccttgtggcagttagctgaaaagcaggcttcttgtctacttgaacatgagaaatgggaatctgagaaaagaaataatcattttgttgataaaatgctctgagcaaaagttactataacatcatggagacaaggataggtcagcccaagagcccaggcacaagagacccataggacagagataaaggtttgccgcaggctaatagattaccatcagaacagagatgaaggcaaggttaggggtacatggtaagactggtttattctggaaccccaaggatgaacaggggagggtcctctcttcactctggtatctcctctgttctcaagtgggtcattgtaatgagatgggaccagggttaagggcacacagtaagaccagtttattccagaaccctaaggacaaatgggggacaccccattcagtataataggaaagtaataggggacaacttcttgttcctttttcctttttttctcctctgttctctctctgcaaatgggtaatcacatctccataccacagaacacacccttaggatgcatccttaagaactggaaaaagtttaattccctgaaactttgaaaccaaaatcctagttttccactgtaatactgtttggctaaaaatgaactcagagaaaattacaaaagtcagccttggaacccagtgcctctgtgcaggagatcctcaaattagcctcctcagtcttttataactgagatcaggacaaggaagacaagcctaaggaaaaagagaaatgcagggggaaaaggcaggctgaactattggctgctctgcaatagaggctggagctctccaactccctccaggttgccctaaggacattccttcacgtaactgccactggtgtggcaatccaggccactagaagacaaactgccccggtgggataaatgggaaaaagccatgtgcagcttgccctctctgccacaagcttggccactggaatgagactgccccaagggctgaagggtccgaggaagggatcccaacctttgatggccttgagccaaaggggctctctgctatgactggcttccaaatcagaaagcatcatcaacagaacaaagccaagggcaactctggaggcagaaagtaacattgtacatttcccttttgggttcaagagctgcctactctgtgctaatatccttctctgagcaactctcctccaaatgctactgagtaatgggaaaaaatggcacctccttcatccaaaagaaaagattcgcacctctttggggaaaaatatactttcaagttggatgcctacttagtatttacacaacttttgaattcatctttccttctaatagcactatttcttccaggaaagctacctaaaacatgaacaaattaacttcaacctggaccgtcttacctcagggtttagaatagcccacacttaggttgacgagccctagcaaaaattgaactgaacaatctcttgagtggagataacttctacagtatgtaaataacctcctcatttactcccccttcacagaactggcacagcaacatgcagtaaaatccttaactttctaatagaaggaaaatgacttgtctgattcaaaggttataaaggtaaagaggtatttctgggaaggaaggttataaagaaaatggattttgtatgagaaagaattttgtttggtaaattcttgtcccaaagtaaaataactggttgtttaaaaagaaagatatttaggacaagtcagaaagtccaagtatgtcataagtggcccacgttgtgaaaagattagtgaaaggaaatttatgaaagaaatcttgtacaatttaaaggttaataggcctgctaattaactgttactatgattcttaactatacaactacttgtctgctttaaagctaggtaaggcctggtgacagagttagccatgcaccctagctatactggagtcagaccttatctgcatttctgtctggtatcctaggctcaaaacctcatatataattagaattacttacttaccagctgataagatttggctgtgtccccactaaaatatcatctcgaattgtagttcccataatccccacatgttgtggaagggacccagtgggagttaattgaatcaagggggcgattacccccatgttgctgttcttgtgatagtgagttttcatgagatctgatggttttataaggggcttttcccctttgctcagcaattctcttcctgctgccatgtaaagaaggacatgtttgcttccccttccaccatgattgtaagtttcctgaggcctctcaagccatggtgaactgtgagtcaattaaacctctttcctgtataaattactcagtctcaggtaggtctttattagcagcatgtgaacagagtgatacaccaggttttcataaaaagtttctaagagttaaacagtgtaacatgtatttgagactacttgaaaaacagttttacgtgcaaggtacgtaaggaaagtcaaatgtgcttttggtaaaagattataaaaaggcatgggaatgtggatttttgtcttgtttagaggatttaaggattgttttaatttagataggataaagctaaaggtttaaccaagttgtggaaggtttctgaaatattaatcttgcagaagaaattctgtgtgtaatcatattggctaaagttaaaggggtattattcaattttcatttaaattgagcattaaaataaaagcaaacagttttattaaagcattaatctgccctttatcaatgtgctattggtgtgtgttccaaaattacgtaaaactcctaatcccttttttttttttttttttttgagatagagtcttactctgtcacccaggctggagggcagtggtgtgaccttggctcactgcaatctctgcctcctggttcaagcaattattccacttcagcctcccaagtagctgggactacaggtgtatgccaccacacccagctaattttttgttgttactgtccttttttagcagagaatgggtttcaccatgtttgccaggctggtctcaaatttctgacctcaagtgatctgaccacctcagtctcccaaagagctgggattacaggtatgaaccatcatgcccatcctgaaactcctaatttttatataccttagtatacattatcagtaatttttccctcttgttataaagaataaaagtaattttattttgccaaatgttgatgtctatgttgagattaattcattaaatcattgaacacttcttatgcttcaagttgctgagctggtcacaggggattcaacgaagattgaaggtgtttgttagtcacacattattaacacttacaaattaatcctcatttcatctgatgagggatatctgcatttttcagatgacagggtctcattattttttatggttgaatagtactgcattgtgtgtatgaactacatttcctttaccattcatctgttagtggacacttaggttatttccaaatcttagctgttgtaaccagtgctgcaacatagtagtgtagatatctcttggacatactgatttcctttcttttgtgtacatatacagctttgggattgctggatcataaggtggcctgatttttagttttctgaggaatgttcaaattgttctccatagtggttgtactaatttaaattccaatcaacagtgtacgagatttcccttttctccacatcctcatcatcacaaattaaaaatttataaatacacatttataacactgatacaatggtagacttaaaagtcattcaaaaccttttttaaaacttgaaaaattatttcctgaacatggataaatgaaactacatcaaaattaaaaacttctgtgtctcaaagatacaatcaaaagagttaaaaaggcaatcttaaaaatggaagaaaatatttgcaaataatacatctaataaggggtaatggccagaatctataaggaacttctacaatcaacaacaaaaagcatttaacttaatttaaaaagggaaaagatttgaatagacatttatttaaagaagacatacaaatgaccaactagtatatttctatggtctgaatgttcctcctaaattcttatgctgaaatcctaacactgaagtgatggtattagaaggtaggcattttggcagcagattaaaccatgagggcagatccctcattaatgggattagcacccttataaaagagaccccagagagccaactttccttccagcatgtgaggatacctcaagaagacaccatcatttgagccaagaaatgggccctcagtggattcagaatctgcaggggccttgatgttggactttccagcttccagaactgtaagaaataaatttctcttatttgtgaattaccaagttgatggtacttgttatagcagctctaacagactaaggcacatatggaaagatgctcaacctcactaactgttaggggatacaaatcaaaatcacaatgagatatcacttcacatccatcagggtggttagtactttaaaaaacaccccaaataacaagagttggcatgatgtagagaaatggaaagacttgtgccctgtttgtgggaatataaaatgatgtagcatagttgtaatggaaaacagtgtgatgttccttaaaaacttaaaaatagaattactatataatccaaaatttccacttctgggtatatatcccaaacaatttttcaaagcagggtttgaagaaatatttatataccatgtttataaaagctttctttactgtagccaaaaggtagaagtaatccaagtgctcatcaatggatggatgaatagataaataaaatgtagtgtatacatataatggaatattattaagccttatatgcattccattaaacacatcatggaatattattcagctttttacaatggagtattatttttcataatattattcagtaaaatgtggtatatacatataatgaaatgttattcaatcttattctgacacatgctgcaacatggatgaaccttgagtacattatgctaagtgaaataagccagtcacaaaatagcaaatactgtatgattgcacctatatgaagtatctagagtagtcaaattcataaaaacagatagtagaatagtggttgccagaggcttagggatggcaggagctggaaggagtggagagatgttatttaaggagcatagaatttcagttttgcaagatggaaaagtctggagattagttccataatgctgtgaatgcagttaatactactgaactgtataccaaaaaatggttaaggtggtaaattttctgctaactgtactttatcttaattttaaaaataggtaacaagggcaacattattccttggaaaacaatgctaaaatataacttagctaaattcagcccagccaagcagtgattaaaggatgaggtagaggggaatcaacattggagaagggatgtagaccaaaagcagcagatgggcatgggctcgaggaaaagtcatcattcctggtctaggggttggctttcagatttgattattctaggcttcagagttaagaaggacataaccaagtcacaagagtttatatacagaaaggtaaatttttgaaagtacagtattctctgtggataataggtaagtgttaattgcactaagttctttcctagtggattaatatatccagaagatcaataatttccttgttgtgactgtcacaaaaagcaaggaaatacatgatttcaaacaatgcttctcccacattgtttaacttaacagaattaaataacgagaatagtgttaatacgaagaatgaaatagctaaattctagaaaatgtttattgtcagtcacacattgttaacacttacaaattaatcctcatttcacctcatgaggaatacctgcatttttcatatttattgaatgtgtaccagtggccaattccatttagtccctatagatatcagtgtctctgatggttaattttaggtgtaaacttgattgcattaggaatacctagcaattttggtcaagcattattttggggtgtatcccagggtgtttccagaggagattagcatatgtgtcttaatgggctaagtggggaagatccaccttcagtgtgggtgggcaccatgtgatctgctgggaatctagagagaacgaaactgataaaagacagatgcgtggatctatccactgaaaccatgatgcactctttctcccctgtccttcaacaacaagtccaagctccccgatctttggactccagggcttaaaccagaagcccttcggttctcaggactttggcctgggactgagaatttcattatccacttcccttattctgaggccttcagacttgaactgagccacactaccagcatcctagggtctccatatttattatatgtaattattatatatatttattacatctatatacatatatatactgattttgtcttgctggagaaccgtgagtagcacagtgaccaaagcggacagtggtaagttatattattattcctatttacagaagaaaatacagaagtatagggagttattgaattgtggagccactgttggaatgcagaaaatctgactctgaatcctcagctcttacatgctcttgggacatgttttggtcaaaagaaccagaggtgatttctagactgatcaatgcttttccagtagagtcctgcctaaggaataaaaaagtcattctcttcagctgttatgcttcttcactgtaaagtcccatttgcttatgccagatgtgtttcataatgaatatattgagccctattttacttacacatgttctatcctagttttgtctccttgagaatttatctttataaattcaaatacatttgaaaaataatttgttcatcccagtaatatacacaacataatcatggtacaattattcaaacaaataaattaacattgatattatattaccatctaaactttagatttcatccgtttttttcattaacattatttttctgtttcaagaatcaatccaggatcccacactgcatttatttgttttatttctttagtctcctccaatctataacacatgctcagtctttcctagtctttcattatcttgaggcttttaaataaaattgatcagctgttttgtagaatgtccatcaatttggatatgtgtggtattttctcatgataacattgaatttacagatttaagagaagcataccccatcattgccaagatcttggcctgcctgcctatgtgtacaaacatgtatgacctacccaggcacagagacaaaagaagctctttcccctggtcccagagtgcacattcagttcatttgtgcatatacccatgtctaggtgtcttgatggctattgagggagttggtgtggtaccctagtgctattagtgcaggacacagcttgcttaacatggaatcacagcaacccttttaaaaggcataggtggaatttccattcacataaggtttgtgtttgcatgtgtttttgactttttaaagacttaattgtcacaagtttcatgattaactgtcacaggctgctatataacaaaactttagctactcacattcatgcctaatagttctaatatattatttatctaggtttgatatccttgtttcatggaccctgttagagcaaactaaatacagcttgagaaggactccatacttctatatttaagtccttgtggatgaactgcaacctaatttaataggtagacaagattgaaaacctaacttaagaatatgagtctgtatcaatagctgagtcttgaccaatcccagcagccatacctcaaccagtcatacactgctgagtgttcaaactgtgttcaaataaggcaaatgccaagctgtaaccaatctagctgtttttgtagctcacttctgatttctgtacgtcattttactttttttgtctataaatttgttctgactacaaggcaaccctggtgtctttctgaatctgctgtgattctgggggctacccaattcatgaatcgttcgttgctcaattaaactcctttcaatttaatttggctgaagtttttcttttaacaaccttaatcctcaggaagggtttctaattctaaatgtaactacttagtgcaaagtgcaccaactggaaagaaaataaagataattaaagtgtcattgtcttctcaactaagttaaatgaatgaattttgcaaaggtctttgctgcattcgaaattgtgatcttgcaatgtctacattaatcacatctttccttatgggagatacctgcctttatgtcttctgttcaggtgttgtttcattttgttttgtttttaaacgaagtctccattgtgaccagaattcatgagatgtcttggatttcattggccctatgaataatttttcctgcactgtgataacttactgagtcctagggaggaaacagaattttacagctgacactggaataacccttgcccctttcaatactctcagtctgctgtggtatcagggtaacctatgctgaagacactgatgttggccacatctccatgaggaaactctgtgctcttagcaaccactttaatcttctctcctaattgcaatgatctgaacagttgacttagtgctcccactggaattgttccagctcttgagtaccttcttcaagttaatgttgtgagctttagatttttaaacaaatgagagccctgggtcttctgcagtctcttcaagtggaattagaatttggaaacttttgaatagaagcacagatgagtttttgcattcctaccagctctttgggtgcagatctgtgggcagggtgctttccactaaccatggttgtgctgaattggacttccttgggttgtaacccttgtagctcatgaatcacctggcaggaaggagaagcaaagccatgctcaccccttgccctgaggcttcagaaacttggctgtctccagctggtgctgcatagtgattgatccttagccaagtcttcctgtgcaccagggggctctccatgccctttttaggtttactagatgcactttacctggggtgggggtggaggaagtaaagtgaagttcgcagcaggacctgggggcaagggtcagccacctcagtgctcatgcactccattgcactccctgcccaggttcctccagatttgccactcagttccccaatactgtagcatatataacatgtaaattataaacataaaattataaggcccccaaaccacctgaatgaacttcctcctctgacagggtattcttaaaatttaacctgaaagactggttcaggcatgacagttggacatgcttcattggaactctccctggcattaacatcaacacagaacttaagtctcataagaagcttttacaatctattctctctgaagcctgctacctggaagcttcatctgcataaaattttggtctctacaacttattgcaacccaggctttcctttctattaataataactctttcaaccaattaccagtcagaaaaattttaaatctacctataacctggaagcccccatgcttcgacctgtcccacctttctggactgaaccaatgtatttcttaaatgtatttgattaaagtctcatgtctccttaaaatatataaaaccaagctgcaccccaacctcctcgggtatatgttcttgggatctcctgagccaagtgtcacaggcaatggtcactcatatttggctcagaataaatctcttcaaatattttatgaaatttgactcttttcattgacaatagctccaggatataaaaaatatatggctgtagcttactgttccaggacaagatatcagtgtggagccaagtcataaaaaatttgcatccagaaaatataatgaaagtaagttacattaaaaaaacaacagcaaccaaataatggaaggggttatcacatttgaaatgtgttagggaatcacaattgaaaggtgttagggaatcacaaagacagagtcaggtttatcaaaaaatatgcatgtcaccctgctcctatcctggtttcccaacaagtgattgaagaggaaagaaaagataggaacaaacattgtttaatatgtaaatcagagcactctaacccatcaataggagaaaaggaatttaaaattgggtctctaatctgaggtagagatttgagcgatctctgcgaagttgaaaccctgcgttactgtctggggaattcacacctgggcaatttacacacacttactgattaacttcttcagttaacaattttgagcagattacctcagtatgcttcaattctacccaaataggtagcaaacaggtgtcaattgggagtcattatagtctctgaaatctctttacttatggcagtgctctaactcagagtcaaggtggaattgatccaagctcatttgttattcaaagtgagagtgagaattttctcatgatagtaaagtcaagggacagaatctgagaataggaaagaatttctaaaactgacaacttacttgtaagaaagagctaatgtgccttcaaatgagattttttttcctgatttccattggagttctgcacccagattggctggctgtactgattccttatataacagaatacatagagggagggatggaacaggaggcccttggaggctggccaggctggaggtaaggaacacatcctgacccttttttccccacatagccatccattgccaaaaaaagttaaaatgtgcctgaggctgggagtattttctctaagatacaaacattaagaaaaagtgcttattcccatactggggtcagttcctgacaggaaagagcctctttttaactctgaaatgaaatctcctgccagggacacacttctgcataagcagaaaagctgctcctcacagacttggccgctgtcttggtgcattttggtcatcggtggctctcttttcctgtaaatgttttaacagcctcagagtaaaatggagcctattgtggaagactgagtgctggtggcatggggctcaaaggatttaccaagacagttgtaggtaaaggaaggcagaaaatttattaggaaaatatgttgccagagagacaacaggcagccagtggaagagaagctgactgccaggagagaaaggcttgctggagattttataggataaaatctatgctgtctgttgaagagggctttgtgtggtattgataacacaaaggttgcagtgagctaacttgcagatgtctactgatagctgggtacagaaatattatgaatgatttgagcaggaggactgtgtgtcccagactataaagaaaagcaagcttgttttctacctgcttcctctttttgctttctcctgctcccaccagccctactcttttttccgaattaagactccacagaacctgccttttatttcccctttgcaaagctactgttacatcattataaaagggacattccctctttttccagaaatattcctaagaaaagaaaaacagcctgttatataagagtgtctgaaaaaactagaactttcactcaaggtcggctttaatttgcagttttgtattcataaggggaaagtgatgggcaaaccccacaagagaacagaaatcagctgtgtgaataggcactgcaggctaatgaagagtgaagaggagagcacagtgggaatttctagaggaagagaaaggaatctaatgtgatatgggagtgaaaaatgggatccagaaaagcagagaggaaatggggaagtggaccaggtctcagaaccagcaaaggctactatgtatatttcacttagtttaggagactaacttcatatgggagcgtatgctggaattctgagagccagaaaaggaacgtgccaggtgccagaatcagttaataggcattatgtgtcttctgcatttcaatctacatgctgcttcttttctttcaggtattcatacaaaccaacatttcctgactgaatgcaaataggacacttctttgaaatgaggagcgacaaatttttaacctttctagaattcatgacagaatactgttttttttttttttttaacgctgtctccattgaaagtcagttactgaatggtaggacacaattcttatgaattttgtagaaagacaaataatattctcatctacaactgtgtgaagaaaaatagaaaaatacttgccatgtgttaaatccttacactatggagaatactatgcaaactgctttcaactgcctgcgttcatttaagaatcacaacaactatgtaagtatttctaatcctttctatttataagaaactgaggctcagagatattaagtgctttttttcaacatcacacatacatgcaaacagagtgaaatttcaatgttaaattttttattgttatttacaactaatgtgtaagctttgtattgggaatttctgcaataattttaactctcttttgattcctggattatacacaactctctcctgctctctgtatatccttggttcatgttgtattttcggctgattttgaccaatcttttattttattttgtatttttatttattatttacttattttttgaggcagagtctcactctgtcacccaggctggagtgcagtgacgctatctgggctcactgcaagctccgcttccagggttcacgccattctcctgcctcagcctcccaagtagctgggactacagaaacccgccactacgcccggctaatttttttgtatttttagtagagaaggggtttcactgcgttagccaggatggtctcgatctcctgacctcatgatccgcccacctcggcctcccaaaatgctgggattgcaggcgtgagccaccgcgcctgggccctatgttttgttttgttttgttttttattattatactttaagttctgggatacatgtgcagaatgtgcaggtttgttacataggtatacatgggccatggtgatttgctgcacccatcaactcgtcgtctccattaggtatttctcctaatgctatccttcccctagcccccacccccaacaggctccagtgtgtgatgtttcccttcctgcgtccacgtgttctcattgttcaactcctatttatgagtgacaacatgtggtgtttggttttctgttcctgtgttaatttgctgagaatgatggtttccagcttcatccatgtccctgtaaaagacatgaactcatcctttttatggctgcatagtattccatggtgtataggtgccacattttctttatgcagtctatcattgatgggcgtttgggttggttccaagcctttgctattgtgaacagtgttgcaataaacgtatgtgtgcatgtgtctttatagtagaatgatttataatcctttgggtatatacccagtaacgggattgctgggtcaaatggtatttctggttctaggtccttgaggaatccccacactgtcttccacaatgtttgacctaatttacactcccaccaacagtgtaaaagtgttcctatttctccacaccctctccagcatctgttgtttcctgacttttttaatgattgccattctaactggcgtgagattgtatctcactgtggttttgatatgcatttctctactgaccagtgctgatgagcttttttttcatgtgtctgttggctgcataaatgtcttcttttgcgaagtgtgtgttcatatccttcaccccctttttggtgttttttttttttttttttttttttttttgtaaatttgtttaagttccttgtagattctggatattagctctttgtcagatgaatggattgcaacagttttctcccattctgcaggttgcctgttcactctgatgatagtttcttttgctgtgcagaagctctttagtttaattagatcccatttgtcagttttggcctctgttgccattgcttttgatgttttagtcttgaagtctttgtccatgcctatgtcctgaatggtatcgcctaggttttcttctagggtttttttggttttaggtcttacatttaagtctttaatcgatcttgagttaatttttgtacaaggtgtaaagaaggggtccagtttcagttttctgcatatggctagcaagttttcccaacacaatgtattaaatagggaatcctttccccatttattgtttttgtcaggtttgtcaaagatcagatggttgtagatgtgtggtattatttctgaggcctctgttctgttccatggttctatttatctgttttggtaccagtaccatgctgttttggttactgtagccttgaagtatagtttgaagttaggtagtgtggtgcctccagatttgttctttttgcttaggattgtcttgactatatgggctcttttttggttccataagaaatttaaagtagttttttctaattatgtgaacaaagtgaaaggtagcttgatggggatagcatctataaattaccttgggcagtatggccattttcacactattgattcttcctatccatgagcatggaatgtttttccacttgtttgtttcctgtcttattttgttgagcagtggtttgtagttcttgacgaggtcctttccacttgtttgtttcctctcctatttccttgagcagtggtttgtagttctccttgaagaggtccttcacatccattgtaagttgtattcctaggcactttattctctttgtagcaattgtgaatgagagttcagtcatgatttggctctctattattggtgtataggagtgcttgtaatttttgcacattgattttgtatcctgcgactttgctgaagttgcttatcagcttaaggagattttggactgagacaatagggttttctaaatatatactcgtgtcttctgcaaatagagaccatttgacttcctctcttcctatttgaacactctttatttctttctcttgcctgattgccctggacagaacttccaatactatgttgaataggagtgatgagagagagcattcttgtcttgtgccagttttcaaaaggaatgcttccagcttttgcccattccatatgatattgactgtgggtttgtcatgaatagctctcattattttgagatgcattccaccaatacctagtttattgagagtttttagcatgaaggggtgttgaattttatcaaggccttttctgcatctattgagataatcatgtggtttttgtcgttggttctgtttatgtgatggattacgtttattgatttgcatatgttgaaccagccttgcatcccaggaatgaagccgacttggtcttggtggataagctctttgatgtgttgctggatttggtttcccagtattttattgaggatttttgcattgatgttcatcagagatattgacttgacatttctttttttttgatgtgtctctgccagtttttggtattaggatgatgctgacctcataaaatgagttagggaggagcccttctttttctattgtttggcatagtttcagaaggaatggtaccagctcctctttgtacctctggtacaatttggctgtgaatccgtcttgtcctggactttttttgttggtaatctattaattactgcctcaatttcagaagttgttattggtctactcagggattcgacttcttttttttttcaattttttttttattatactttaagttctagggtacatgtgcacaatgtgcaggtttgttacatatgtatacatgtgctatgttggtgtgctgcacccattaactcgccatttacattaagtatatctcctaatgctatccctccccactcccccaaccccacaacaggccccagtatgtgatgttccccttcctgtgtccaagtgttctcgttgttcaattcccacctatgagtgagaacatgcagagtttggttttctgtcctagcgatagtttgctgagaatgatggtttacagcgtcatccatgtccctacaaatgacatgaactcctccttttttatgactgcatagtattccatggtgtatatatgccacattttcttaatccagtctatcattgatggacatttgggttggctctaagtctttgctattgtgaatagtgccacaataaacataagtgtgcatgtgtctttgtaacagcatgatttataatcctttgggtatatacccagtaatgggatggctggttcaaatggtatttctagctctgatcgccatgctgccctccgcaatggttgaactagtttacagccccaccaacagtataaaagtattcctatttctccaaatcctcaccagcacctgttgcttcctgactttttaatgatcgccattctaactggtgtgagatggtatctcattttggttttgatttgcatttctctgatggccagtgatgatgagcattttgtcatgtgtttgttggctgcataaatgtctttttttgagaagcgtctgttcctatcctttgcccactttttgatggggttgtttgatttttttcttgtaaatttgcttaagttctttgtagattcttgatattagccctttgtcagatgggtagattgcaaaaattttctcccattctgtaggttgcctgttcaatctgatggtagtttcttttgctgtgcagaagctctttagtttaattagatcccatttgtcaattttgacttttgttgccattgcttttggtgttgtagtcatgaagtccttgcccatgcctatgtcctgtatggtattgcctaggttttcttctggggtttttatggttttaggtctaacatttaagtctttaattcatcttgaattaatttttgttctgccctctcttaccactcctattcaacataatgttggaagttctggccagggaaatcaggcaggagaaagaaataaagggtattcaattaggaaaagaggaagtcaaatcgtctctgtttgcagaagacatgattgcatatttagaaaacccaaacacttcagcccaaaatctccttaagctgataagcaacttaagcagtctcaggatacaaaatcaatgtgcaaaaatcacaagcattcctgtacaccagtaacagacagagagccaaatcatgagtgaactcccattcacaattgcttcaaagagaataaaatacctaggaatccaacttacaagggatgtgaagcacctcttcaaggagaactgcaaaccactgcttaatgaaataaaagaggatacaaacaaatggaagaacattccatgctcatgggtaggaagaatcaatatcgtgaaaatggccatactgcccaaggtaatttatagattcaatgccatccccatcaagctactgatgactttcttcacataattggaaaaaactactttaaagttcatatggaaccagaaaagagcccgcattgccaagccaatcctaagtcaaaagaacaaagctggaggcatcacgctacctgacttcaaactatacttcaaggctacagtaaccaaaacagcatggtactggtaccaaaatagagatatagaccaatggaacagaacagagccctcagaaataataccacacatctacaaccatctgatctttgacaaacctgacgaaaacaagaaatggagaaaggattccctgtttaataaatggtgctaggaaaactggctagccatatgtagaaagctgaaatgggattcaacttcttcctagtttagtcttgggagggtgtgtgtgtccaggaatttatccatttcttctagattttctagtttatttgcacagaggtgtttatagtattctctgatggtagtttgtatttctgtgggatcagtgatgatatcctctttatcattttttattgtgtctatttgattcttctctcttttcttctttgttagtctggccagcggtctatctattttgttaatctgtccaaaaaaccagctcctggatttactgattctttgaagggtttttcgtgtctctatctccttcagttacactctgatcttagttatttgttgttttctgctagcatttgaatttgtttgctcctgtttctctagttcttttaattgtgatgttagggtgtcgattttagatccttcctgctttctcctgtgggcatttagtgctataaattttcctctaaacactgttttagccgtgtttcagagattctggtacactgtgtctttgttctaattggtttcaaagaacttatgtacttctgccttaatttcattatttatccagtagccattcaggagcaggttgttcagtttccatgtagttgtggggttttgagtgagtttcttaatcccgagttctaacttgattgcattgtggtctgagagactgtttgttttgatttccattcttttgcgtttactgaggagtgttttatttccaattatgtggtcaattttagaataagtgtgacgtgatgctgagaagaatgtgtattctgttaatttggggtggaaagttctgcagatgtctattaggtctgcttggtccagagctgagttcaagtcctgaatatccttgttaattttctgtcttgttgatctgtctaatattgacagtggggtgttaaattctcccactattattgtgtgggagtctaaacctctttgtaggtctctaagaacttgctttatgaatctgggtgctccagtattgggtgcatatatagttagaatagttagctcttcttgttgcattgatccctttaacattatgtaaagcccttctttgtcttctttttctttttgatctttgttggtttaaagtctgttttatcagagaccagaattgcaaccccagctttttttttttttttttttttttttttgctttccatttgcttggtaaatattcctccatccctttattttgagtttatgtgtctttgcatgtgagatgggtctcctgaatacagcacaccgatgggtcttgactctatccaatttgccagtctgtgtcttttaattggggcatttttcccatttacatttaaggttaatattgttatgtgtgcatttgatcctgtcataatgatgctagctggttattttgcccattagttgatgcagtttcttcatagtttcaatggtcttcacaatttgatatgtttttgtagtgactggtactggtttttccttttcatatttagtgcttccttcaggagctcttgtagggcaggcctagtggtgacaaaatctctcagcatttgcttttctgtaatgaattttatttctcctttgcttatgaagcttagattgactgaatatgaaattctgggttgaaaattcttttaagaatgttgaatattgggccccactctttactggcttgtagagtttctgcagagagatgcactgttgatctgatgggcttctctttttgggtaatccgacctttctctctggctgccctcaacattttttccttcatttcagccttggtgaatctgacgattatgtgtattgagtttgcttttctcaaggagtacctttgtggtgttctctgtgtttcctgaatttgaatgttgacctgtcttgccaggttggggaagttctcctgggtaatatcctgaagagtgtttcccaacttggttccattctccccttcacttttaggtacacgaatcaaacgtacgtttggtcttttcacgtagtcccatatttcttagagtctgttcatttcttttcattcttttttctctaatcttgccttcacactttatttcattaagttgatcttcaatctctgatatcgtttcttccacttgattgatttggctattgatacttgtgaccaatctttttttgttttcttaaagcgttgagaaagcgattctttcatccagttttccattttattttatgaaggaagtttgtcaggttttactgacaattaacatagtactaatcaaaattataattattgcaactttatatgttataatttgatattataaaatattaagtatattaacagcttttcaatgcatgaaatcaatctgcagacatatatattttcaaacggataaaccatgcaggtaaaatgaaatgtgatccactttttttttcatgtctaaccttatttctttcctttatcttaaagggaaacctctcacaactatttcttatctattttgtcacagatttcccttctttgattcatgcttccacctactgcaatacggtttatagtgattaattctaccaatgcagctctcactaagatctccactgccatttatttttctgatgtagtggacagttttaatccatatttcccccaagtctattgattcttcttctaaatacatttattttcaagacacacatttatcaccattaagtctttccttcactaatgtacagttttccacccttgcttcctttgtgtctcttatatcccctctctttaaaggtggaaggtcctcagaatcaattttaggttcttttttcctttacttttctttttcctctccacatgactgcctctatttttgggctttccattgccagttatgaaccttcaggcattgtatttcttgaaaattgcaaattcatatatctgactggaaatacacatttgcaattgtatgtttagaagtcaatttattgaggatattgcttcttttatttttatttctggaatgcctaaatccatcctcttctatgagaaattcattgttttttttttcctatctcacattatagcatttaacataactgatatcaattgagaacgattattgtttataagtttctttcctcacaaaaatcaaaggtacatgagaacaggaaatgtatttgttttttcaattttatatcctgaaggcaacatacaacatacaatctggtatagaaaaatctattttgacttataaccaataataggtaactgaatcgtataatctattttttaatcaggttaaataatcaggcttggagtttcattttaaagaataaacaaatacaaggagttttccatagtaaaaatttaatgaaaaaagcaaagtaatatattgactaaatataaagaacatgtattgttatattaaccacaaagtaaaaatacatgatacatgaaaagaagattttaaatagtataaatagttaaataattatttagacaaatagataaacagatccatcagcatgatcatccgtaaggaactagtgcctgtacagctgaacatgatgctgcttaacattcctgaaaacattttaaaattttgattcaactcatgtcatggatatagcaaaaatgagaaatggcagaattcatgaacgtgtgagatgatgtattaatcatggaaatgtttctcatttccatgttgaaccagttttcattccttcctccttaatctttcctgcaagttcgttcataaagagaaggatctcatgatttctgctctgacagcctcccaggaacaagggctatacttcttctttgtcagataaagagtgattctttgaaagtattttctcacagccaggatggagtccacattcctcaggggagtctcttccactccaaccttctacatcacacaggcttccaggtcattcagctgctggtaaagttcagtgtagaatttgtctaaaagggtcgcatcccaagtatcagatgagtcctttgtgctgaagaggttgaaggtctgctgcatcatctcatggaaaaggaagatagcttgaaccttctggaagtggttgccatgaaacacctgatgatggaaaatcaaagtcatgtctgtccttcaagtaagaaaaaggagagattctcctcatttgtgtcaggagtatgaaggccctcctgttacccacgctgtgggcctgaggcagatcacagcccagaggcagatggacttgcagctgagcaccatcatagccatcagtaaactaaagggcaagtccattggggatgtttcagatgctactgggctggctgagagagtgactctgaactctggattttaggttatctgaagaccttattttgtacgtaaccttaaatagggaacacactagtttctattttctgaatgccccctctcttattttctatttctgtttttgttttcctttatgctctctctacagggctgtagagcagtttcttaactacttctttttcattattacctcctcttctccttccccatagtctttttagaaatgtctctgtaattcaaattcccactaatatttaataacatagatatactatatatctgctgatgttctatgcacacatctctatatataagcagtataaagtttaatgtttttattcaatggagggttaagaatgactaaacattttaagctaaaagttaatagttaaatttaaaacccatgaatatttaacttaactccatatctaaattttaaagtgatttttatataatttattcacttatataaattgtaatgtgtcaaattacatgaccaaattaacaagttataaaaacaaataataatacctaatataataaaatacttaaaagtcattcaaacctgctaaagacttaaaatttaaattattttttaacattaactgttagtgcacttaacttttaattttgcttcatggggaaaacttttgacttcagtagctgctagatattcatccagatattgtcaagattgttctcttttcagtgctgagacaattaatgatgtgttgaacaatatcagtataattaaataatataatataaagtatttttaattctcaaagcccacaacacgttcagaattgctaaggatcagacataagcaacatccacgagatggcaaatgacagcacatatgtatgcagtggacacctctcatgatatgacttagtcatctagtaaaccttgaaatgtcctctactcacagcacccatttgccataggtttgcagcactgatcttatataccttttgtgtatcttccatggactcaatgtcaatgcttctcatgtgatacacaagaatactcaattaaaaaatgctaagggataagttttttttcagatagagttgagctttaaagggccacaaaccattgaaataggtaagatttgttcctgctcccaagaattaacttattgttcctttgagagcaatatcatacccaatgagactacacaattgagaaaaaatcagttggattaaaaaaatttgtacattaaaattcaaatttccaaagaacctgcaaaggttccaatactagttgattcttatctaactaaatgaaacaatttttgtcctaaatgttcatgatgggaggtaaatgtgataacatatatgggctgtacaattgttttacatgccatgccagacaccagagatatttgtttctaattttcattttcattgaaaacaaaagttgttacttttgcatcctaaagaatggagacaagaagaaaacaaacgtgtatctaaatgtgattaaaatgttaaaaggaaaaaatatcttaatggaaaaaaataatgatgaaatagaatttacctacattaattccagtcacgatggaaattaaaggaaggggaagagcagaagcaaaattgtggaagagatgtagatcaaagggagcaaatgagcatgggctggaagaatagtaatcattcctggtcaggggtgtgttttcagctttgctgaatccagccttcacagagagtcatgggacacacaccaaccacaagagtttatacataaaaaaggcaaaaatttgagagtacaatatactctctgcataataggtaagtgatgatgtaccaagttctcccttagtgtataaataaactcaagagatcaatatttttcttatcacatctcttacaagaaacaagggaattgataatgtcaaaggacactttctgcaacctagtaaagttcgataataaaaatagtgattaaaaggaaccaaatacctaaattgttgaatgtgtttatttttagtcagacattgttcttagcacttacaaaattgatgctccctttaccaataatgaatactcttatttttcatattaactgaacacctaccatgtgtctacccccattaattcactggagatatcagtgaccaaagaagactgataggttctactgttattcctatttacaaaataaaaaatagaagtataaggaactatcaaattatgaagccattgtttgaacccaaaatctgactgagccctcagttcttacatgctcccaggaatatttctggtcataagaactagagcgatttctagattgatcaatattttcccagtagagtcctgcctaggtaatgacagagtctttctcttcagctgtttactagtcttcttcactgaaattccccatttgatcatgccaacatgttacattacaattaaattgggtcccattttgcttacacattatattctagttttgtttccttgagattatattttatatgcttgaatgtatttgtcaaacacttggttcattgcagtaaatatattcataagcaattgtttgaaaccctacatatttctactcagttattcaaatatccatagtgctttagatttctacctgtttagtgcaatcctaattaagactaagtcatgatcaggatattgaaatgagctaaattagaactaaaccaaggtaaggtgcagagttcagggaaggctcatctggaagggctctctaaggagattaaaggtgtggaaatagaaacacttctggggaaatggggaagtccagtgcattagaggaggaggactgagatgacaaaagattctgaatcacctgacttttcagctggttgatgccttttatgttgtaggtcagctgagtttgctgctgtgttgattgcgctgacttactttgaggaactggtaaacaaaaacattatgctgacacttggtattacggtaaggaagacttaatttaggactcttgcaacagatgccaaaactatcacaataggggagagagatcaatctgaactcaattctgaatataacaaagacagccttggatttgtagccaacaagcagaatgagaaagtctatggatagaaaatcactaagaaaatccttgctaaatcaacttaacagaatttttgccaaagtaaagccagggcagtcagatatctagggtacaggaattctcataaaactgacttaggaagattcttgctacatctggaccaggcagaactaagagtggactccaagacatggtctattcaaaaagagagctcagaggagcctgactaacatttggtgaagaagagagcctttcagaaccctaaagggataaagagtaagagacagaactatcttctaaacacttaaaatggcatatgaaattttacatcttttatggaaaaatgggaatttaatgatgatttcaattaatgaaatacactagtaaaaatttaaatcatctgtataagaattttggactttttaacttttattttgaaacaattttagatatgcagagttgtaaatgtagtacagagagtcctctattcccttcactcacttctcctaaggttaacagcttacatagccatggcacaactatcaaaactaagaaatcaagattggtgtactaaccctaattaaacttcagacttcactcagatttcctcaattttttattgatgtctttttcctattcaaggaatctctccaggatcccatattgcatttcattgtcatttctctttattcttctctaatctgccatacacgctcagtctttcctgactttcatgaccttgaaactttttaaagaatattagtcaattatttttgtagaatgcccatcaatttggatgtgagtgcattttctcattattatattaaaattatagatgtaaaagatgaatacaatagagtgaatcttgtcacatcaagtgatataggagatatatatcaatatgttgccttattactgctgatattaaacttattcacttggtaaagtttggatatgcctgttttctccaatacaaagttgctatttttcctttccatactctttatattggtaacacgtcactaatgtgagcttacactcaaaaggagggaaattaagctccaccccatggaaagagaagtatcaaagactttgttgacatgtgttaaagcttcacagtaatttaaaaatcttttggagggagatacattgaggatatgcagttatcctcattctcttcaaggctttgcttattgattttatgattcaacagtagatcttgcctgttgcaattatatttatgatgttctgactatgatattctattttcctcgttccttgtacatttattatttgaaatgcttttgaaagatggagttggcctcccttcccaataaatgtatttatttactcattacttatattagtataaactcatggatatttattccattctttatgtgataataaaatactatcattatctattgtgttactctagttgtcccagctttggctattggaagctcattaaggctggcttctgtgtccttttgacatgtacctatacattttgtttttgcatacttcttcatcttctggcaccacaagatactccagtatccttgtatttccatgacacagaccaagaatcagtcatttctccaagatgtattaatgccttttattggagattggtattttagaagacaagatctgagagctacatgtgcttagcagtactaggatgtcactgcttttaggtcctctcagtgacagagataggaatataagtagtacatatacgtatactaattttttatatacacatacctatatttatttctgtccacacctatatctaagtaaagactaaagcaaacatgagactatacaaatatctttgattctaatccagcacaataaggttaattctagcctttccattttcattatttgaaacttctttttccaactctgagatacttggtttttgttagtaacaatatttttacctatttactcaagtctaataatacacataatgtttcggaactactaactagaatttctgtgagaaacaattctaccaactagcatacagtgtttgtgtacaacccttttgtgtttcaccttaaagtatctagtcaccacatggctagacagagtatttgtcactttcagagtggttatgtcatacatcaattacattaatttgtcatcatctagattcaatcctggtatctactgccaatgtggttgagtttttaaaaatttacatacagtaaaattcacaccttttggtgcatagttccacaggttttaacaaatggacagaattatagttcatttatttttac

SEQ ID NO: 149 - DNA, 31412 bp, Homo sapiens
ccttgaaaatttgcactgactatattaaaaagttttagtagatgtgcattcatattcagaaaattcttatttttctgtatctgcttaacattctttcactgatggatatatcagtgccttaaaaggcagccattctattactttatatattttaaacattttatttatttggaagaaatacgcactccctataatttgtacttataacattttttatttttgattattatgggcacataatagttgtatatgtttatgagatacatgtgatgttttgatacagtcatacaatgtgtaatgatcaaatcagggtaattgggacatccatcacttcaagcctttattattttttgtgttaggaacatttcagttctacttgtttagttatttattgcttttgcatcaacctaataaaaatatacaataaattattaactgtagtcaccctattttgctaccaaatattcattctatctgtatttttgtacccattaaccagcctcactttatcccctgctctctgctacctttcctagcctctagcaactatcattccactctttatagtccataaattcaacaatttttgtcttccacatgtaagtgagaatacgtgatatttgtctttctgtgcctggcttatttcacttaacattgcccttcagtttcatccgtgttgttgcagatgacaggatttcattcttttttaatggctaaataatgttctgttgtgtatatgcatagaattttcttctcattcatctgttgatggacacttaggttgctttcgtagcttggctattgtgaatagtgctgcaataaacatgggaacgcagatatctctttgatatacagattttctttcttttggatatatgtccagcagtggtattgctggatcatgtggtagttctatttttagttttttaggaactccaaactattcttcatagtggttgtactaatttatgttctcaccggcagtgtatgaggattctcctttctccacatcctcatcagcattattgcctgtcttttggataaaagccattttaactggagtgagattgtatctcattataattttgattgtatttatctgatgattagtaagtattttttcatatacctgtttgccatttttatgttgatatgattaggctttgtgtccccacccaaatctcaattgaattgtaatccccatactctccacaatccccacgtatcaaggaatagaccaggtagaggtaattacatcatgggagcagcttcccccatgctgttctcattatagtgagtgagttctcatgagatctgatggttttataagtatttcatagttcctcctgtgttcattatcctccctgccaccctttgtagaaggtgccttccttccccttccccttccgccatgattgcaagttccctgaggcctcctcagccatgctgaactgtgagtcaattaaacccctttcctttataaattactcagtcttgggcagttctttatagcagtgtgaaaacgggctaataacatatgttgtcttttgagaaaagttctattcagatcttttgcccatttaaaaataagatctttttttccctattgagttgtttgacaactttgtatattctggttattaatcccttgtcagagggtactttgaaaatattttctctcattctgtgggttgtctcttcactgtgttgattgtttcctttgctgtgcagaagatttttttagcttgatgtgatgcctttgcccattttttgctttggttacctgtgcttttgaggtcctactcaagaaatctgcccagaccaatgtcctggagtgtttctccagtgttttcttctagtattttcatagtttcatgtgttagatgtaagtctttaatccattttgattttattttcgtatatggtgagaggtaggggtctagtttcattcttctgcctatggatatccagttttcccagaatcatttattgaagagactgtcctttccccaatgtatgttcttggcacccttgtaaaaaacgagttgactgtaaatgtgtgaatttatttctggagtctctattctgttgcattggtctatatttctgtttttatgccagtacaatgctgttttgactattatggctttgtaatataatttcaagtctggtaatgtgatgcctcctgttttgttctttttgctcaggatggctttggctattctgggtcttttgtggtttcatataaattttaggatcattctttctgtgaagaatgtcattagtattttgataggcattatgtttaatctatagaacctttgggtagtttggacattttaacaatatttttccaaatccgtttttttgtgtattctcttcaatttctttcatcagtgtcttataatttcaattgtagagatctttcacttctttggttaagttaattcccagacattttatttcacttgtagctattttaaatgggattacttttttttggtttctttttcagattgtgcactgttgccatgtaggaatgctactgtttttttgtatcttgattttgtatccctgcaacattactggatatgtttatcggttccagtagtttttggagtctttaggttttctaaatataagatcatataatctataaacaaggaaaaacttgatttctttctttctatttaggatgtcctttatttctttctcttgtctaattgctgtagctaggacttccagtactgccttgaatacaagtggtgaaaggatcctgtctttttctagatattagaggaaaggctttcagtttttccccatttattatgatactagctgtgggtttgttgtatgtggcttttaaactattgaagtatgtttcttctgtacccagttttttagtttttatagtgaaaggattttgaattattgaatgcattttggcatcaattgaaatggccgtatgatttttctcttcattctgttgacaccatcaggtactaggcttttgtttgatgggagacatttcatcagtgcatccatcttgctatgtgttattgacctactcaggttttgaatttctccatggtttaatcttggtatgttgcaagtaatgtatctgtttcttctgttttacagtgtattggcactttgtctcctaatagtctctaatgattctttgattttctgtggtatcccttgtaatgtctcctttttcatctctgattttatttatttaggtcttctttcttttttctttgtctgatttaagatttgtctatattttcatcttttcaaaaataaacttcatttcattgaccttttgtattttttattattgatttaatttctgctctgatctttattattttatttcttctactaattttgggtttggtttgctcttctctttgtgttctttaagatgtgccattaggttgtttatttgaagcttttctatttttttaatgtaaggatttattactgtaaacttccctcttagtactgcttttgctgtattctttaggttttgatctgtttgtctccattttcgtttgtttctggaaattttaaaattttcttctgaatttcttcattgaccgaagtggtttttttagaagcatttccatgagtttgtatagttttcaaagttcctcctgctattgatttctagttttattctgttgtggtcagatgagatacttgatacttgatatgattttaattgttttgaatttttgagacatgttttgtgtcctaatgaattgtctatcttggagagcattctatgtgctgaggagaagaatgtgtattgtgcagctattagatgaaatggtctgtaaatgtctatttggtctgtagtgcagattaaggtctgatctgatgtttctttgttgattttctgtctggatgatctgtccaatcctaaaaatgtgctgttgaagtcccaagatattattgttttggggtcttctctctttttagatctaataatgtttgcattatatttttggtgctccagtggtacatatagatttacaattgttctatcatcttgctgaagagactcctttatcattatgtaataaccttgtctctttttgcagtttttttctcttgaaacctatttatgtgatacaagtatagctactccttcttgctttttttttgtttgtttgttgccattggcatggaatatcttttttcatccctttattttaggtctgtgtgtctttatgggtgaagtgtttcttctaggcagcatgtagtggggtcttattttttatccattcttctatgtcttttgtttggagaatttagtccgtttacattcaatattattattgattcgtaagaacttattactgccattttgttgtttgttttctggtcattttgttggtctttcttttttccttctgaattcctttgtataaaagtgatttttttttctggtagtatattttaatttcttgctttttattttttgtatatctgttttaggtttttgttttgtggttaccatgaggtttgcaaataaaatcttataaccagttattttaagctgatgacaaattaattttgattacaaggaaaagaaaaaaaacaaaacaaataagcaaataaaaaactaaaaaagctctatacattctttttggctttggactttttattgtctatatttatatctttttatacagtctacctgaaaaagttgtggtagtttttagttttgattggtttgttttttagtttttctactacagatatgagtgctttatgtatttcagttatagtattaagcgtattctctgtatgtttgtatatttactattgccagtgagttttatacctttagatgatttcctgttgtttgttaatatcctcttgtttcacattgaagaactccctttaacatttcttataagacagacatgttgttgatgaaatcctttggtttttatttttctgagaaagtatttctcctttatgtttgaaggataattttgctggatatatataactttctaggttggatgttttctttccttcagcactttgaaaatgtcatctcgctctcctggactgcaagtttcctactgagaagtctgctgccagatatgtcagggattctttataagttgtgtgcctcttttctctgctgcttttggatctgttccttatccttgacctttgagagtctgaatattatataccttgaagtaggtatatactcaaataagtatttgagtatatttgaggtatctgttggtgttttataacctcgtatctggatatttatatctttctacaagtttggaaagttctcagttattatttctttgaataaactttctagctcaatctttatttctacatactaattaaggccagtaactctttaggataacttttcatcttctttataaaccagaggttgtaaattttgatgaattaccacttattattattttaaaaaatgtctgtactttttgtattctatctaaaagacctttgccaagctcaaggtcacatttttctcatgcgttttctaggagatgttttataattttggcttttgtcctcagatatttgtgatccatttgagtgaattttcatatattgtgcgaagtaagggctgagatttttataaaaataggctgcgtccagtggctcacacctataatcccagatgctcaggagcctgaggtagggagactgctggagcccaagagttcaaggctacagtgaactatgattgtgccactgcactacagcctgtcatttagagacaggcaaaaccctgtgcctgaatgaatgaatgaatgaatgaataaatatccaattgttccagctttttccattgaattaccatggtatctgtgtagaaaaatcaattggccatatatgtgtgagccgatttttgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtctatattcataagagatattagagtatgtatttttcttgtaatatctttatatggttttgtaatctggctaatgttaaatgatttaaagcatgtttcatcttttttaagagtttatgtagaattgatattatttctgtcttaaatggttgatagaatttgatcagggaaactatctgttccaggactttgtgagaatgattttaattatgtatgtattttctttactagatatagagatatccaggttcaaattgtaacaaatgacagggttttctccctttttaaggtcaaataagattacactgtgtatatacagttgtccctcagtatatatgggggattgattccaggaccccataccaaagccagtgcagtcggcctggggaatccatatgtaggaaaaattggccctctctgtataggaaaagttggctccccctaaacacaagttttgcatcctgcaaatatggtattttctatttgcatttggttgaaagaatctatatataagtgagcccgcacgtaagtggactcataaagttcaaacccatgttattcaagcatcatcaatatgccacatgtttttcatctattcactccattggatggacacttaggttgatgagcccttaggttgattccatatcttggctattgagactaatgttacaatgaacatggaaatgcagatatctttttgacatgctgatttcatattctttagatgtatacccaatagtgaaattgctgggccatacggtagttctacttttaatttttaggaggcttcatattgttttccataatgggcgtacttcttcccaccaacagggtacaaggattcccttttctccacattcttgccaacacttgttatcttttgtctttctgataataacgattctaacagatgtgaaatgatatatcattttggttttaatttgcatttttctgatggtgagtaatgttgaacattttttcatatacctgttgggcatttgtgtatcttcttttgagaaatgtccactcatgtcctttgcccatgttttagtttggttatttgttttcttgctgttaagttctttgagttccttatatattttcatattaaccctttaacagatatatcatttgcaagtgtattttcccatttcataggttatatcttcagtttgttgattatctccttgctatgcagaagcttgtttgatgtaatatcatttgtctacttttgcttttgttacctgtgcttttggcatcatatccaataaatctttacccaatgaatgtcattaacttctcgactatgtttttttctagtagttttaccatttcgtgtcttatctttaagtctttaatccatttttagttgatttttatatatgatgtgaaatgagggtctaattttattcttctgcatgtggatatccagttttcctagaatcattaattgaagagactgtctttttcctgttatgtgtttaggcatcttcatcaaaagttaattgactataaatgtgtgaatttattttcaggtcccctgttctgtttcactggtcttgtgttagtaccatgcctgtacaatgttgttttcattactacagttttgtagtagattttgcaatcaactaatgggaggcctctggatttgttctttttgcttaaggttgccttagctctttggggctttttgtggtttcatactgattttaggatttttaaaaaattttttgtgaaaaatgtcattgagagtgtggtagggattgctctgaatctgtagatcactgtgggaagtatggatattataacaatattaatttttccagtctgtgaatgtgggatctttccatttatttgtgtctttttcaatttatttcatcaatgttttatagttttcattgtacagatctttcacctcattggttacatttatttatttatttcaagtattttcagtttttttaatgagcaataaaagaaaatgtttcggctgggtgcagtggctcctgtaatcccagcactttggaggccaagatgggcggatcacaaggtcaagagatcgagaccttccaggccaacatggtgaaaccccatctctactaaaaatacaaaaattagctggcgtagtggcacgtgcctttagtcccagctacttgggaggctgaggcaggagaatagcttgaacttgggcggtgggggttgcagtgagctgagattgcaccactgcacttcagcctggcgacagagcaagatttcatctaaaaaaaaaaattcaatagttaagcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagatcaccactctattttggatctcactgagtttctgtttaccttacaagtaatcagggtaattcattatgaaatatagtatttcacttaaaatactacggaagcaaaaactactataaaagtaaaaaataaaaatgactcaaatataacaagagttcttcattaggccatgatggagtaatttggaaagcatttcctgccataaacaactcaaaaaccagaaaaaatatatgaaaaatgcttcacagatgttggataacaagcagaagtaaaatatttatttctctttaaagaaagagaaatatttatttcgcactaaaaagtttatttctttctctttacttcctacatcttgtgtcatggccagggtattgcctacaagcagtatgctctggcaatcatagagcctacacttgtttctgtttcttttagagtcatagtcctatgctgtcacaggatcacagtgtaatgctgcttggtatctagtatccataaagcattttttattttgtttttttttttttctggtttctgagttgtttgtggcaggaagtgttttctaaattactccatcatggcctaatgaagaattcttggtatatttgagtaatttttgctatttacttttgcagtattatcctgagttagttcatgtattcatgcatctgttttcaccactgtcttttctcattaatgacctacttttgaaccagtggtttacttttttataaattgagaatatgataaagcacactaccaaattgaaaaaaaattcacgcatatgcaaataacaacagaggataagaacatatgttttctgaggtgatctatatgttgttatcttgcatgtttattgagaccagttggttccttagagcatatatacatttccaaatgcaaaacataagaagaatataatgagaatgtgactcaaattaatcttgcttttcaaatttgtctcctgtgtgggaagacaattgtttccttttaatttttcacctgaaactactataccacttatgaattccttgcctgaactgctagtgactgaacctagagaaacattgaggtagtacaagaatgcacattttggtgttagacctgtgtcttcgctcttacaattccaaagtttttttaaaaaagtttatcaagtagttaagtgaaatactgtatttcataatgaattatgccgattactggtagctgatcactagtagtgaacattatatttttaaaataaactttttattttgagataaatgtagttacaggtatataattgtaagaaataatgaaagtgattctgtataccctttacacagttttctctcatagaaacatcttgcacaaatgtgtaacatcctaagtctagatactgacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccctttaaccacacatacctcctttctaccctggctcctcacaaccaccagtttgttctccattttataattttgtgattccaagaatgttttatatatggatcatttacatttaaggtaattttgatatattagtgactaagtctgctgttttattatttgttttctgtttttttccttttcttgtgcctctttttctctttacttgcttcctgtgggttatgtgaataatttttaggattcctttttgatgcacttgtatagtgttcttaatagtatctctttgtaaaattttgatagtatcttctgtataattttcttagtggttggtctgtgtgttaaaatatatatatttgacttatcacagtctactggcaccagtaatttaccacctcaggtgagatgtggaaaccttgctttcatttacgtcactttagctttacttttctcacttttaaatatcattatcttgagtatcggatggtgttataatttttttccatcatcatatattatttataaacattcatgagaaggataatctgttgtttgtattcatgtttctgctctatttgttgtcctgacttctttttttttttttttaattatactttaagttttagggtacatgtgcacattgtgcaggttagttacatatgtatacatgtgccatgctggtgcgctgcacccacttttctgatgctccaagcttccttcctttatctttctgtttgaagaagttcttttaaccattatttaaagagagacctgctaatgacaaattctttttttttttttaatttaagaattttttccctcttaattcctgaaggatagtttcactggaggtagaattcatactttacagttctttttctctccagcatttgaaaacagttgtgctacttcttttggacctccatggtttcagatgagaagtccattattattaaaattattgtttttctaggtaatttgtcatttcactctggctgctttcaaggtttttttccttgtctttagtttttagaagtttaattatgaggtgtcttggcatggatatctttgggtttaacctatttaagatttacttagtttcttgaatctgtaagtttatgtcttttacaaaatttggaagtatttggccatcatttcttttttttttattatactttaaattttagagtacatgtgcacaatgtgcaggtttgttacatatgtatacatgtgccatgttggtgtgctgtacccattaactcgtcatttaacattagttatatctcctaatgctatccctcccccctcccctcacccacaacagtccctggtgtgtgatgttccccttcctgtgtctatgtgttctcatcgttcaattcccacctatgagtttaaaaactctgtaagccccatttctttttcttctccttttgggattatggtgctacaaatgttggatcatttgttattgtcctaagggtctctgagactctgttcactgttttctctatttttcatattggataaattttatttatttttatttttaattttttgtttatttttataattttaacttttattttagattcagggggtgaatctcaatgcaggtttgttatgtggctgtattgcatgatgctgaggtttggagtatgattgatcttgtcacacaggtgtactgagctcagtacccaatagttattcaccccttgccccactccctctctcttgataaattttattgttctgtcctcaagtttaacaattctttcctttgtcatttccactccggttttgagcctatcccgttagtttttatttgttattgtagttttttttaaacttttttttttttgctgagatatttttgtttgtttcaagataatttgtaatagtagtgaggttgcagagaaaaaggaatgcttatacactgttggtgggagtgtaagttagttcaaccattgtggaagacactgtggtatttctcaaagacctaaagatggaaataccattcaactcagcaatcccattactaggtatatatccaaagaaatatattaataaattattctattataaagacacatgcacatgtatgttcattgccagcactattcacaatagcaaagaatcaatctaaatgcccatcaatgatagactgaataaagaaaatgtcgtacatatacaccgtggaatattatgcagccacgaaaaagaaagagataatgtcttttgcagggacatggttggagctgcaggccattatccttcacagattaacacaggaacagaaaaccaaatactgcgtgttctcacttataagtgggagctaaatgatgagaacacatggacacatagagggaaaaaatgcacactggggcctattggaggtgaattgtggaaggagggagaggatcaggaaagtaactaatgggtactaggcttaatacttgggtgatgaaataatctatacaacaaacccccgtgacatagatttaccaatgtaacaaacctgcacttgtaccccaaaacttataataaaagttaaaaatagttatagttacatgttggagtatttttatcatggctactttaaaattctttttagataattttaacatctgatccattcatctcagtgttagtattacttgattgtctcttctcattcaagtcgtgatttttcttgttgtcggtatgacagggagtttttgatcatatctttacattttgggtttcatagtgggagtctctgggttctattttaaatcttttatcttagcaggtagtcacctagtttgggttttgcattcaggtcttgtggtgagatctctctttgcagtcttaggccttgtggggaaggggagtgctttccctgcatatttactgtaagtagtatttggcaggtcccttttgctagggctgccagggtcatctggttttgtccattggactcgtgttcagtttggctaaggaataagcctacccaagtaaccttttgttctaaggatgggggttgagaagtgctgggcctcagtaaccttcttctgttgggtgagtgagtgtcatgagacacacattctccagtccctagccagtctgccttcgtctttacactttagattttttctttggttgtctcttacacagtttctaaggtctgtggggggagcagggaaaaatcagtctacactatcttgttccacttattaacttttaaacttttgatgtgttattcaatttttctagctttgaatttcctaatttgtaaagaagagatagcaataatataaccctccaaagattattattaaatgagataatgagatagttactgagaactgtgctctattagagaatgatgctgctgttgattgcaaggttgtttattgcaccattgtttctaagggcaaattgaaacccaaatgagtaacaaagtagagttatttaaataaattgtatattatcaacacaatgaaatttagctcttaaaaaagtaataaatgggacacagaatgatgccccaaatgtcttgttaagtgaaacagtagttgcaacatagtatttttagtacaaatatgtacacacacacacacacacacacacacacacacatatatataaacatatctatctaaaaaacatgtacatgtgttttatgtatacgaaaatattcagaactgtagtttgaaaatagtctgtatgtaacaaattgtgaaatgtacctctaggtagtgggctgggggaaagggtaacttttacattttatacctcttaattcaatattttttggtaaggatcaagtttatctttattaaaaggaaatgaataaaactatgaaaatcttttagttcaaatatatatatatatatatagttaagtggttaaagaatattaatcaaattatttctgataagttgtcttttacttcattttttggaaattacctccaaaatgtaatgcctgttagttacatatgagttccgcaaagtttcttaacatagattaagtaccagtggcttggatgacttttttggatatttctattttttatgatcattgtagaatcattttctttactaccttagaattttgtaaatgcaaagaatttttaagcattatcattttctattagttgatttgggtattttcaatgagctgactaggatgccacattttaggtggctggttagaggaatgatggagatgtgatctatatgcatatttaaaaacaaatgacagatttttatatagctgctttttataataaattttctaaggccaagaaattgtgggcttttcgtatgcatttcttaaaagcatcccttgcatatgattggtgtttttattagtgaaactgcattgggaaatgaatctattgtagatacagcaagcagagtgggattttaatatcggaaattagttacaaaagtgttagaaggactagagataccaaagggaagggatcacccagaaatccagaagtgctacatacctaggctggagcctatgatcacatttgccactgagcaactaaacataccagttttgctactgagcagggaatacctattaagccagcactgccattacttactgtaattgccttcctgttcctgctgctagaggcaaaatcagaatctttcctcttgccctttaatctcatactagtactcccattggtggaacctaatgtaacacaattgtcaagcgagtcttggaaattttattgtttaggttttcatcctctgcaatacaaaggactttataaaaaggaaagtggggcttataaccaacaaataaaggaccagcacagtactaaaaatgtgttcaattaattttagatttctaagggtagggatcatatcattttatctttataatgtcagtgactaactgtcacatagtaggctctcaaaatatttgttaaaaatttttttcagagctatttatgtaatataagaataaagttttcctttttctcttgcaaacacataaaatgttctttttagtatttcagagtttaacttcatctatggaaagaccagtgttactcaacttcaaacccagcacctaacctggcacatacttaataagtgtttcttgattaaattaatattagatatacaatgtttactcataaaaatatgtcattagaattaacttgttggtattttggtgatatattagttatatttaaaaatactacttgaaatttataatgtattttatttctgttacagcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggtgagtacacaaaataacacattttctatgttgccattattattgtaaatgattgactttaaaatggtttctgacatagaaatacttactttatatgcattcattgtaaatgctgatatcgtcttaatttcagatgagtaattttgtttaccagtatgacttcgatatcatctgttcagggatttgttcttctttgcactcatattttattgtcatctgtaaattttaaaaagcatttatttagtttcatcatctaacttcctgtgaaatacagagcttgtggcatttaggtaaattttcaccttttgttgttataaacaatgctacactgcacttcttgcactgatcttttcatgtacatatttaagagttgctctagggtgcatacttaaaagtgagatttttgtatctgagagtatttatatcctcaactttattacatgttgccgaagtgcttttcaagtcactgtggtaatgtgtatatacttccaccaacagggtatgtgtccctgatccttcatgttctcaccaacacttgaaaattgtgagaatttttacttttgccaaggtgatgggtgtgaatagtattttaatgtgcattttcctgattagtattgtaaacatcttcttatgtgttgatttcctattgtttcctgtttagtgaattgcctactcatatccataatattctctttatgtttgaaatattattaattaatttttcatttattggtttttttggttatagaagttttaaaataaaatttttgttctaatttttctttgtaaaatctgggaaatgacttttttttcttttaagacagtatacattcttttaaacttctagcattaagttactttatgtgatcaaaggaaatacacaggtttccatcaaatcatgatttgttctaccctcttcactttcatacatatatcctaatttctactttttaaaaaaatatagaattataacaccttttttcttttggtaattttgataattcttatttttagtctaataaaatgtagttttattctttatatttttatattcatttttattttgtataactcataaatagcatcttctgtacatttaatatttgtaaatttttctctgacattttgctatgttagcaagtggaattgtggtatagtgatgaaggtactatcagtctgttacacattttaaacatgtatttaatttaatttaatttatttatttgagacggagttttactcttattgcccaggctggagtgcagtggcacgatctcagctcactgccacctccacctcccacgttcaagcgattctcctgcctcagcatcctgagtagctgggattacatgcacacaccaccatgcccggctaattttttatttttagtacagatggggtttcactatgttggtaagcctggtcttgaactcctgacctcaggtgatccacccaccttgacctcccaaagtgctgggattataggtgtgagcaactgtgcctggccctaaaaatattttttcaatgctgtgtcataccaaaagggaagaataacttctgtatgaaggaggcagtatagttcacagtaataataatgggtatagcaatgctcaggtaagaagaatcttaatgaaagtgaatggataagagagcagaattggatattatttgtgtaaagtcaaaatgagagattcagttgttgctcactacttgaataaaattttgttaaattttccatgattttctacctgaaaactttacatagtgaaagttttgcctagatgaatattattgtcagccctggcaattttagtatgtgcacaaatggcactggatatttatatgtaaaacaatttactaaaataatttgtaaattattttaaacacctcattacaaatatgttgtagatgtatgatgctttaatattttaatgggtcttaaatttctttaaacacacaaagttatcagtgagcactaattgattttttcattatccttaaaatttgtagtattctttaagcttagatcttttttagcatatttgtcaagtttgctattatatatggattatgtcagtggtccccaacctttttggcaccagggactggttttgtggagacagtttttccatggacccagggaggggagatggttttggaatgattgaagtgcattatatttattgtgcactttatttctattatttttattacattataatatataatgaaacaattatacaactcaccataatgtagaataagtgagaatcctgggcttgttttcctgcaactagatggtcccattctgggggtgatgggagacagtgacaccgaaagtgttttgcctatgttcagtctactccataatctcattttggttgctgtcactgcagaaaactctgctccacgaagacaggatgctggaaatagaagcaggctttttggtgcttttgtggcaatctcaggatattctgccttgactttaactcacaatgtatagtgatttgaagttgtcttaaacatacttttaaggctactgtcatttgcgatctcatgcagttgatcctcttctagcatggacaaagtcgattcacctggcttactcgcaaatgggtcgcgtatccattccttcccagtttggggtctttttgaagttgggaagtaatgctgaaattcttttgtaagctgtaatagttgttcatgcaccagctgggagaaagatggtgctgggagaaaaaaatctcttctaatgtttgaaacatgtcagaaattcgagagtttacttgtcgcccccataattccagtttggcattgaatgcagccactttacctgccaacttgaatgcagttgttattctctcctgaagtgacagaatgagtttcttgagcaggttgaatatgtcacacaagtaagcaagttttgcaacccattctgtgtcactgaaatgtgctgccagtggtgactgtttttctaaaagaaatctctgcagtagcccttgtaagttgaaaactctgaccagtgacccacctttagaaagccacctcacttctgtgtataagagaagacatgcggccgggtacagtggctcacgcctgtaatcccaacattttgggaggccaaggtgggcagatcacgaggtcaggagttcgagaccagcctggccaatatggtgaaaccccatctctactaaaaatacaaaaattagctgggcatggtgatgtgcgcctgtagtcccaggtactcgggaggctgaggcagaagtgcttgaacccaggaggcggaggttgcagtgagctgagatcgcgccactgcactccagtctgggtgacagagtgagactccatctcaaaaaaaaaaaaaaaaaagaaaaagggatgacgtgtgtgctttgcacccatctcctcacagagctgtgtgaacagatgtgagttgagggcatgtactttaatgtggttgataattttcatcacatcttgctaaatattgttaagttcaggtgacatttttcgcctagccagcatttctctattgatgacacagtgagtagactcacattcagaagcaacctctttgacccaagcagtaaaaccagaaagctgcctagtcatggcagatactccatttgtgcgtatattgacaaaaaatgaccaattcagttttcctgatatgtaatcattcaaagatttgaatacttctgcagctgttgtgttggttgtcaacaaaagttcacataatagtctgggcatggtggctcatgcctgtgatgccagcactttgtgaggcagaggcaggtggattgcttgaacttaggagtttgagacaagcctggctaacatggtgaaaccccatctctactaaaaatacaaaagttagccaggcatgatggcacacacctgtagtcccagctacttgttggtctgaggtggaaggattgcttgaacctgggaagtggaggctgtggtgagccgagatcgtgccactgtcctccaggctgggtgacagattgagaccctgtctcaaaaaaacaaaaaagagagagagagagaaatgtgcacataacatatcctcgtgcacagcctcctgaaaaatatattgcacaaaaacaaacgttttattgtcaacatcagttgactcatcaacctggattgcttaccaaggtgacttattaattctctctaacaattgtgcctcagtatcctctgctatttcatcaattcctctagttatggtgctagctgaaagaggaacacatgtcaccttttgaactgcagtctctcctaaaagactacaaatgtcttcagcaataggcaggatcaactcttcatcaatagtaaagggcttctatggtttagcaatgctgttagctactaagaatgatgctcttagtacagacccatttgatgaagtggtggctttcaataattgcttcggctcttcgtgttcactttttttcttttgaaaaactccaaaggcttgttttttaatgcagggtgcttggtctccttgtggtgaagcagttttgaaggtttcatggtttcattggatggctggttgcaacgtattgtacaaagtggacttggagaatgtgaatcacctgttgtaatgaacccgtaatttaagtaagactcttagtattttctttgaaatgcagctttctttttgttggcagtctaagagtcttctgctatctcatcattcccccttttcaaagaagctctccagtgatgtttgttttttactcagtttggctaaggtttgtttgtgggcttaccaaaactgtaactgaaacaagtgtgcagtgtgggaaagaggtgtggacagaaatggtaaataaaataatggggggggggggcggggtcaggcagtgcccgcatggactaaaataagtattagattctgccttcaagcttgctaccagatgcgactgtaaaattgaagtacatcatctcacttgccactataaagcctgctaccagatgcagcttaattatcacttgccactcactcactgatagggttttgatatgagtctgcaagcaattgatttattgtggtccctgtgcactcaaacctctctgctaacattaatctgtatttgcagccactcccaagccctatcatcatcacctcagctccacctcagatcatcaagcattagattctcatagggacatgcaacctagatccctaacatgtgcagtttacaatagggtttgcactcctatgataatctaatgttgccactcatctgacaggaggtggagctcaggcagtaatgcgagtgatggagaatggctgtaaagacagatgaagctgtgtttcctcacttgctactcacctcctgctctgctgcctggttcctaacagggtgttgagaaccctgggattatattgtataggatgtcaccattatgtgtccattatgtatcagtattatgtatccactgtatagactgatatttattttttaccacctcagaactggtttcggtttttagtagatatggttacatagatagggcactttgttgagatactaggaaatgtgttttgaggacttattctttttcagtggtgaaatgaattcttttggactgttacttcccctgagaaaaattaggaattttatttgcctaaagcatgagagaactatcaaaaccatgagaatttgtcagagatttaggagaggtacaatgtcaagggatacaagacaggcattttgtgtaattttaaccttgagacagttagaaatcctggaaacctcctgagacactgagcagtccttttgtcagccattacagaggaacaaaattagatatccagatgtgccaaggaagaggagccttggtacatacttaaggatttagtctggccc

SEQ ID NO: 150 - DNA, 780 bp, Homo sapiens
actactttactctatgcttgcaggggttttttttaaatgaaagaattaatccttatatcttatataagttgcaaatatatattattctatttcttatatggaatattttattgtttggatatattttatgttgtcaaaaatttctccctcttttccttgatggtttctggatgttataactgagcctgtgaaagccttcctcactccacatttataaaaggaagatcttctttattttcttttaatacatttttatttttacatttaattcttcattctggaatttattttgtacacataatgtgaggtggaagccatttgctttctcaggtatccagttgtaccaaaactgtttattttatagaccgtcttttctgcactcatttaaaatgcttattataaactaaagtctcggaatttctctggagtctatgagttcagaaatataggaagtttaatttttctttttctttcttttagttctctacatggaaatgacatttctgttgtgcctgaaggtgctttcaatgatctttctgcattatcacatctgtgagtacctagtttatgaatataggtttagggtcaaacacttcctaatgagtgacttggaacattcctctgccagttattttactgtaacatcataagatgtaattggtttcatctttaaagaaaatgtgaagattttcaaactggatatgatgccttctgcaagatggctttaattttcccttctggctcttattttccagtagtcgaattatctttgcttagcta

SEQ ID NO: 151 - DNA, 1090 bp, Homo sapiens
tctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaatag

SEQ ID NO: 152 - DNA, 1410 bp, Homo sapiens
aactggtggaaatacatctagaaataccctctgttttctagaatagtgccacttaagagcagtggctggatgaatttccaacagtgagtaaaaataagccataagctcagcacttaatttgtgttactttatatgacttgattgcatgcatgtaggtgaattgacctcacttctggctttcattttggctcttactgatgtttttcctttgccccaatttcctcaattgtttattttaacctgtagtacctcagaagtaccttttgtaaaaggtattgcacaaagagatgcacaggaaacttcacaggatatcagaaggaaatattaagatgtttatttatatttggatttttatctcattctcttacattttctgtttgtgagtttatttttataattcacaccaaatatatattttatagaaatgtactaatttttacattttaattaattaatttagttgattaaaggtaaaggattttaaaagtttggagaccactcatataaaaaccagacaaatatatagaaaaaggaaggaggggaaaagtacatgtgtgatagataggtcccttgacttggagagcattccacatttaaagcaaaaaacatatatacatatattttaatgggttctttcaagccactattaaattttataattactttaacccagttttaccataactaaatataaacaattaaaatggcttgaccacttaatgaaacttagtaataggttcagtttttaaaaattcagatggcttattatttttacccttctgtattgtttgaattttttgtcaaatgtatgtgctgtgtgtatacatattttaagcataagattgtaaagagatagcaaaaaagaagggggagaattttaaaagattacatcatgcaattaatttctatgggatttttaaaaatcacatacagtgttttattcatttaattttcgctttgcattaagctaattagtcaagttaagcacaactacaactgaatggattctctctctgcattacaacattctgaactctttgctttttcagccactttggagagagactagttgtgaaccaatgttacataatgtgatgggatatgatataatgatgtgatgatatgatgctgattccattgcaggcatgatcacacggctccgccaccctgtgtcaacaaaggccaacaaggtccccgactctgtgtccctgggaaatggtatggatacatacttgggttcttaaactccattttccatcattttttatttaaatatatggttaatttactggcaaaaaaaaaaaaaaaggaggaaagacaggaaggaggcctctgttcagattgtatcaggaaggattttctttaaaaaaaaaaaaaatctgtcctctcaacctaaatctgtaagcttct

SEQ ID NO: 153 - DNA, 1728 bp, Homo sapiens
ggggaaagaaaagattaaaaaaaaaaagtcggatagtggagattcagcaaatacgggaaaaggaaaaaaacaaaaaccaaaaaaccaccaaatgcaggcacgatcgctgtttcaagaaaagtaaggaaaggtaccgcgcaccgggctggcaactggtgcgcgcagcctcccgcccccgcgctgcgctggacaagccggctgtggaggttccaagctccggggcccacttcctttcttattttgtgggtttccttggctctgctgggaccaggaggaagggaagaaagagaggggaaaaagccgtaaaaattaaaacaaaaatgcaggggggcagcctgaggcgagctggtgaagcggcgtgtctgtgtcccttcggctgcggtctcctcctgcccgccgtcatccccagtcggcagctgcgagcgccgagagcagcgcgagcgctgtgaagatgcgaggaggtggaacaatgaatttatagcggcatgccatcctgcaatggcaatttcaacagttcgtcactgcacgctgcctcttaaagggagagcttcccccaccactcccacccttcccagtccgcgcctaatcagatgggggagggcaaaagaggagggtgatcgaggaaagggagacgaagtaggaggaagggactgggacccggcgaggtggtaggaggggagaggggaaaataaaaagtaatggggcaagaaaaacagatttccttggccacttttaaagccacagcggctccgggtctgtctgatatttcacaaccaattggggttggctaaccttggcttacctcatctcctgaacgggtgttttggttaaagttattgagacgtttcaagtctctccctgcctccttcttgcctgcttttctcgccctcggtgggaagttcctgccgcaagtttttcccctttgcacacccgtgcgctctggcctcgcagaccgtgcaactccatccaccagccagagcttttcagcttcccgtgcgtcccctaaccaccgcgttcccttcgcttcctcccctccgtcccggcacccggtttcctccctccccattctccagcctcttgatgctttgacgctcgccggattcgggctccgggtgactaacttctcccggccaccagcagagcggctggacagccagagagcccagggcgcttcctggcgcgctgcggtaccccggggcgagaacgcccgccgcttgggaactccgcagctttgtgtgcgaacggcgggctcccagctttctccagcacgcctttcgtcagggtccacaatctgtcccttactcccagcccactggaacttcctttgctctaaaaaggcagagcgagaaagagttaactcttagagggaattccgctcattttttttccctgaaagattttaaaattttgcgctcatacttttattttttgcttaaatgatactttaataataaattcctatatctgtttttgtctcttctaaagcaaccacttatcgccataggccttgacctaccttcattctcagaaattccttttagaagaaaaagaatacttttggcggaaggaagattggtgcttattagtacgcgggtgacattatcactgctactcgtttcctctgacctctttgtttcctctaattatcattctaagaagggagaaggaaaacccgacgacttatggttagaaggtctaccttctactgtaggggtaagagctccctcc

SEQ ID NO: 154 - DNA, 1831 bp, Homo sapiens
gttgtcctctctacctataaataccttcaaggtaacggcggaaagtgaagggcaggaatgaggcgccctccccagggagatggtggggaggccgggcccaggcaaccggggcggggccggggcgccaggcctggttgcaggcgctgccctcgggggcctggggattcccagggggctcctccgtgggctggcagtcttggtgggggtccctacccaggcccggaggaagcacctgcggttgtccactgggtgggcactgcccgcggggaacgggcgggaccgcaacttcggagcactttggcagcgtggggagggggctcctacccggacgccccccaggggtcgcagaggtgggggctgcgccgcgcgggcccactcctcgggggtccagggtccgggggatgagccctccgcccgtgcaccccggggcaggagaccccgcgggacgcgccgaggtaggggggacacctgccccaagacccccgcccctccccccacctgcacggccccgcccccggccaggccccgcccctgaaggccccgcccccgcccccgccccggggggtcccgcctggcccggcccggcccggggcctcccccgccccgctacggctccgccccacccgcgggctccccaggccgggccgggcctcaccggggaggcggcgccgccggccaggtgccggggctcggagctcccctccttggtgcggccgtcgctgccgctaccgccgctgccgctcccggtgccggtgccgcggcctccgcagccgccgccgcctccaccgctcgggggacattgtccctttaaatcgctccccccgccgccccgcccccccggcgcgccgccgtgacctcagcgcgacagccccgccgcgccgccatgatggggaggtccggggcgccccccccaccccacccccccccccctcgccgccccggggggggcggccagcgggcgcgccgccatgttgggagtggccaagcgggtcacccttaaagggcccgcacggcctgagtccagggagaggccccgttaccatgacaacacccttgtcgtcccacaccccaatggctccttatcgtcccactggtacttccaatggtaggctcgctaaaagcactaaaagagtggggagggtgcagagaagttcccccatgggtcattgatgggtcattgataggtcattgaagactccacccagccaatttttagccttttgtcccctgccccccatcagctaccttccaaccacaagctcactccctccttcccaatcatccacactggacttcagcacctccatgtccctagagttgccctaggtcttcagtcctaagtcaccttctccacccagttcccaggatcacagcttccaggactaccccatcagacacacatcatggcctgttgtcttgtcttatccaccatgtatccagatatctaaccacctagctatctcatccacttcctcaatctatcaatcactcatctacctatccaatgaactaatcacctatccacccacccctccaaccacctattaattcacccaaacacccactcaacccacccattcacttcccatctacccacccattcatccagcacccaagtaaatactcatttatccatacaaccaagcaagtacccaaccatccccacacacatctttccgcccagccccccaaacatccatccaccagtttgtctgttgatttggtccctccactaacatgtaagttccatgaggccaggagtcctgtctagttcattattgtttctccactgcccagttctcaggcgtctcaggagacctcaacatatgta

SEQ ID NO: 155 - DNA, 2597 bp, Homo sapiens
atcaataactcctcccctttatacagatcctgcactgcctcagtttacccatattgacacatgcacactcagccacctggtcttcttccatcaatcttaccatttctccagacgcctcccttcattcacacacagctgcactttccccagtcctgccctcacatccatgcacacgcacatcctactgccatgccttcgtttcctcggcaagaatcccagccacttgtacactctgatcctatacaccgtcaggagtctcccatcattacccctttacttttctccattgggttgtcccataccaatgatccctgcacttttcccacactccaacccttcccccacacaggaccttagggttctccagcattaaccccttcacccccctccacacacacagcctcaagtgaccccagcattaaccctttcgcttctccccaacattatccctcatgcatacccagcttgggctcctccattccccccaccccccaaccaagattgctctagtcctcgggcgaaagaaaacgatagggctcctggtccagaaatgaggaccctggggagcgggggttgtcctctctacctataaataccttcaaggtaacggcggaaagtgaagggcaggaatgaggcgccctccccagggagatggtggggaggccgggcccaggcaaccggggcggggccggggcgccaggcctggttgcaggcgctgccctcgggggcctggggattcccagggggctcctccgtgggctggcagtcttggtgggggtccctacccaggcccggaggaagcacctgcggttgtccactgggtgggcactgcccgcggggaacgggcgggaccgcaacttcggagcactttggcagcgtggggagggggctcctacccggacgccccccaggggtcgcagaggtgggggctgcgccgcgcgggcccactcctcgggggtccagggtccgggggatgagccctccgcccgtgcaccccggggcaggagaccccgcgggacgcgccgaggtaggggggacacctgccccaagacccccgcccctccccccacctgcacggccccgcccccggccaggccccgcccctgaaggccccgcccccgcccccgccccggggggtcccgcctggcccggcccggcccggggcctcccccgccccgctacggctccgccccacccgcgggctccccaggccgggccgggcctcaccggggaggcggcgccgccggccaggtgccggggctcggagctcccctccttggtgcggccgtcgctgccgctaccgccgctgccgctcccggtgccggtgccgcggcctccgcagccgccgccgcctccaccgctcgggggacattgtccctttaaatcgctccccccgccgccccgcccccccggcgcgccgccgtgacctcagcgcgacagccccgccgcgccgccatgatggggaggtccggggcgccccccccaccccacccccccccccctcgccgccccggggggggcggccagcgggcgcgccgccatgttgggagtggccaagcgggtcacccttaaagggcccgcacggcctgagtccagggagaggccccgttaccatgacaacacccttgtcgtcccacaccccaatggctccttatcgtcccactggtacttccaatggtaggctcgctaaaagcactaaaagagtggggagggtgcagagaagttcccccatgggtcattgatgggtcattgataggtcattgaagactccacccagccaatttttagccttttgtcccctgccccccatcagctaccttccaaccacaagctcactccctccttcccaatcatccacactggacttcagcacctccatgtccctagagttgccctaggtcttcagtcctaagtcaccttctccacccagttcccaggatcacagcttccaggactaccccatcagacacacatcatggcctgttgtcttgtcttatccaccatgtatccagatatctaaccacctagctatctcatccacttcctcaatctatcaatcactcatctacctatccaatgaactaatcacctatccacccacccctccaaccacctattaattcacccaaacacccactcaacccacccattcacttcccatctacccacccattcatccagcacccaagtaaatactcatttatccatacaaccaagcaagtacccaaccatccccacacacatctttccgcccagccccccaaacatccatccaccagtttgtctgttgatttggtccctccactaacatgtaagttccatgaggccaggagtcctgtctagttcattattgtttctccactgcccagttctcaggcgtctcaggagacctcaacatatgtacatatgatatatataatcacaacattgaaaaaaattttttcttactatgaaccaggccttttctaggcagacatacccaacctggttaaccaactacccagctactcacctaccaggtcaaacatccagcaaatgctaacctatccgtctgccgtttgctccacccactctacccctcacccatccactcaccc

SEQ ID NO: 156 - DNA, 2902 bp, Homo sapiens
atccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgttt

SEQ ID NO: 157 - DNA, 3696 bp, Homo sapiens
aagaggttttttttcccctattaacatcaatgtaattcctgtgtgtgtgtgagagatctcagaaagggagagagagtgccaaggtcttgctctgtcacccaggatggagtgcagtggcacgatctcagctcactgcaacctctgcctcctgggctcaagtgatcctcccaactcagccgcctgtgtagctgggactacaggcatatgcctaattaatttttatatttttagtagagacaaggttttgccatattgtccaggctggtctcgaactcctagactcaagtaatctgcccacctcggcctcccaaggtgctgggattacaggcatgagccaccacacccagcctggttcctccccttttaaaccatataaagtaacttctgggtttgccatggcatttgtaaactgtcatggtgccagtgagagtgtcttttagcatgctagtgcattataattaatgtataacaagcactgagagcaactagaggttttgcagtttctttacggcatcctcagaaaacaagtcctgctgacctcataccttaggaatgccatctctgcatttccaaaggcgtcagtgtagtcttttgtaggctgcagtcttttgtaggcaagggataggcagatgctcctaaactataaatgcctgtgcgcgtattaaaaacagatacttctttggtgagactactgaaaaaacagtgctctttgatctggactattgtagaccttctcttacctaatacactccacctggggagatacattccttcatctgttttttgttaaaggcttttaataacttttagtaaaactacccaatatatgcatggaagaaacctgcaatttcacccctaaatacataaaaataaattttttaaaaaagttattgaggccaggtgtggtagctcatgcctgtaattgtagcactttgggaggccaagacaggagaattgcttgagcccaggagcttgagagcagcttgggcaacatgatgagacccccgtctctacaaaaaaaaaaaaaaaaaaaaaattagccaggcatggtggcacgtgtctgtggtcctagctactcaggaggctaaggtgggaggatcacttgagcccaggaggtcaaggctgcagtgagctgtgatcatgtcactgcattccagcttgagtgaaagagcaagacccccatctcaaaaacaaaacaaaaaacttttggtaatgaactataaacgaccctaataggaaaaacacattaagtcattaccagcttgtaacaccattctgtgacttcattgacacgttattatgtatttgtcacttagctttctaatgaccctgcacaattttgttggcagaacaggtggagaggtatgaagaacgaggaacactgcccggggagtttcttcctctgcaaaataagggagtgtgtactgaattaccgtttccagctccaacatccaggatttcagcactacctgcagagtagtgggaggagagataggtaagaagttaaaaagagacctgatggaatacgtggcatcctggtactgctggggtccatccccacacctcatgctcatgagagggagacaagcttcttggagctcctcctcatctacagggctctcctcacagggcctggaagttctgccccagccctgtggggattttctagagtcatttgcctctctttaaagccttggcagagggagccggtgtggggaaggggtggtaacgtagatggcaatgcttgtcagaacatattagagccctcttccacgctctgcagcccctgggcctagggctagcattattctccccttttatagccatctgttgatttcaccttatctcgcactaagcaatgggcttcttgtgggcaggtgctctctctcacccatcttatttctctctggctctttcacggggcctgctgcatggtaagcgctcagtgttcagtgagtgaatggacaggaaggggcagggaagtgaatcaaatctcctcaggttgagacatcagcaccatctgtgatcctttcctcatttggaccttcacatgcaattaggctctaaaatccagtgagtttttttttttttctttttgacggagtcttgctgttgcccaggttggagtgcagtggcgtgatcccagctcactgcaacttccacctcccaagttcaagtgattctcctgcctcagcctcccgaggagctgtgattacaggcgcccaccaccatgcctggctcctttttatagttttagtagagatggggtttcgtcatgttgcccaggatggtctcgatctcctgacctcaggtgatctgcctgcctcagcctcccaaagtgctgggattacaggcgtgagccactgcgcccggtcctaaaatctggtgatttttatttccctgtgtctgtttctacggctgcctccctaagttctttctctgttgggtagtgggcttcggcctagctttctcatcaccgccacacccttccttacccatcctgtacagacagatagatttttctaatgtacattttcagcatatctctgggctgctcagaccatttcctcaactcgacacccaaattaatcagctcactcttccatgttttaccatcctatccgtccttctaataaatacatcctgagcttctggggaggaggtctcatctcagattctctgcccaagccagatggtttcaacatagtcctgcctctgagcccttatgcaagccatctccctgcctgtcccaactacttgcttctatccagagcttggtaagcccacttctcccagagaagcctcctggggtcatcccaggccacttcgaattttctctttggtagcacttggtcacagcaaccttgggcaccaagctgagtatagaatggagtccaatcaatgttgatatgatttttaaatggtggcgacagtcatgtgccatctgaagcaggaatagggaaagagaagcagtgactagcctatacaaattagccaggcgtggtggcaggcgcctgtaatcccagctactcaggaggctgaggcaggagaatcgcttgaacctgggaggtggcggttgcagtgaggcgagattgagccactgcactccagcctgggtgacacagcaagactccatctcagaaaaaaaaaccactctgggaggccaaggcaggtggatcacgaggtcagtagttcaagaccaacctggccaacatggtgaaaccccgtcgctactaaaaatacaaaaattagccgggcacggtggcgggcgcctgtaatcccagctactcgggaagctgaggcagagaattgcatgaacccgggaggcggaggccgcaatgagctgagatcacgtcactgcactctagcctaggcagcagagccagactccgactgaaaaaaaaagagtctacagagcctttcttggaaactagtgtggaaagagaagagcagcatgaaaagccgaggccctgacagcctgatgtcccgctccctccttcacagctctgtgcccagggcctgcctgatgtgcagtgctgcagagaatccagcacactctgctcatgtatgtgcccgggcatgttttctttcttggctacctctttagtcatttgttatgtgttatgaagaaataaactcccagcaaaataatgtcttttgcacagtcttaaagtgatccattacctaagatcatca

SEQ ID NO: 158 - DNA, 4050 bp, Homo sapiens
aaaattgctgctgatcactttccttgaaagtatgggtaaatcaaacactttatagaaagtaaataggagtatttaaatgacaaatgattaaacaatggaaaaagatatcctctaagatgtcttgttctgcttctagttatttatttgatagcagcaagaactgattacatacattttgttctgttaaataaaccattaaattgctgcaatttccaaagggtcactttagcagaattgggtcatttgtgggacagcatgtgattactttcaagccagctcgaaatgacaaatgaggatttgtggatccaaaaatggttttactagtgactcatgatacaactctaggcaagttacttctgctaatacagatacttttatttttaaaatttaggaatagttcttcagcagttaaaaatatgagtataaagctcctctcagattcttaacattttcacaatttcatgggtccattttactgacattttgatattttaataaaggaatagattatcctcggtttttctgaatcttccatttattcatatattttgcattttgcttcagaaaaaaattagtgaatatatttagttattataaatggtgaatatatattagtattacatattgtatatatattttaatatattttttacatatatagtgtgtgtatatatacactatatatataatgagaataagatcaagttcatgaaatgtaaattacgacccatagtacaaactatacatataagtagccatttaacattggtaaaaattcaacgtctctcccatttacttaacattcattaaacaaatatttattgaggacctactgtgtgaccatgactcagccaggggcaggagcacagacgtttttattgatgacattttgaatgtaattaatcaggggttctttcagtgatcaaatttgagtctgtgtatcagtgaacatatgtatcaatgagggtaaagtatgtgtatctgataggacttttgaagataagggtttatttcccaccggcaaaattttgtctatcgcaagtcacctccaaggaagctccctgtaaaatatcaaaagccttatggagatgggcgcagagggataagggcaaataaactctgctctgaagctgctgctttgaagtgaaccaaccccttgcacgtacactacattggctaaagcaatgcatatatatataatcactcctaatttcaaaacagtgaggtgtaaataatcatgaataacattgcaatctactccagtgggtcgttcactgttttattgttttcagataacagctgaatgctaacaatactgctatgactataagaagacccttctccttctaagaatcactaatattttcatttctgtggttaatagtgtactccatttctttttctcttttagagacttaagtaacaacagaataagcacgctttctaatcagagcttcagcaacatgacccagctcctcaccttgtgagtgtgaaagtgtggtactgagtattcattaattcaatggacaaaaggcagtctctagatgctggacattgctattgaacaagacagtctctaccctcaaggaatgtttctattgggagaaacagacaaaaccacgatacgtgaacaatgtagacattaggaaaagtattgcgttctattaaaaaaaacaaagaataatttgtgtttgtggggggcttaggggagatccctaagatagggaaaatccaccttagggaagggacggctgacgcaccaaagttgggcaggagtaggcagcgggaagcattctaggttgtatttaggaaataagtatgttgtgttagggagacaacacacaaaaaataacaatatattgtgtgttaacactatcagttaataagatgctttaataagccttaactgctttatttttggaagtatttggccatttttggatttctgaataaaacaaattgacatatgtatgctttcagaattcttagttacaaccgtctgagatgtattcctcctcgcacctttgatggattaaagtctcttcgattactgtaagcatcttgtgttcaacagaatatctcttttctcagagatctgagtttggggttgtctttttaaggatgtaactgctttgttgattcttggtgcttgaagatacatgcattaggatttattataaattaggaaatagaaaaatcatttcttacagtatcattgtccaacagctttgctttggacaatataacttcctttttagtaatactgattgttgttatagtcatttatttgattatatgtaacattaagacatatggtttatagagtttcaattaactttgaaagaaactttcaaaattgagaaactttcaaaattaatttctttagaaattacatagtatatgaaaacatttttactgtgaaatgtcctttaaaatatgtgaaataaaacatgatccttgatcctactctcctgcctcagaatttacagtttgatgtgctctctggtcctttttcagatgcatttttttctattctaatagatgtaggcccatggctatatagcttttaaaagccacagatattaataggatctgtttttgttctgccattgtctatttttgtttaacatatgcttttgaatatttcaagtctatcatatatatgaataaaaatatatatataagaatggaatagatatatatttatacatatatataactcaactgtttaactggtagagactgttgtattggtgggaggaaccagaactgattcaatcatcttcatctttactgtgatttggtttaatttcaaattttaatgagtactatacagtactctaatgaacatcctatacattcctcttggtgcaaatgtgctggcatttcagcaagaatttagggtgtgtgggaaggtactgtcaagtatattggaaggattccaaaagtaactgtcttgttattccccagacaagactttgtccatttagaagttaatttttccaccaactatttaagagtacctttttcaaaacactcttgcaaacactgaatattatttattcttttatttttgtccatatgacagattcaaagttattctgcgttcctgtcttaatttgcacttccaattagtagagcatttgaatatattttatttgtttactaagcactcgtgctttttattctaatgagcttgatctatcatttccccattttctgttgggtactttatattttccttattaatgtagatatctttatgcatatactactttactctatgcttgcaggggttttttttaaatgaaagaattaatccttatatcttatataagttgcaaatatatattattctatttcttatatggaatattttattgtttggatatattttatgttgtcaaaaatttctccctcttttccttgatggtttctggatgttataactgagcctgtgaaagccttcctcactccacatttataaaaggaagatcttctttattttcttttaatacatttttatttttacatttaattcttcattctggaatttattttgtacacataatgtgaggtggaagccatttgctttctcaggtatccagttgtaccaaaactgtttattttatagaccgtcttttctgcactcatttaaaatgcttattataaactaaagtctcggaatttctctggagtctatgagttcagaaatataggaagtttaatttttctttttctttcttttagttctctacatggaaatgacatttctgttgtgcctgaaggtgctttcaatgatctttctgcattatcacatctgtgagtacctagtttatgaatataggtttagggtcaaacacttcctaatgagtgacttggaacattcctctgccagttattttactgtaacatcataagatgtaattggtttcatctttaaagaaaatgtgaagattttcaaactggatatgatgccttctgcaagatggctttaattttcccttctggctcttattttccagtagtcgaattatctttgcttagcta

SEQ ID NO: 159 - DNA, 4297 bp, Homo sapiens
ctagaagatgctgtgtatttataaatatccgagcatcatgagttgtaaaggtggccagagcaggtcaaggatctgtgaggatgcagcagggtggttaagagtgagggctgtcaagccatgttactccctggctaggtgacgttgggcaacttatgtcaccgctcagggtctcagtttccccatctctgacacgggataataataatgaaggctattccacagggttctttggagaatgacagaagatgatcttgcaaaagccttggcacggaggaagcccttgatgaggtgtttggagatgggggtggggggtgtgatacatcagcccactgttttccaggcataccagcctcctaccaggtccttggacacgtcaggctcctccccaccacagggcctttgcactggctgttccctccacccagaatgcccgtcccaccattcactccatgctccattcaaatgccactctatcagggagggtctcccaggtctcccaggcatgatcctggcactctgtttaatgccttcacagcatctgtcactacctgtccttctgatatttgtttagttgcttgttgtccatttcccctactagagtgtcagccccttgagggcaggaattcttgcctctttggtttacagctgtcttcccagtgcctagcacataccctggcacaccgaaggtgctcagtatttaatgaatgaataacacgtctggaggtggggagagtgtgagatacctttttgctgggtaaaccaaggggtagccagcatcgctgactacccagcctctccctagccactacagaagctgttttggcccgtggttcaggaacaggatacacccagacagccagagggagctgggatagactgatgggagtggggaatacctgtggaataagtgggctgggggcagggagtctggggtgctgagatgggcctctggacccaattagtatgctcagaggaggaagccaggctgacctgagttcaagtcccagctccataccacccagtggggagccttggtctggtcactggctcccaggacacctgttttcacaactgtcaaataagaaactaaacagagtacaaagaaaaggctctggacccaagcggaatcagcatcccagctcagccgctgctgcgctgggtgacttgactctctctgagccttggggaatgggctggatgctccctgggggccacacggcccattctcttaccagagatgccacctctgccatccagaatgtctcgggggccctccttggtgacaggcaggtaacgggtggaccggaagatgccaccttccccctcagcagcttcggccccaccctcgatgttctcccttggcgccgggccaggcagtctctctgggccttggggacgatctggtgcagccaggctgcctgccagagacccctccatcggattttctctgcttggatccactcagctgctgcaccggctcagcggggcattgtgggcctggggatagagagaaggaagtgcttaggggatggaggaaagggaatctgcctcagtttcccatccctcaaaacctcagtcctcaactttgcagctcactgcctcagtttacctcccagcccaggggagctaatggtgttcagaccttttccacacaccttctatcccaatggcccctaccctcagcatgcctccgtctccccatcaataactcctcccctttatacagatcctgcactgcctcagtttacccatattgacacatgcacactcagccacctggtcttcttccatcaatcttaccatttctccagacgcctcccttcattcacacacagctgcactttccccagtcctgccctcacatccatgcacacgcacatcctactgccatgccttcgtttcctcggcaagaatcccagccacttgtacactctgatcctatacaccgtcaggagtctcccatcattacccctttacttttctccattgggttgtcccataccaatgatccctgcacttttcccacactccaacccttcccccacacaggaccttagggttctccagcattaaccccttcacccccctccacacacacagcctcaagtgaccccagcattaaccctttcgcttctccccaacattatccctcatgcatacccagcttgggctcctccattccccccaccccccaaccaagattgctctagtcctcgggcgaaagaaaacgatagggctcctggtccagaaatgaggaccctggggagcgggggttgtcctctctacctataaataccttcaaggtaacggcggaaagtgaagggcaggaatgaggcgccctccccagggagatggtggggaggccgggcccaggcaaccggggcggggccggggcgccaggcctggttgcaggcgctgccctcgggggcctggggattcccagggggctcctccgtgggctggcagtcttggtgggggtccctacccaggcccggaggaagcacctgcggttgtccactgggtgggcactgcccgcggggaacgggcgggaccgcaacttcggagcactttggcagcgtggggagggggctcctacccggacgccccccaggggtcgcagaggtgggggctgcgccgcgcgggcccactcctcgggggtccagggtccgggggatgagccctccgcccgtgcaccccggggcaggagaccccgcgggacgcgccgaggtaggggggacacctgccccaagacccccgcccctccccccacctgcacggccccgcccccggccaggccccgcccctgaaggccccgcccccgcccccgccccggggggtcccgcctggcccggcccggcccggggcctcccccgccccgctacggctccgccccacccgcgggctccccaggccgggccgggcctcaccggggaggcggcgccgccggccaggtgccggggctcggagctcccctccttggtgcggccgtcgctgccgctaccgccgctgccgctcccggtgccggtgccgcggcctccgcagccgccgccgcctccaccgctcgggggacattgtccctttaaatcgctccccccgccgccccgcccccccggcgcgccgccgtgacctcagcgcgacagccccgccgcgccgccatgatggggaggtccggggcgccccccccaccccacccccccccccctcgccgccccggggggggcggccagcgggcgcgccgccatgttgggagtggccaagcgggtcacccttaaagggcccgcacggcctgagtccagggagaggccccgttaccatgacaacacccttgtcgtcccacaccccaatggctccttatcgtcccactggtacttccaatggtaggctcgctaaaagcactaaaagagtggggagggtgcagagaagttcccccatgggtcattgatgggtcattgataggtcattgaagactccacccagccaatttttagccttttgtcccctgccccccatcagctaccttccaaccacaagctcactccctccttcccaatcatccacactggacttcagcacctccatgtccctagagttgccctaggtcttcagtcctaagtcaccttctccacccagttcccaggatcacagcttccaggactaccccatcagacacacatcatggcctgttgtcttgtcttatccaccatgtatccagatatctaaccacctagctatctcatccacttcctcaatctatcaatcactcatctacctatccaatgaactaatcacctatccacccacccctccaaccacctattaattcacccaaacacccactcaacccacccattcacttcccatctacccacccattcatccagcacccaagtaaatactcatttatccatacaaccaagcaagtacccaaccatccccacacacatctttccgcccagccccccaaacatccatccaccagtttgtctgttgatttggtccctccactaacatgtaagttccatgaggccaggagtcctgtctagttcattattgtttctccactgcccagttctcaggcgtctcaggagacctcaacatatgtacatatgatatatataatcacaacattgaaaaaaattttttcttactatgaaccaggccttttctaggcagacatacccaacctggttaaccaactacccagctactcacctaccaggtcaaacatccagcaaatgctaacctatccgtctgccgtttgctccacccactctacccctcacccatccactcaccc

SEQ ID NO: 160 - DNA, 4520 bp, Homo sapiens
ttatactaattcagtcttaggtttgcctcattgaatttgcctaagtaggaaagtttaactagctgaaaagaataaaactgcattcaatttctctaaaagcattcacataataatggttataggaggccaggcgcggtggcttacgcctgtaatcccagcactttgggaggccaaggtgggcggatcatgaggtcaggagatcgagatcttcctggctaacatggtgaaacctcatctctactaaaaatacaaaaattagccaggcgtggtggcaggcacctgtagtcccagttacttgggaggctgagacagaagaatggcgtgaacccgggaggtggagcttgcagtgagccgagatctcaccactgcactccagcctgggtgataaagcaagactccatctcaaaaaaaaaaaaaaaattgttataggaaccaaaaattcattcataataagttcctaaagcagacactgaagtacagttttttctacttaacagtatcttcctcagtatcttagaagtatgccggaatggtggaactttaaaatgaaaatatgcagctgggatcatttatttcgtgatttgaaagctacagggcccacattaccatgggtctgtgaaatcatcaatgaaggtccacaaaagtggttcaaaaagcatatagaaattattccttagctatgacaaagcctgagtaagcttaaaaaaaaaaaaaaaaaaagcctatattcgctgggcatggtggctcatgcctgtaatcccagcactttgggagaccaagccgggtggatcacctgaggtcaggagttcaagaccagcctggccaacatggaaaaacgctttctctactaaaaaaaacaaaaattaggcagcatggtggcatgcgcctgtaatccagctactcgggaggttgaggtgcaagaatcacttgaacccaggaggcggaggttgcagtgagccaagattgcaccactgcactccagcctgggtgacagagtaaaactccatctcaaaaaaaaaaaaaaaaacaacctatattttaaatgtttttatattaaagtgggaaaataattattcaacatttgtaatatgtaattgtaatatgtagtttagtatacaaatttttcaaaacatattgtctgtaaaagaaacctaaaaaataaaacaagttcttggtgaagaagccagttgatctggtttggttctgtgtccccacccaaatttcatcttgtagctcccataattcccacgtgttgtgggagggagacagtgggagatgactgaactatgggggcaggtctttcccctgttgttctcgtaatagtgaatgggtctcacagatctgatggctttaaaaatgggagttgccctgcacgagctctttttgcctgccaccatccatgtgagatgtgacttgtccctccttgccttctgccgtgattgtgaggcctccccagccacgtggaactgtgaatccaattaaacctctttttttttttaaattgcccagtctcaggtatgtctttatcagcagcacaaaaacagactaatatagcaaattggtaccagtagagtggggtgctgctgaaaagatacccaaaaatgtggaaccaactttggagctgggtaacaggcagaggctggaacagtttggagggctcagaagaagacagaaaaatgtgggaaagtttggaactcactggacacttgttgaatggctttgacaaaaatgctgatagtgatatggacaatgaaatccaggctgaggtggtctcagaaggagatgaggaacttgttgagaactggagcaaaggtgactcttgttatgttttagcaaagagactggcaacattttgcccctgccctaaagacttatggaactttgaacttgagagagatgatctagggtatctggcagaagaaatttctaagcagcaaagcattcaagaggtgacttgggtgctattagaagcattcagttttaaaagggaaatatagaataaaagtttggaaaatttgcagcctgacaatgcagtagaaaagaaaatcccactttctgagcagaaattcaatccagctgcagaaatttgcataattaacaaggagctgaatgttaatccccaagacaatggggaaaatgtctccagggcacgtcagatgtcttctcggcagcccctcccatcataggcctggaggcctaggaggaaaagatggtttcatgggccaaacccagggctcccgtgctctgtgcagcctaaggacttggtaccctgcattccaaccactccagccatggctaaaagggagcaaggtagagctcaggctgttgtttcagagggtggaagccccaagccttggcagcttctacatagtgttcagcctgcaagtgcacagaagtcaagaattgaggcttgggaacctccgcctagaatacagaagatgtatagaaacagtctgtctgggcatggtggctcacgcctgtaatctcagcactatgggaggctgaggcgggcagatcacctgaggtcaggagtttgagaccaccctggccaacatggtgaaaccctgtctctgctaaaaatacacacaaattagccaagcgtggtggcacacgcctgtaatcccagctacttgggaggctgaggcacaagaattgcttaaaccttgaaagcagaggttgcagtgagccaagatcaaaccactgcactgcagcctgggtgacagagtgagactctgtctccaaaaaaaaaaaatgtatagaaatgcctggatgcccaggcagaagtttgctgtaggagtggggccctccaggggaacctctgctagaatagtgcagaaggaaaatgtgggtgggagcctccacacagagtccctactgggacaccacctagtggagctgtgagaagagggccaccatcctccagaccccagaatggtagatctactgacagcttgcaccatgcacctggaaaagcagcagatactcaatgccagcccatgaaaacagccaggagaggggctataccctgcaaagtcacaggggcagacctgcccaagattatgggaacctatgttttgcatgagcttgacctggatgtgagacatgaagtcaaaggagatgattttggagcttttcgatttgattgtccactggatttcagacttgcatggagcctgtagcccctttgttttggccaatttctcccatttggaacagctgtatttacccaatggctgtacccccattgtatctaggaagtaactaacttgcttttgattttacaggctcataggcagaagagacttgccttgtctcagatgagactttggactgtggacttttgagttaatgctgaaacttttgagttaatgctgaaatgagctgagactttggaggactgttgggaaggcatgattacaatgtgaaggtattacaatgtgaagatatgctatttgggatgtgccagggcagaatgatacggtttgactctgtgtccccacccaaatctcatcttgtagctcccataattcccacgtgttgtgggagggacctggtgggagacgactgaattatggggcaggtctttcctgttgtctttcctgttgttcttgtaatagtgaatgggtctcatgtgatctgatggttttataaatgggagtcgccctacacaaactctatttttgcctgcctccatccatgtaagatatgacttactcctccttgccttccaccatgattttgaggcctccccagccacatagaactgtgagtccaattaaacctctttcttttgtaaactgcccagtctcaggtatgtctttcccagaggcatgaaaacggactaatacaccagtgaatcacacacattgagactgaggtccaaaaaggctgaatccttagcccctagttatataccaagctggtggcaaagccaggatcacaggttccaactattaagtcctggtctaatacccattccctcaccctgagaatccctgaaaactataacatgtttatagagggcaggaagtatctcactttctagtacataaggtacctaggaaagtatcttgcagtaactgcttgatggatgaaaacaataaaaatgaacttcctttaaatgattatataatttagatattcctcaaattcaaatctgtctctcctccaaattattctgaattaattaggatttatgataactagcattaactaaagcaataattacattcaatagatttctagaaaggctgggccttcgattgaagtttcatcaactattcatgacatttgtagaattgtatataagaaagcaaaaacttagagacataggaacaaagagagtatttagaaattctgctatgtataagatacatatcttaaggtaataaaatgtatcttaagggaataaaaatcctctctcaaaacttgtttcagtgatttatatacatacatagtttgtgctaagttataaaatacttcctacagtggatagctacaaaaagtttgaaagcctctgt

SEQ ID NO: 161 - DNA, 5363 bp, Homo sapiens
gaacagtgtgtgaaaccatctcacgtgtagaacgtgagtagcaaaggatgggaggggagcattgcgctcgtgctggtgattgattctggaggccgaatcggagtgcagccggggcatgtggccaccagctcccggggctccccgcttcaggccgcttctgcacaggtaagaaattcccccagccaggaaacgctctggggcagagggacacagggactttcagtgtttcgggagctgtccaccaaagctgtggcggggcgcgctacagaatttgagggatgcactgcagaattaaaatcccacccccccagttcccaaatagggggaagtactattaaaggtactaaaatataaacactttttttcccctgcagttttgccctttatttgtcatggtgttttttggtttgctatttgatgccattctaggtaaaggaaaattttaagttattagcatgaaacatataaagttattagcatgaattttaccattctttttttttttttttttgagacggagtcttgctctgttgccaaggctggagtgcattggcgtggtcttggctcactgcaacctctgccttctgggttcaagcaattccctgcctcagcctcctgagtagctgggattacaggcacccaccaccatgcccggctaattttttgtatttttactagagatggggtttcaccatcttggccaggctggtcttgaactcctgaccttgtgatccactcgcctcagcctccaaaagtgctgggattacaggcgtgagccacaatgccaggctgcgtattttgttcttacgaggacagtggaaatactgcacacaacaagcccagccacttttatttcactccttgacacacgcatgttccaccaacatggcacacctctgtggctttctcacgggtaagggaaagaccactgggaaaggaggagggagggtactgggaaaggaggagggagggtggcctgtgtcctttcctcctgggtcacgaacttctgaagaaatgatgggctgatgcagtgaaatgacatgagtcagaaggtaccgcacagcgcttggtggttcgtgtctcagaaaactagtgccttctttccgagttcagggcaagttctgattggaagggaaagcatggcccggggcccagagcacctctgctcactcagccagctcacttaccttgctgtcacctggaggtcccgctaaactcctgctgctgggtgttccctaggaatttcgtgctcatgggcatcgtgaatgctacacatgagcagacggcagcctctctggtcacacgtgtgtgtatcccctccgttcaccctcggactccgtgttccatcggacgtcacttctaaaacccaagttcaaagataaaattattaagaatgtgaagatggtcacagcagagcatgaagccaagtgtgggggcgtgtgtgactgcagaggtgtgggtgggccccctgcagggtctgctgtgcaggaagcttttgattttctacccactgcacttttatcttttttgaatgtttagttgccgataaaatcaacatagacatttaaaatcaagctaaccatatgaagactgtcaaagccttcttctcttgtcttcagagaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccgggcatcccagggaggtagagctcaggttccagtaagtatccccttctgtcctgagagatggggaggtgagaggggtggtctctgaggtccgggcacatttcagatgcccctgtagtctggggggctaccccccatccccaggcatggtacccccccaccctatgtcgggatctcactttgaccgcttctctcgccagcctgcaggagacctccgaggacgtggcccctccactgccccccttccacttccagcggctcctcgccaacctgaccagcctccgcctccgcgtcagtcccggccccagccctgccggtcagtaaagacaaccacatgcccaagacccgagtgcttgccaggtctcagaactgggctgggctccggcggtcacagtcttgtcagggccttgcggccgggtggttattgtcctgttttgccaagaaggaaccttagtcaaaagtcaggacagttgccagaggccatataacctgtgaaggcaatggggatggtggctgaggtcagatgcagggaatggacaggagagaggcctgaaggatgggcctcagaggcaggtgtgcggccagcaagccacccagacccgctgggtgtgctcactccaccttcactggatccaccaagccccctgtccccgctggacacagcccacagccggcagtccaggagtcccctggcagagtgactcccctgctggtcactggcggtattgtacctaagccaccctaggagggtctggtcttcccaaagagggggccaagccatcacacatcattgatgggggtctgtcaccacctcccaccctggtcacagtgattgacagccttagcctctgatctgttcctcattagaacctctacccacacgctattttaaaaatcaatataggtcgggcgcagaagctcacgcctgtaatcccagcactttgggaggccaaggcgagtggatcatgaagtcgggagtttgagaccagcctggccaagatggtgaaaccccacctctactaaaaatacaaaaattagctgggcgtggtggcacacacctgtaatcccagctacttgggaggctgaggcaggagaatcgcttgaacccaggaggcggaggttgtagtgagccaagattgcgccactgcactccagactgggcgacagagccagactccatctcaaaacaacaacagcaacaataacaaaaaacagtctggtggggtggtctgcacctgtaattccagctactcaggagactaagactggaggatcgcttgagcccaggaggttgagactgtagtgactgtgccactgcactccagcctgggtgacaaagcgagaccttgtctctaaaaaaaaaaaaacaaaacaaaaaacaaaacccctagtgtatgtgtgtaaaatgaagctgagctctaggctcagatgtttacaaaggggtttttctacccttccagcaccacgcaggacatttgaaagtcatgtggggagtttctgggaatgtcaatttctgggaactttaggcctcttcatccacatgacaaccaacatgtcctcagatttgcttccaggggagggagattttgctctttttgaggacctctggctcagagggtcagtcttcccctgggcctcttttgagtccaagggtgctgggatgccctggagaagcagaggacatagcgaccctccccagcacccgcaatccccaaacttcctctttccatgggtaatgttttgggaggcctctctctaaacctttctgtgtgtacgtacttaacatctgtatttttttaaaaacatagaaatgtgattacacagccgggcgtggtggctcacgcctgtaatcccagctctttgggaggctgaggcgggcggatcacttgagctcaggagtttgagaccagcctgggcaatatggtgaaaccccatctctactaaaaatacaaaaattagccgggtatggtggcatgtgcctgtaatcccagctactcgggagggagaattgcttgaacctgggaggcggaggttgcagttagccaagatcatgccactgcactccagcctgggtagcagagccagaccttgtctcaaagaaagaaagaaaaagaaagagagaggggaagggagggggagaaagagagagagagagtgagagagagagaaagaaagaagaagggagggagggagcaagggagggaaaagaaaagaaagaaaggtaatcacacagtacgatattctgggacttgctttttgtcagctaacagtgcgtcgtggaggttgttccttgtcattacgcgtagaaagcctggttttctgtgtctggtgtgtaagattctgtggtatgggtgctctgtgaggttttagccatccccctattgacaggcgcttaagtggcctccagttttccccattacaaccgtgtcacagggaatagggaccagcctcatagaaaggtcttggtattccagtataagtgtcgctttaggacagagtgctggaaatggagatgttaggtcaaagagggagcattttccattttgatccacactgccaaattttccttcagaaaggctgctctgatgaggagtgtcggccgcctccagtctccctgttctgtgtctacagatggtcattttcatattttgcccagagtttatagttgttttctgtgggaaggttgatctgccaggatcccctgctcctctgttactggaagcaaaaccttctgattagtattcgtacatccacactcttttttcttttctttctttttttttttttttttttgagacggagtcttgctctgtcacccaggctggagtgcagtggcatgatctctgctcactgcaagctccgcctcccgggttcatgtcatcctcctgcctcagcctcccgagtagctaggactacaggcgcccgccaccacgcccggctaattttttgtattttttagtagagacggggtttcaccgtgttagccaggatggtctcgatttcctgaccttatgattcgcccgcctcagcctcccaaagtcctgggattacaggctcgagccaccgcgcccggcccatttttttttccaaatatcagatttctttatttttaaaatgtacacattatagttgatctaaatacaagatgttcactttccttgcaggtaagaaatgtcactgacatttctgtgtcaattagcttcttttacatcaaaatcctgttacattcattagtctcaaaatctcctataacacttagaactttaggctgggcgtggtggctcaagcctgtaattccagcactttgggaggctgagacaggagtccttgaggccaggagttcaaaaccagcctggacaacaaggcgaaaccgtttttctacaaaaaatttaaaaaattagctgggtgtggtgccacacacctttggtctcagctacttgagcggctgaggcaggaggatcatttgaggccaggagttcaaggctgcagtgagctatggttgtaccactgcactccagcctgagtgacagagcaagattctgtctctcttaaaaacaaccaaaacaacaagaaaaatcttaaaac

SEQ ID NO: 162 - DNA, 5773 bp, Homo sapiens
acatttataatgaaaaaaaccaaactacattttcataaatagaagataaaattctgttatccaaaatgaaaatcagactttttttacatctttcagaaatacaagctaaaagatggttaaatcatctagttttctaatatctattatatttaactggttccaaaagtgaacttttcagagaagtgtagtaccacaaattattttttaggccatgaatcttgacactttaaagtttactttgaattacagaaaaactgttgtgtatgggtaatacagagttaaccaggataaactgaattgccttactattaaaccaaaccagcaatatacaaatattaaaatattaaaataatatacaaatattaaaaatttggctactatcattgacctacctgcagagcaaaaagatttccaaattataaagtacaatatactgataatcctaactggagatgctttttaatatattaagtaaacatgattgctcactactataaatgtcttatctttaataccaaaataaatctttctttaatacctaaaacagtggaaagggtggtaagttactgacaattcagagtaataattccttattttagttatctctaagccattaaaagcagaatacattaaattatttccatattatcataaaaatactgcttacctgcccgtaacaaactgtaagagaagaactctctcctcttgagtaatgtcttctacaacttcccagaaccactaacaacaagaacaaaaaacttagctcatatttcagagcaattgtagacttctcaataccagagaaatatgcaatattcataaagcacattttattctacaaaactcgtttaccaaaaatgatttcatgcaaagctttcatatgcactattcccacaagaataatttgggtaaacactttactttgttaattaatgtaagttttcatccaatagtgctgaaaagcttacaaaattaaacggcaaaacttaacttcattctaagctctagagaaattttacctgaataactggatcttctctttcatagccacttgtgtattctgtattttttatccaatcactcacatcaatttctggcatgccagaaagcagtagctccttgggggaagaagaaaaatatttcaataattttctttagggaaaaaagttattatatttaagtggtaaatttgccataattagaaactaatcccatgtaaaactgatatatttttgtgacagttcctgcatgtcatcaacaacaagcattacatgagagagaatccttgacgctgataatctcaaatattataagatgtggagatgtttccacattgatacaatttcattaaaacataagagattatagtttatatgtttatgtgtgaacatatgcaacaacagtttatatgtgcaaaagttttatgaacattatctttggtttactttatatttttacaattctttgcaattttgttaacttctgtaaggagacagtattctcaacatgaaagtgacaacaaagacccgaataaatacttgactaaacaaggggaaagtcatcaagaaatcattatcatgaggaaaaaggaggtaatataaaaatagttacgatttttaaaaaagatttaggccttttaggaattcaattctggaataatttggatcctgtaaagtcaattttctccaaagtcaaaaaaaatgcaattttcctaatgacttgataggtttattttatccaggaagatcatcaaagacacaaaatctcaatcgtataagtaaaaatgaaattaagaatggcaaagtatttacctttttgttttccaagggaaaagaggacatgaaaagagcttgtccacttctctgaatcagtccatatatcacagttagagatgcttacatagtcaggggaggcaatgattggcctacactttacactgatgattcagaatatcaggatttcctttttttttgagaccgagtctggctctgtcacccaggctggagtgcagtggcgcggctcactgcaagctccacctcccgggttcacgccattctcccacctcagcctcccaagtagctaggactacaggcgcctgccaccatgcccggctaatttttttgtagttttagtagagatgaggtttcaccgtgttagccaggatggtctcaatctcctgaccttgtgatccacccacctcagcctccaaaagtgctgggattacaggcgtgaaccaccgtgcccggccaggatttcttattacagggatgtagatgccctgtgattcaaaatcatgtctcctatagtaaactactcataacatatacctgaccttgtaccttaaataagattgatataaggcaacatctgagaactcttgagggtttccgagatctactcagtgggtccatgaggttctcccttttccaacttatctgtatgaggttgagttttcttcatatatttcaaccaaacaacataccaaaacagattatacacaaaagcagttgtaagggcccatttgtcttctactaagctagacattaaagaaatttgcaaaactgttaaacagtaccagtcttcccactgtttctgttttgttctggaaaatgcaattttagtttttcaaatgttctctatgttaatataataatggattattttatgtgaataaaatattttacatttctgttttaatttcaagtaaatatccattgacataacccacataaacaaaaactcttttgttttaaggggtcctaagaccaaaaagttttagaactgctagtatagggtgtgttttagtcctagtcacagtgttatagaatccttttcctagatgaagacagtctagtctacattgaccacccccaaatacattctctagcttcctttgcactgcagactggctgctttgcctgctggctgtcttgccagctggctttggtttgggtttggagcctgggaaacataggcagttagtctggaggtgagggtactctctgctcccccactgcttcagcatctctttgcagtagctatggctcctcaagtatggctaccatcaggtggcccctccttggtggttcaggctcccacggggctcttcacagtaattcctctacctgtctcttcagtcctagggatgataaaggctttccctgttgccagtctgtggatgtctcactagacattgtttattcttaacactgcccatacctctgtcatagtccctttgttaaagtttcgatatttgaaccatctggagaaattctgttccctgacaggactctgatataggtttgctaaaagggagtgggacaggctttacgcatgtcttacaattcatgagtttaatccttttcccttctaggctgaagataagctttcaataatattaagtatgctttcattattcataattatgaataaaaatgactaacattatattctctcaagaaatttgaagcacttcatgaatatcacattaattgttacgattttttttcaagaagaagaaaaagaaaggatctttattatcccatctggttactaaactgaccaaaaacaaacagatgaaatgagaattccagaataaaatgtacatattaagaaaaatattttaagccccaatcaatttttttaatacaacaaaataattgaattcatctgttggaactatgtgtaaggtatataactcatactaatagttagaaactgaatcatgaaagtattcataggcatcagcttacctagcatcacacgattcagtgtttttatattctggttctatcatggataaattcacaagcagcacagtatggaagaacagtccacagtcatctcttgatgccttctgtctacaatggatgactacacctccagttcagtacactggagctactcgataccttctcctcactaaaactctagaatttaacctgaatcctttaactcagatgcacatctagtttagacgtttgtaccaaattttttaaaagtttcctttctcagtgcagcatagccctcccctatgaaagacacaaagtcacacaaaaagttctaaagccaagtccctctgattactcatgccaccaagcagcagactggcaacagtgatggtatctggggtcagggaacatgagttcatagcctatcactaacacatgctctatgaccatgaacaagttccatatcttctttggcctagttttctcatctgtaaaatggggacaatagtactcacctcaagagattttttgtgagcgtttttaaagttaatacatataaaatacctggcaaatactaaatgcttaataattattattatcactgtataaatcaagaccatgcctacaatgttgctcttcccaaatgtgaatcagctcaacttagtaaagtcagagtccaagacaaactaggaacctgatctaaattttaatgtaagagccacaattaaaaacttaccagtaacagacctaaatgtgaaagataaaggaataaagcttttaaaagaaaacacagaaaaatatcttcacagccttggagtaagaaacagtttctaaaacaggacacaaaaagcttcttccatcaaaaaaaacaaaacaaaacaaaaaaaactgataaactgaactatgttaaaccccaaaatttttattcactgaaaagacctgagtagaaaatattcataatacatatatctgataaaagactcttataaaagaattcataaagagtcctacaaatcagtaaaaagaaaaaaaaacacaatagaaaagtgggcaaattacttaaatagacactttgaaaacagtacacaaatggctataatcataaaaggtgtgtaacttcattagctatcaggtaaatacaaattaaaatctcaaggaaagaccactactgaattaccagaatggaaatgaaaaagatggaaaattatcaaatgctagtgagaatgcagaacacccagaactctcacacctcctaatgggagtgtaaactgatgcatcacttgagaaactatctgctcctatctactgaaatggggtacatgcacagcctatgtcccagcaattccactccaaggcatataacctacagaatgcaaacttatgttttcctaaaggcatgtttatagcagcagtacttgaaagagcctgaaactgaaaagtacccactaaatgttcatcaagagtagaaaagactaaaggaaactgaaatgctatacagcaattaaaatgaacaaattaccaactgcatgcaacaatatgtatgattcccacaaacaaaaacttgagctaagaaagccagatacattctatttacataattctaaaataggcgaatctcgtctatgattttagaagtcaggagaatggttacccttaaggtgggagaatgactggagggagatgacagagtgacatatggggtgctagaatttctgtttcttcatctgggtgttagtttcatgggtatgttcagtttgttaaaacttatcaagctatacatttatgatgtgtgtccttttctgcatgtatatcataacccaaagttttataaacttattgatatcagtaaattacaaggcaaagttttcatcaattatttttgttgttgctatttgttttttacatacatataggtccagcaaataactaatgctctgttttgaatttcaaaaggctaatttaatccaagcacagtacaggaaaagccatattgcagtcaggtctaataatataatagctcaaatagtcctccatttttaaat

SEQ ID NO: 163 - DNA, 6000 bp, Homo sapiens
ttatactaattcagtcttaggtttgcctcattgaatttgcctaagtaggaaagtttaactagctgaaaagaataaaactgcattcaatttctctaaaagcattcacataataatggttataggaggccaggcgcggtggcttacgcctgtaatcccagcactttgggaggccaaggtgggcggatcatgaggtcaggagatcgagatcttcctggctaacatggtgaaacctcatctctactaaaaatacaaaaattagccaggcgtggtggcaggcacctgtagtcccagttacttgggaggctgagacagaagaatggcgtgaacccgggaggtggagcttgcagtgagccgagatctcaccactgcactccagcctgggtgataaagcaagactccatctcaaaaaaaaaaaaaaaattgttataggaaccaaaaattcattcataataagttcctaaagcagacactgaagtacagttttttctacttaacagtatcttcctcagtatcttagaagtatgccggaatggtggaactttaaaatgaaaatatgcagctgggatcatttatttcgtgatttgaaagctacagggcccacattaccatgggtctgtgaaatcatcaatgaaggtccacaaaagtggttcaaaaagcatatagaaattattccttagctatgacaaagcctgagtaagcttaaaaaaaaaaaaaaaaaaagcctatattcgctgggcatggtggctcatgcctgtaatcccagcactttgggagaccaagccgggtggatcacctgaggtcaggagttcaagaccagcctggccaacatggaaaaacgctttctctactaaaaaaaacaaaaattaggcagcatggtggcatgcgcctgtaatccagctactcgggaggttgaggtgcaagaatcacttgaacccaggaggcggaggttgcagtgagccaagattgcaccactgcactccagcctgggtgacagagtaaaactccatctcaaaaaaaaaaaaaaaaacaacctatattttaaatgtttttatattaaagtgggaaaataattattcaacatttgtaatatgtaattgtaatatgtagtttagtatacaaatttttcaaaacatattgtctgtaaaagaaacctaaaaaataaaacaagttcttggtgaagaagccagttgatctggtttggttctgtgtccccacccaaatttcatcttgtagctcccataattcccacgtgttgtgggagggagacagtgggagatgactgaactatgggggcaggtctttcccctgttgttctcgtaatagtgaatgggtctcacagatctgatggctttaaaaatgggagttgccctgcacgagctctttttgcctgccaccatccatgtgagatgtgacttgtccctccttgccttctgccgtgattgtgaggcctccccagccacgtggaactgtgaatccaattaaacctctttttttttttaaattgcccagtctcaggtatgtctttatcagcagcacaaaaacagactaatatagcaaattggtaccagtagagtggggtgctgctgaaaagatacccaaaaatgtggaaccaactttggagctgggtaacaggcagaggctggaacagtttggagggctcagaagaagacagaaaaatgtgggaaagtttggaactcactggacacttgttgaatggctttgacaaaaatgctgatagtgatatggacaatgaaatccaggctgaggtggtctcagaaggagatgaggaacttgttgagaactggagcaaaggtgactcttgttatgttttagcaaagagactggcaacattttgcccctgccctaaagacttatggaactttgaacttgagagagatgatctagggtatctggcagaagaaatttctaagcagcaaagcattcaagaggtgacttgggtgctattagaagcattcagttttaaaagggaaatatagaataaaagtttggaaaatttgcagcctgacaatgcagtagaaaagaaaatcccactttctgagcagaaattcaatccagctgcagaaatttgcataattaacaaggagctgaatgttaatccccaagacaatggggaaaatgtctccagggcacgtcagatgtcttctcggcagcccctcccatcataggcctggaggcctaggaggaaaagatggtttcatgggccaaacccagggctcccgtgctctgtgcagcctaaggacttggtaccctgcattccaaccactccagccatggctaaaagggagcaaggtagagctcaggctgttgtttcagagggtggaagccccaagccttggcagcttctacatagtgttcagcctgcaagtgcacagaagtcaagaattgaggcttgggaacctccgcctagaatacagaagatgtatagaaacagtctgtctgggcatggtggctcacgcctgtaatctcagcactatgggaggctgaggcgggcagatcacctgaggtcaggagtttgagaccaccctggccaacatggtgaaaccctgtctctgctaaaaatacacacaaattagccaagcgtggtggcacacgcctgtaatcccagctacttgggaggctgaggcacaagaattgcttaaaccttgaaagcagaggttgcagtgagccaagatcaaaccactgcactgcagcctgggtgacagagtgagactctgtctccaaaaaaaaaaaatgtatagaaatgcctggatgcccaggcagaagtttgctgtaggagtggggccctccaggggaacctctgctagaatagtgcagaaggaaaatgtgggtgggagcctccacacagagtccctactgggacaccacctagtggagctgtgagaagagggccaccatcctccagaccccagaatggtagatctactgacagcttgcaccatgcacctggaaaagcagcagatactcaatgccagcccatgaaaacagccaggagaggggctataccctgcaaagtcacaggggcagacctgcccaagattatgggaacctatgttttgcatgagcttgacctggatgtgagacatgaagtcaaaggagatgattttggagcttttcgatttgattgtccactggatttcagacttgcatggagcctgtagcccctttgttttggccaatttctcccatttggaacagctgtatttacccaatggctgtacccccattgtatctaggaagtaactaacttgcttttgattttacaggctcataggcagaagagacttgccttgtctcagatgagactttggactgtggacttttgagttaatgctgaaacttttgagttaatgctgaaatgagctgagactttggaggactgttgggaaggcatgattacaatgtgaaggtattacaatgtgaagatatgctatttgggatgtgccagggcagaatgatacggtttgactctgtgtccccacccaaatctcatcttgtagctcccataattcccacgtgttgtgggagggacctggtgggagacgactgaattatggggcaggtctttcctgttgtctttcctgttgttcttgtaatagtgaatgggtctcatgtgatctgatggttttataaatgggagtcgccctacacaaactctatttttgcctgcctccatccatgtaagatatgacttactcctccttgccttccaccatgattttgaggcctccccagccacatagaactgtgagtccaattaaacctctttcttttgtaaactgcccagtctcaggtatgtctttcccagaggcatgaaaacggactaatacaccagtgaatcacacacattgagactgaggtccaaaaaggctgaatccttagcccctagttatataccaagctggtggcaaagccaggatcacaggttccaactattaagtcctggtctaatacccattccctcaccctgagaatccctgaaaactataacatgtttatagagggcaggaagtatctcactttctagtacataaggtacctaggaaagtatcttgcagtaactgcttgatggatgaaaacaataaaaatgaacttcctttaaatgattatataatttagatattcctcaaattcaaatctgtctctcctccaaattattctgaattaattaggatttatgataactagcattaactaaagcaataattacattcaatagatttctagaaaggctgggccttcgattgaagtttcatcaactattcatgacatttgtagaattgtatataagaaagcaaaaacttagagacataggaacaaagagagtatttagaaattctgctatgtataagatacatatcttaaggtaataaaatgtatcttaagggaataaaaatcctctctcaaaacttgtttcagtgatttatatacatacatagtttgtgctaagttataaaatacttcctacagtggatagctacaaaaagtttgaaagcctctgttgcagaacttaccatttttttggcatgttcttcacacagaggtgtctgatgtgtaatgtcaaaaactggcacagagcactgctgtccatctgcaaacttggctgtgcaacttgagaagagctgctgagagtggttcaagaggatatctgggtttttttaagttaggagtaaaatacactgaaactctaatttttcaatttctatataaaatttgcttgttcccttacatttcataagtacaagctttattatccataatataaatattacccatatcagtactagctcaactactgatatgggaaaataatagaatttatcagatgacaactctgaaggactctattttgctaatgagaccctggcaccagtctccttaatgaccattctgaaccaaattgtgttatttggaaaagcagggccatttccttcttaacatgtgaactccacttaaagttccacttcatgttttttttgttttgttttttgttttgagatgaagtcactctgttgcccaggctggagtgcaatggcacgatctcagctcactgccacctcggcctcccgggttcaagcaagtgattctcctgtctcagcctcccgagtaactgggattacaggcatctgtcaccacatccagataatttattgtatttttagtagagacagggtttcaccatattggccaggctggtctcgaactcctgacctcaagtgatctagccgcctcagcctcccaaagcgttgagattataggcataagccactgcacctggccaatggttttctttttttaaacagctcttaaaaggaaaattttctgcctatgatacttaccaagaataaaaatttaaagatatagttattagaaactcatctttccaaatttgaatattttgcttcacacttccagcaacaaactcaaactcacaacccatgaaaaattacttttaaatcaaaacttcactattggccaggcacagtggctcacacctatactcccagcactgtgggaggctaaggtgggttgatttattgagcctcagaagttcaggatcagcctgggcaacaaaaaagtacaaaaattagtcaggcatggtggtgcatgcctgtagtcccaggtactcaggaggctgtgatgcaaagatcacctgagcccagggaggtcgaggctgcagtgagctgtgatcgtgccactgcacttcagccggggtgacagagtgagatcctgcctctaaacaaacaaacatgagctttacatcatcaatatttttaagcactcatacttttagctactacatttccttaacacttaccttatatctattaagtgcctttgtgtttttcctttatggtttttaggtaaaactataaagcctttattacatagaaagtgctgctgaacaagctgttccaagaacagaaaggagggcaacaattaaatagatggtaaagataagtaattgctgctatttttaca

SEQ ID NO: 164 - DNA, 6836 bp, Homo sapiens
ggacagaaaagaggagggtggtatatatgtgcatagatgtataaaattcctctggaaagatacataagaaattagtgaatatatgctgtccccagagaggagaactgggtggctggaggatagggagggagggagatgcactgttgaaagcccagcaccatgcatcctgaacgttttccctggctcttaatgtccactaagttctcagatgcccacagcatctctctcctctaccctcttcttcctcctagttccccattgaaagcaactcctgccccatccgttcctgggccagactcagggagttgtagttttcctacctgtttcccgcccacaggttcctgttctctgcccccagtgcccagcagtctccagccatctccagctcctcacattcctgccccaccccttcctctctccccaggtcctagcccgcaaactgcagggagggggcctcctccccagcctccacccgtctctccccctccactccacacagcctcagcggggtctgacattcagctataaccgtgtccccgccccttgctcacaaccttccagggctccctgtcaccctcagaaggctaagttcccagcctggcctgaaactccctaagaatctgaccccgcccgctcgccccaccagcctcatctcctgtgctccttggctcctggcttcggaggctctagtcagacttaagggctttgttgtcctcccagcacctccttggtttcctgccttgggccttcgcttcagctgtgccctctgcctggaagggccttagtggaggtcatgccacaaccacgccttctctggaggtcctctctgccgtctccagctgccaggattcctcccgccctgggctctcacagcctctggcctctccctgtgtcatacccagatcacccgggattgggactgtctgcggctggctctgtctcttccatcagactgtgagctccatctgcaagggcagattcgggtctgattcacctttgagcccccagtgggtgggggtggggggtggagatactaaagctggtgggggcgaagctgggagagcaggaagggggagagagagacgggcagaccctgactggttcggggagagaggggaggagaaagcgagagagaggaagaacagagacacagagacaggaagggagggagagaaacagagaaaagggaagaataaatgggagacacagataatgccccacaggcagagaaagaggatggagatagggagagggcgaaaggaaggacagatgtgcagagacagaagggaggacagacggaaagagacacagagaggcagcaaaagcaaccaagaatgacaggagcagagaggaggagggaaagagggagagagagagagagagaacgagagagaagggagggagggagagagggagagagagagcgagagagcacgcacagagcgaggaggaggcgcaggagagaagagggagggaggccagcgagggacaggacggggcggagaggcggaggggagctagggaaagccggggaggagcgagactggccgaggaggagggcgggcgagcgggagcgccggccccgccgcctcccggcctcttttgtcccttccctcctctgcgtcaggcttctctggcccggcctccccctcccgctccctcctcctccccggggctggatggaattttttcccctggacctgggccagctccggggcaggggggaagccaggccggactgggctgggcggtggggaggggccggggcggggggccccctggggagggggctggtccgacggccgcgcagccggcggggtccagggagggggagccccggaccgcagagccggggaggaggtgacggccggagggagtcggggagaagggaaggaggatggcggggacggcgggaggaaggggagaggccgccgtgcggcgaaggcggggagaggatggagagcgctcggcggcggtggggcccggcctgcgggcccggggcggcggagaagaccccttccctgcgacgcgggagccgcgggagccgtgagtctgcggaaagggagggtggggggctggggcccgcactcctgggtccctgagggaggagcacccgggggcctggatttcagggttcttggaggaggagttgggggtggggagggtggggtggctgggagcccagactcctgaatccttgaaggagggggctgggacctggatcccggggtccagaatctggagaaggctggggacacttcctggattcaagagggaggacagagatgggggctggggctggtaggatcgtggctggaagagactaggggcgagctgcccgagccctcgggggaggtggaggaagactggctttggagtgcctgcggcagcggaagggttaacgtctggctggaggggagggggaggcgcagggatggggctgcggggctttgaggggtcaagggtgagccgtgccagtgggagggggccgaggaggagggggaggttgtctgggctgccagacaggccagggtcagcggcgggggcaggagatgtctggaggaggagaggcccagcatccatgctccctcggggacccgggattccaggtcccagacccctcctccctcagatctgggagtacaccacccagtcccccacccattccagaatccgagcccccagcccccttttttccaggatccaggagtctgagcccccagtctgttctctcagaccagggaatccacactccagcccctaactccttcaaaaccccagagttcagaacctcagcccctcttcccaaggagcgcggcccccaaccctctgttcctctagaacccaagcgttcaggctccggcatctttctccctttgaagcctgcagttctggggatccccaggcccctcctcctccggaacccaggagtccccacctcctctttagccccagctggagtccagccctccaggggttaagggggcgggaccagctagttgccatggtgccagactgtttgggtctgctctctgacccttgggggctccccagggtccgcagagagggggagggggacctaggcctgggggaagtccagagcctaccccttccccaaagcggggctatgggcccagggagttcgcgtttccaccaacgccttgtccagtgaccttgaacaagtcctgacccttctctctccgcctcagtttccccaaggagacactggttggcgggtgggggagatgcttaggtccggggaatctctgagattctcggcttcccctctcccctcaccctcctcctcaggccccaggcagccccggggcatgctgggaacccaggcctgggctccgggccaggttggtgtgggggggtgggggcgggggcagcctcctcccttccccttcctccccaccttggcctgactctcgcccccgcctgagggtctgggaggttgggaaggagggaagggggaagagagctggccgtagacccgtctccggcccccgcctccccctttcctcctccgcccctttcccgcctctcctccccctcctcaggtcgctaccccagccctgggccccttctcaaaccacccccaccccacccccagctccagacctggctcgagctgcgagggggagggagagagggaaggagaaaagagagagagagaagggagggagacccaaagagagaagggggaggggaggaaagagagagacctaagagggagggaaggagagagagagggagagagacagagactgagagagagcaggagacggaggtgagggatggagagagggaaggggcggagggagaggaagtgaggaaagacatccgaaaaaagggggtggagaagggtgagaaagaggagagagactgagagagggccagagagagaatgagagagacaaagagggggaagggggagaaggggaggatgaaagacagaaggtagaggaaaagcaggagaaagagggggagagaaggaagaaaacagaagcggggagaggagagaggcgatgggcagagagagaagccagcgcagagccagggagggatgtcctgatgcaggaggaggctgggaaccagggaaggtggaaagaaagagggagagagaaaaaggcagggccagagagacctggactgcgagaaaggaaccggaaggtgcgcctggagcaggggcagcgagaaccagacagtccaggaggaggggctgggcacgggagagaccccagctggaggggctcagagcccaggggtggggagggtgggtgctgggtcccggggtccagaagctggagaaggctggggacacctcctggattcaagagggaggacagagatggggctgggcagactttgggagcctcttcccctctctgaggctcagccccctcacctgccaaatggggatgctgagggcacctcgctctctggagtgggaggtgtcagggagaggactggtgctcagggcctggtatggggtcagcgctgggagattgtggctgtcatagttgtaaatgacccaaagaagggaggagagaggaaagaaagcacctagggaggctctgatggttggctagcccctggcctccttagccctgggcctggagtctctgcagactgacaggagggtaggtaggaagcaggtgtgcccaaagggccaaattacgagacaaatgaggttccctcccagccggcacccaggaagccaggttttctatcaggccatgccttccccaggaggcctgcctggccggagggaggaggggctgggggcagggactcctgggtctctggggagaaggaggctttggatctggactcatgagtctgagggaggaaggggctgagtccttggattccaggaacatttggggagaaaagggccagaggcctggattcctgggtctgtggtgaggaagggcctagacttctgggttctttagggaggagggggatgagagccttgactccagggtccctgatgaggaaggggctgagggcctggactcctgggttccttggggaggaggggccgggggcccggactcctgggtcctggcacccacccgtagaaccgaccttgcggggccttcgccgcacacaagctcgtgtctgtgggtccgtgtcgggggctcaccatcgcggctggggcctccccggccctccccctcatccctggtcctcctggtccctgtctgtctgtctgtcgggtctgtccacctgccgcgccccccgggctgaggtaggaggttgtatagttgaggaggacacccaaggagatcactatacggcctcctagctttccccaggctgcgccctgcacgggacggggcccggcggggacccccagccccactcagggacccttagccccactgggctgccccagggaccctgggaggaagagccgggctcttttctgtccttgtccctgcatcccctccttcccctgaaatctgttttccttccctgtctgtctccatctctgctgtgtctctgtggcttctgtgtctctttcacagtggatcctctgactccctcttattctggctttctaggtctctgcccctcccgatatctctctgtgtctctatttctgtcgtttttggtctttctgtctctggctctcagaatgtctctgtgcctatctccatctctgacccccaccccagggtctaccgggccaccgcacaccatgttgccagtctctaggtccctgagaccctttaacctgtgaggacatccagggtcacaggtgaggttcttgggagcctggcgtctggcccaaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcgggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggagga

SEQ ID NO: 165 - DNA, 7007 bp, Homo sapiens
gctccttgtaacagaaataatcctaaatgtcaaataggcactcttgtatcaggatcttcaagagccttacacggtaatgggctactggaagcttgagggaagatgcaggtgggtcacatgaattggttgagctcattccttgcagctgaagacatggggatgataaaaagactgaccagttccgtcttttactcagcagaagaatcaccttctggcataatgtactcaggtcagggattgccgaactttaacatgcatgactcctgtggactttgttaaaatgcagattctgatttcacaggtatagggtgaggcctgacattgtgcatttctaacaagttcctaggtaaagctgatcgagctgattcttggaccacaccatgagtaacaggggtgtggcacagtggagtgattaagagcactggctttagtgtaggacactctgagttctgccgagggaatttatcattaccttttcattttttttttttttttttttttttttgagacagaggcttactctctcacccaggctggagtgcagtggcggggcgtggtcttggctgactgcaacctctgtctcccaggttaaagcgattctcctgcctcaggctcccaagtagctaggactacaggcatgtgccaacacacccagctaaattttgaatttatagtagagatggggtttcaccatgttggccagactggtctcaaactcctgacctcaagtgatctgcctgccacagcttcccaaaatgctggaattacaggcatgagccaccgtgcccagcctcatcatgatcttaagcaagttacttaattgttgtgggcctcagcttcctcatatgtaaaatagcagctcctccacacagttttgttgtgaggattcaatgaaatattgctcaacaaatgccactgtagttttactattacattcttgggatgtatttctcaaaggatgagctgtgattcacttgcattagaattctctgtattaaagttacagatccctgaatccaccagagacctaatgaagcaggacccctagagatgcagcccaataaacagccttttaaataagctctgcaaagagctggtaccaatcctattgaaacaattttttcaaaatcgaagaagagatattccttcctaactcattctatgaaacctctatcatcctgataccaatacctggcaaaaacacaagaaaaaaagaaaactacagactaatatccctgatgaacattgacatgaaaatcctcaacaaaatactagcaaactgaatccagcaacataccaaaaagataatctaccatgatcgagtggactttattcttggcaggcaaggatcattcaacatatgcaagtcaataaatgtgattcaccacacaaacaattaaaaacaaaaacaatatgaccatatcaatagatgcagaaaaagcattagataaaatccaacatcccttcatgataaaaacctacaaggcataagacatcaaaagaacatacctcaaaataaaagccatctctaacaaacccacagccaatatcatacttaacaggcaaaagttggaagcattcctcctaagaatgggaacaagacaagaatgtgtactctcaccactcctattcaacatagtattggaaatcttagccagagcaatcaggcaagagaaagaaagaaaagacatcaaaagaggaaaagaggaagtcaaattatcttccttcactgacaatatgattctatacaaagaaaaccctaaatattccaccaaaagattcctagacctgaaaaatgacttcagtaaattttcagggtgcaaaataaatgtacaaaaatcagaagcatttctatacacaaataacattcaagctgagaaccaaatcaagaatgcaatccaatttacagtcaccacaaaaagaataaaatacctaggaatacatctaatcaagcaggtaaaagagctctacaaggagaattataaacattgcttaaggaaatcatagatgacacaaatagaaaaacgttccatgctcatctattggaagaatcaatagcattaaaatgtccatactgcccaaagaaatacacagattcaacaaaattcccatcaaattaccaatgttattctttacagtgttagaagaagaactattctaaaattgatatggaaccaaagcagagcctaaaagcgaaagcaatcctaagcaaaaagaacgaagccagaggtatcatattaccggacttcaaactctactccaaggcagcaaactaaaggtaaccaaaacagcatggtactggtactaaaatagacacaaaaattaatggaacagaataaggaacccagaaataaagctatacatctataaccaactggacttcaacacaatcaacaaaaataaacaatggggaaagcacaccctataataaatggtgctggaaaaactggctaaccatatacagaagaatgaaattgaactcttacctcttaccatatacaaaaaataactcaggatacattaaagacttaaatgtaagacttcaaaacataaaaattctagaagaaaacccaggaaatactcttctgaacattggcctaggcaaacaaattatgactaagtcctcaaaagcaaatgcaacaaaatgaaaattgataatggagacctaactaaattaaagagcttctgcacatcaaaagaaactatcaacagaataaatggacaatctacagaataggagaaaacatttttaacctatacatttgataaaggaataatatccagaatctataaggaacttaagcaaatcaacaagaaaaaaacaaataaccctattaaaaagtgggcaaaggacatggacagacacttctcaaaagaagacacacaagcagccaacaaatataagaaaaaatgctgaacatcacttatcatcacagaaatgcaagtcaaaaccacactgagataacatctcatgccaatcagaatggcgattcttaaaaagtaaaaagataacagatattggtgagactgcagagaaaaatggaatacactgttggtgggactgtaaattagttcatcctttgtgaaaagcagtttggagagttcttaaagaactaaaaatataactaccatttgacccagcaatccattactgggtatatatcaaaaagaaaataaatcattcaaccaaaaagacacctgcactcacatgtttattgcagcactattcacaatagcaaacgtggaatcaacctaggtaccgattaatggtggactggattttaaaaatgtggtctgtatacatgatgaaatactatgcagccataaaaaataatgaaatcatgtcctttgcagcaatatggatgcagctggaggcaattttcctaagtgaattaacacagaaacaaaaaatcaaataccatatgctcttgcttataagtgggagtggaatactgggtacacatggacataaagactgaaataatggacactggtaactccaaaagggaggaggaagggaagggaaaactatttattggatactactttcactatttgggtgatgggttcaaacgaagcctacatctcaacacactataacagtgtaacaaacttgcacatgtacctcctgaatctaaaatctaaaagcaaataaataaataggccagctctgtagaggggaagccatgtctaatggcagagaactgatggcttcagtcacgtgaggacagaggagcaggagataaaaaggtagaactgtattgggtcagcttcaagatgcttaactgtaaccctgcctgatcctcccacatttgctcatataggctacagaaaaaaataaaagacaaatacacagacagacagacataggactacttaccttagctataaaactcgcacctccaggccagtaccagaggatggagtgcattttccacagtaaccaccgcatttccctacgactcgggtaccatcctgcaaggagatgcatcatgttagcctgcctgcttggttaatgctttcagggcctgcactggctttttgggaaaacgttcttatacacacagtaaacaggccttctgaactgatgtgaagcccaacatactcaccatggtctaaagcaggggctggcaaacttcagcctgtgagccaaatccagcccaccacctgtttctgtatggcttgcaagctaaggatgatttttatatttttaaataattgagaaaaagtaaaccaaaaattacatttcttgacacataaaatcatatgaaattcaaatttcagtgtctattaataaagttttattggaatacagccacattcattaatttacctgatgtctatagctgctttcatgctgcaaaaaaagaactgagtctcagcttcatactgcttctcggtgcacaacaaatcacagtgacattgttttaatttgagagtgttttgagtgatgtgtgtattgctagatcattacaatttatgtgcttattaccagtgtataccattatgacaaatcaagaaaagaagagaaaggtagactttgaatgttgcacttttaaggtacaatggcatgtggattattttgttatcaaatttagatgacaaaggattgtgattattatgaaatgacactatagctgtgctaaaagaatacaatatatatcatcaccaaactaaatactcatcacaatattcccaactcacagaaaaacaatggtcaaaaatttagaaaatttaaaatataaaattaaaaaacatgaaaatgagtaagtttccaagttgctcatttgttagccaagcaaggaaaacaatttaccaatggtgagttcattaaatcctgtttaacagcaacatctgaagaaatgtgtccagagaaaataaacttaactactcttttggcaaggactattgcttgaaaagctaatagcattgggaaccacataaacagtcaattaaaaaaacaaagcagattattttgagtggttttcactggctcttaatgggtccacacatattactgatgttattcaggtgttatcatttctttgaggagaaaatgcccagtctgaagtgactaaagaattagactctatgaagagtctagtggaactagtggaatagtggaacaatttgtggaatagtggaatagtttatggaacaagtacaggtgagaatatttcaaaaaggttgggaaagaactgcagaacaactgaagtggaatctgctaagacgtgttgacaactgatgatagtaaaaatatgtgtggagcataaaaagctttaactggacaaatttacaaagcttgcgaaactgttagatgtttaaagcctatggttattcactgtattattcatttgcaggtactttgtggaaaatatttgacctatcaagtgctatagaactagtagtatcaatagtggactttattttctaccacggacttacccatcatccattttgtgaatttttttgtcagaactgaaagctcaataccttgacttgtcctactacacagcaatttgatggcttagcagtggggtaaagttttattttgatttttgagctcagggtcaagattaaagttttttgaactacaactgctctcaatcactgtaattcaacacttaatggctctgaatattagcttttgcttcagagttgatcatgtttctcaatggattgtacctaaaattacaaggcaaaactgttcttataggcaaaacttatacagtgataaagtaatttcactgataatactgtttggatcacaagtaacgttagattgttttatacacttcccatgctgtcaaaagttaaaacaggaaatgtcttctctattacacacaaatttaaagtggatatattttctgagcttaaactgcagttccagcactgtttttcagactttgatataaatgcaaaggaaatctttttatgtcaaaatccatttaactagcaattgaggagcttcaatctcattttcaattgcaagtgattaatatgcaatgtagtgacatgctaaaaggcaactatcaagagaaaactctgatagaattctttacttgcctgccaagccatgaatatgcttaattaacattatatggttatggacagatatcagtgtttggcaatatcaatgcatgtagaaaggcatttagaaagattgaaatacataatatctcatttcacgtcagcattaacagataaacatttacaatctattttgataatagagaacactaattaagcgaaatattttcctcccccaatatcccattcatctcctcaggtgatctgtattagaaaaagctatactcagttattatgattgtattttgaatttgaccaataaaaaaattttgtgcaaatttgttttctctcttgacatacaaatataccattgattttgcctcttggcccttcaagactaaaatctttactatctggcactttgtagacaaagtatgccaactcctagtctaaagacctgcgctccatagagtctgtctttgcctctgcagattcatctggtaccattctgtactcaacacatgcatttctttttgttattcttctgatatgtcccatacattacaaggcctttgcatgtgccattctctctgattggagttctcctctctctccctctctgtgcatactgtaccacctcaattttggcctggtaaattcttcagaactcagttcaaagcccatttcttctgagaaaccttcctgacctggttatctgccgcaaagcaccctgtaaatgggtaattctttctttaacatctgtcttcctactggaatgtcagctccattatgacaagaccaataccttgttaaaacctgggagtatccagaacctaccacagtgtgtggctcataacgatacgaaatatacatttgttaaatgaatgaatgaatgaaaggctgaagctgaattcttcttttggaagtgtagttaagaatgccctgctgatcagttccccttatgctttaccatgcta

SEQ ID NO: 166 - DNA, 7095 bp, Homo sapiens
acaaaaaatgatcgaatatcatgctgtttttctttttcgaactaggaaaagcaaacagtagttatcaaagtaagaagcaatctaatatgttcttcttacataaaagagcttaacaaaatattttaattaaccatattgccttatcctttaaataccttttggaaatgaattcattatgctctgactcttcatatatacatatataaatatatatatgtaaaacatatccatgtacttcctgtgtctaacttttttctcagcacttattgtgtgccaagcatttaacatatattaactcatttaatcctcacatcagctctatgaagtcaatactagtattattataacatttcggaagaaactgcagctttagagaggtaagataacttggttagagcagttatataacaaaaatatacttaatacattaccctaaatatatgtcacggaaaaaaaggcaactgtgtattcaaatatttcaggtcaatcaaggacctaaaaaaatgctttcacacctaaaatataaacacaatgctcacacataatgttattcatatgaaaatgttttcttgaccaggaagctgttaattaggctgggtgcggtggctcatgccgataatcctagcactttgggaggctgatatggcaggactgcctgagcccaggagttcaagactagcttgggcaacacggtgaaaccccgtcactacaaaaaaacacaaaaaaacaaaaaacaaaccccaaaacaaaaattagccaggagtggtggtgtgcacctgtagtcccagctactcggggagctgaggtgggaagactgctggagcctcggaggttgaggctacagtgagctgtgattgtgccactgcacttcagctgaggcaaaggagtgagaccctgtcaaaaaaaaaacacacacaaaaaaacgggggatggagccaagatggccgaataggaacagctccagtctacagcttccagcatgactgaagatgggtgatttctgcatttccaactgaggtaccaggttcatctcactggggagtgtcagacagtgggtgcaggacagtgggtgcagcgcactgagcattagctgaagcagggcgaggcatcgactcacccgggaagcgcaaggggtcagggaattccctttcctagtcaaagaaagaggtgacagatggcacctggaaaatcgggtcactcccaccctaatactgcgcttttccaacggtcttagcaaatgccacaccaggagattatatcccgcgcctggctcagagggtcctacacccatggagccttgctcattgctagcacagcagtctgaaatcaaactgcaaggctgcagtgaggctgggggaggggcgcctgccattgctgaggcttgagtaggtaaacaaagtgcctggaagctcgaactgggtggagcccaccacagctcaaggaggcctgcctgcctctgtagactccatccacctctgggggcagggcacagccaaacaaaaggcagcagaaacctctgcagacttaaatgtccctgtctgacagctttgaagagagtagtggttctcccagcatgcagctggagatctgagaatggacagactgcctccttaagtgggtccctgaaccccgagtagcctaactgggaggcagcccccagtaggggcagactgacacctcacatggccaggtactcctctgagacaaaacctccagaggaatgatcaggcagcaacatttgctgttcaccaatatccgctgttctacagcctctgcttctgatacccaggcaaacagggtctggagtggacctccagcaaactccaacagacctgcagctgagggtcctgactgttagaaggaaaactaacaaacagaaaggacatccacaccaaaaccccatctatacatcaccatcatcaaagaccaaaggtagataaaatcacaaagatggggaaaaaacagagcagaaaaactggaaactctaaaaatcagggtgcctctcctcctccaaaggaacgagctcctcaccagcaacggaacaaagctggatggagaatgactttgacaaggtgagagaagaaggcttccgacaatcaaactattccgagctaaaggaggaagtttcagccaatggcaaagaagttaaaaaccttgaaaaaaaattagacgaatggctaactagaatacccgatgcagagaagtccttaaaggacctgatggagctgaaaaccatggcacgagagctatgtgatgaatgcacaagcctcagtagccgatttgatcaactggaagaaagactatcagtgatggaagatcaaatgaatgaaatgaagcgagcagagaaatttagagaaaaaagaataaaaagaaatgaacaaagcctccaagaaatatgggaccatgtgaaaagatcaaatctacatctgattggtgtacctgaaactgatggggagaatggaaccaagttggaaaacactctgcaggatattatccgggagaacttccccaatctggcaaggcaggccaacattcaaattcaggaaatacagagaacgccacaaagatactcctcgagaagagcaactccaagacatacaatcgtcagattcaccaaagttgaaatgaaggaaaaaatgttaagggcagccagagagaaagctcgggttacccacaaagggaagcccatcagactaacagcggatctcttggcagaaactctacaagccagaagacagtgggggccaatattcaacattctcaaagaaaagaattttcaacctagaatttcatatccagccaaactaagcttcataagtgaaggagaaataaaatcctttacagacaagcaaatgctgagagattttgtcaccaccagacctgccctaaaagagctcctgaaggaagcactaaacatggaaaggaacaaccagtacaagccactgcaaaaacatgccaaattgtaaagaccatcgaggctaggaagaaactgcatcaactaacgagcaaaataaccagctaacatcataatgacaggatcaaattcacacataacagtaataaccttaaatgtaaatgggctaaatgctccaattaaaagacacagactggcaaattggataaagagtcaagacccatcagtgtgctgtattcaggaaacccatctcatgtgcagagacacgcataggctcaaaataaagggatggaggaagatctaccaagcaaatggaaaacaaaaaaaggcaggcgttgcaatcctagtctcggataaaacagactttaaaccaacaaagatcaaaagagacaaagaaggccattacataatggtaaagggatcaattcaacaagaagagctaactatcctaaatatatacgcacccaatacaggaacactcagattcataaagcaagtccttagagacctacaaagagacttagtctcccacacaataataatcagagactttaacaccccactgtcaacactagacagatctacgagacagaaagttaacaaggatatccaggaactgaacccagctctgcaccaagcagacctaacagacatctatagaactctccaccccaaatcaacagaatatacattgttttcagcaccacacctattccaaaattgaccacatagttggaagtaaagcactcctcagcaaatgtaaaagaacagaaattataacaaactgtctctcagaccacagtgcaatcaaactagaactcaggattaagaaactcactcaaaaccgcataactacatggaaactgaacaacctgctcctaatgactactgggtacataatgaaatgaacgcagaaataaagatgttctttggaatcaatgagaacgaagacacaacataccagaatctctgggatacattcaaagcagtgtgtagagggaaatttataccactaaatgcccacaagagaaagcaggaaagatctaaaattgacaccctaacatcacaattaaaagaactagagaagcaagagcaaacacattcaaaagccagcagaaggcaagaaataactaagatcagagtagaactgaaggaaatagagacacaaaaaacccttcaaaaattcaatgaatccaggagctggttttttgaaaagatcaacaaaattgatagaccgctagcaggactaataaagaagaaaagagaagaatcaaatagacgcaataaaaaatgataaaggggatatcaccaccgatcccacagaaatacaaactaccatcagagaatactataaacacctctatgcaaataaactagaaaatctagaagaaatggataaattcctcaacacatacaccctcccaagactgaaccaggaagaagttgaatctctgaatagaccaataacaggctctgaaattgaggcaataattaatagcttaccaaccaaaaaaagtccaggaccagatggattcacagccaaattctacgagaggtacaaggaagagctggtaccattccttctgaaactattccaatcaatagaaaaagagggaatcctccctaactcactttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaagtgggcttcatccctgggaagcaaggctggttcaacatacgaaaatcaataaacgtaatccagcatataaacagaaccaaagacaaaaaccacatgattatctcaatagatgcagaaaaggcctttgacaaaattcaacaacccttcatgctaaacactctcaataaattaggtattgatgggatttatctcaaaataataagagctatctatgacaaacccacaaccaatatcatactgaatggacaaaaactggaagcattccctttgaaaactggcacaagacagggatgccctgtctcaccactcctattcaacatagtgttggaagttctggccagggcaatgaggcaggagaaggaaaaaaagggcattcaattaggaaaagaggaagtcaaattgtccctgtttgcagatgacatgattatatatctagaaaaccccatcgtctcagcccaaaatctccttaagccgataggcaacttcagcaaagtctcaggatacaaaatcaatgtacaaaaatcacaagcattcttatacaccatcaacagacaaacagagagccaaatcatgagtgaactcccattcacaattgcttcaaagagaataaaatacctaggaatccaacttagaaaggaagtgaaggacctcttcaaggagaactacaaaccactgctcaatgaaataaaagaggatacaaacaaatggaagaacattccatgctcatgggtaggaagaatcaatgtcatgaaaatggcgatactgcccaaggtaatttatagattcaatgccatccccatcaagctaccaatgactttcttcacagaattggaaaaaactactttaaagttcatatggaaccaaaaaagaacccacattgccaagtcaatcctaagccaaaagaacaaagctggaggcatcacactacctgacttcaagctatactacaaagctacagtaaccaaaacagcatggtactggtaccaaaacagagatatagaccaatgggacagaacagagccctcagaaataatgccgcatatctacaactatctgatctttgacaaacctgagaaaaacaagcaatggggaaaggattccctatttaataaatggtgctgggaaaactggctagccatatgtagaaagctggaagtggatcccttccttacaccttatacaaaaattaattcaagatggattaaagacttaccatgttagacctaaaaccataaaagccctagaagaaaacctaggcaataccattcaggacacaggcatgggcaaggacttcatgtctaaaacaccaaaagtaatggcaacaaaagccaaaattgataaatgggatctaattaaactaaagagcttctgcacagcaaaagaaactaccatcagagtgaacaggcaacctacagaatgggagaaaatttttgcaatctactcatctgacaaagggctaatatccagaatctacaattaactcaaacaaatttacaagaaaaaaacaaacaaccccatcgacaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatgtagaactagaaatactatttgacccagccatcccattactgggtatatacccaaaggattatcaaacatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaactaaacaccacatgtcctcactcataggtgggaattgaacaatgagaacacatggacacaggaaggggaacatcacacactggggcctgttgtggggtgggggaaggggggagggatagcattaggagatatacctaatgttaaatgacgagttaatgggtgcagcacaccaacatggcacatgtatacatatgtaacaaatctgcacgttgtgcacatgtaccctaaaagtataactaaaaacaaaaaacaaaaaacaaaaaaacctgttaattaggacagc

SEQ ID NO: 167 - DNA, 7454 bp, Homo sapiens
aggatctagaagtaagcatttatcgaatatctgggtttagaggcttaaaagcattggacaaaatcactttaaaaatcagcaaatttgggccaggtgtggtggctcagccaaggtgggaggatcacttgaggtcagaagttcaagaccagtccagcaaacgtggcaaaaccccatctctacagaatacacaaaaattagccgggcctggtggcgcaggcctgtagttccaaccacgtgggaggctgaggtgggagaatggcttgaacctggaaggcagaggttgcagtgatctgagataatgccactgcactccagcctgggcaatccgtctcaaaaataaatacatacatacatacatacatacatacatacatacatacatacataagcaaatctgtaaatatcaatatgcataaccattagtttcttgacataaaaaacctcccaatctcccaattaactgaatacactaggaataaatagatgaatacaatggaatattatatcactattaaaatgaatgaggaggttctataagcctagatatgggaggatctttggatatcatgtaaaaaaaaaaaaaaaaaccaaggtgcagaataatgtgatcctatcaggggacagaaaagaggagggtggtatatatgtgcatagatgtataaaattcctctggaaagatacataagaaattagtgaatatatgctgtccccagagaggagaactgggtggctggaggatagggagggagggagatgcactgttgaaagcccagcaccatgcatcctgaacgttttccctggctcttaatgtccactaagttctcagatgcccacagcatctctctcctctaccctcttcttcctcctagttccccattgaaagcaactcctgccccatccgttcctgggccagactcagggagttgtagttttcctacctgtttcccgcccacaggttcctgttctctgcccccagtgcccagcagtctccagccatctccagctcctcacattcctgccccaccccttcctctctccccaggtcctagcccgcaaactgcagggagggggcctcctccccagcctccacccgtctctccccctccactccacacagcctcagcggggtctgacattcagctataaccgtgtccccgccccttgctcacaaccttccagggctccctgtcaccctcagaaggctaagttcccagcctggcctgaaactccctaagaatctgaccccgcccgctcgccccaccagcctcatctcctgtgctccttggctcctggcttcggaggctctagtcagacttaagggctttgttgtcctcccagcacctccttggtttcctgccttgggccttcgcttcagctgtgccctctgcctggaagggccttagtggaggtcatgccacaaccacgccttctctggaggtcctctctgccgtctccagctgccaggattcctcccgccctgggctctcacagcctctggcctctccctgtgtcatacccagatcacccgggattgggactgtctgcggctggctctgtctcttccatcagactgtgagctccatctgcaagggcagattcgggtctgattcacctttgagcccccagtgggtgggggtggggggtggagatactaaagctggtgggggcgaagctgggagagcaggaagggggagagagagacgggcagaccctgactggttcggggagagaggggaggagaaagcgagagagaggaagaacagagacacagagacaggaagggagggagagaaacagagaaaagggaagaataaatgggagacacagataatgccccacaggcagagaaagaggatggagatagggagagggcgaaaggaaggacagatgtgcagagacagaagggaggacagacggaaagagacacagagaggcagcaaaagcaaccaagaatgacaggagcagagaggaggagggaaagagggagagagagagagagagaacgagagagaagggagggagggagagagggagagagagagcgagagagcacgcacagagcgaggaggaggcgcaggagagaagagggagggaggccagcgagggacaggacggggcggagaggcggaggggagctagggaaagccggggaggagcgagactggccgaggaggagggcgggcgagcgggagcgccggccccgccgcctcccggcctcttttgtcccttccctcctctgcgtcaggcttctctggcccggcctccccctcccgctccctcctcctccccggggctggatggaattttttcccctggacctgggccagctccggggcaggggggaagccaggccggactgggctgggcggtggggaggggccggggcggggggccccctggggagggggctggtccgacggccgcgcagccggcggggtccagggagggggagccccggaccgcagagccggggaggaggtgacggccggagggagtcggggagaagggaaggaggatggcggggacggcgggaggaaggggagaggccgccgtgcggcgaaggcggggagaggatggagagcgctcggcggcggtggggcccggcctgcgggcccggggcggcggagaagaccccttccctgcgacgcgggagccgcgggagccgtgagtctgcggaaagggagggtggggggctggggcccgcactcctgggtccctgagggaggagcacccgggggcctggatttcagggttcttggaggaggagttgggggtggggagggtggggtggctgggagcccagactcctgaatccttgaaggagggggctgggacctggatcccggggtccagaatctggagaaggctggggacacttcctggattcaagagggaggacagagatgggggctggggctggtaggatcgtggctggaagagactaggggcgagctgcccgagccctcgggggaggtggaggaagactggctttggagtgcctgcggcagcggaagggttaacgtctggctggaggggagggggaggcgcagggatggggctgcggggctttgaggggtcaagggtgagccgtgccagtgggagggggccgaggaggagggggaggttgtctgggctgccagacaggccagggtcagcggcgggggcaggagatgtctggaggaggagaggcccagcatccatgctccctcggggacccgggattccaggtcccagacccctcctccctcagatctgggagtacaccacccagtcccccacccattccagaatccgagcccccagcccccttttttccaggatccaggagtctgagcccccagtctgttctctcagaccagggaatccacactccagcccctaactccttcaaaaccccagagttcagaacctcagcccctcttcccaaggagcgcggcccccaaccctctgttcctctagaacccaagcgttcaggctccggcatctttctccctttgaagcctgcagttctggggatccccaggcccctcctcctccggaacccaggagtccccacctcctctttagccccagctggagtccagccctccaggggttaagggggcgggaccagctagttgccatggtgccagactgtttgggtctgctctctgacccttgggggctccccagggtccgcagagagggggagggggacctaggcctgggggaagtccagagcctaccccttccccaaagcggggctatgggcccagggagttcgcgtttccaccaacgccttgtccagtgaccttgaacaagtcctgacccttctctctccgcctcagtttccccaaggagacactggttggcgggtgggggagatgcttaggtccggggaatctctgagattctcggcttcccctctcccctcaccctcctcctcaggccccaggcagccccggggcatgctgggaacccaggcctgggctccgggccaggttggtgtgggggggtgggggcgggggcagcctcctcccttccccttcctccccaccttggcctgactctcgcccccgcctgagggtctgggaggttgggaaggagggaagggggaagagagctggccgtagacccgtctccggcccccgcctccccctttcctcctccgcccctttcccgcctctcctccccctcctcaggtcgctaccccagccctgggccccttctcaaaccacccccaccccacccccagctccagacctggctcgagctgcgagggggagggagagagggaaggagaaaagagagagagagaagggagggagacccaaagagagaagggggaggggaggaaagagagagacctaagagggagggaaggagagagagagggagagagacagagactgagagagagcaggagacggaggtgagggatggagagagggaaggggcggagggagaggaagtgaggaaagacatccgaaaaaagggggtggagaagggtgagaaagaggagagagactgagagagggccagagagagaatgagagagacaaagagggggaagggggagaaggggaggatgaaagacagaaggtagaggaaaagcaggagaaagagggggagagaaggaagaaaacagaagcggggagaggagagaggcgatgggcagagagagaagccagcgcagagccagggagggatgtcctgatgcaggaggaggctgggaaccagggaaggtggaaagaaagagggagagagaaaaaggcagggccagagagacctggactgcgagaaaggaaccggaaggtgcgcctggagcaggggcagcgagaaccagacagtccaggaggaggggctgggcacgggagagaccccagctggaggggctcagagcccaggggtggggagggtgggtgctgggtcccggggtccagaagctggagaaggctggggacacctcctggattcaagagggaggacagagatggggctgggcagactttgggagcctcttcccctctctgaggctcagccccctcacctgccaaatggggatgctgagggcacctcgctctctggagtgggaggtgtcagggagaggactggtgctcagggcctggtatggggtcagcgctgggagattgtggctgtcatagttgtaaatgacccaaagaagggaggagagaggaaagaaagcacctagggaggctctgatggttggctagcccctggcctccttagccctgggcctggagtctctgcagactgacaggagggtaggtaggaagcaggtgtgcccaaagggccaaattacgagacaaatgaggttccctcccagccggcacccaggaagccaggttttctatcaggccatgccttccccaggaggcctgcctggccggagggaggaggggctgggggcagggactcctgggtctctggggagaaggaggctttggatctggactcatgagtctgagggaggaaggggctgagtccttggattccaggaacatttggggagaaaagggccagaggcctggattcctgggtctgtggtgaggaagggcctagacttctgggttctttagggaggagggggatgagagccttgactccagggtccctgatgaggaaggggctgagggcctggactcctgggttccttggggaggaggggccgggggcccggactcctgggtcctggcacccacccgtagaaccgaccttgcggggccttcgccgcacacaagctcgtgtctgtgggtccgtgtcgggggctcaccatcgcggctggggcctccccggccctccccctcatccctggtcctcctggtccctgtctgtctgtctgtcgggtctgtccacctgccgcgccccccgggctgaggtaggaggttgtatagttgaggaggacacccaaggagatcactatacggcctcctagctttccccaggctgcgccctgcacgggacggggcccggcggggacccccagccccactcagggacccttagccccactgggctgccccagggaccctgggaggaagagccgggctcttttctgtccttgtccctgcatcccctccttcccctgaaatctgttttccttccctgtctgtctccatctctgctgtgtctctgtggcttctgtgtctctttcacagtggatcctctgactccctcttattctggctttctaggtctctgcccctcccgatatctctctgtgtctctatttctgtcgtttttggtctttctgtctctggctctcagaatgtctctgtgcctatctccatctctgacccccaccccagggtctaccgggccaccgcacaccatgttgccagtctctaggtccctgagaccctttaacctgtgaggacatccagggtcacaggtgaggttcttgggagcctggcgtctggcccaaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcgggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggagga

SEQ ID NO: 168 - DNA, 7479 bp, Homo sapiens
tgtgccatactgttaaatgtttataatgcctgttctgtttccaaatttgtgatgcttatgaatattaataggaatatttgtaaggcctgaaatattttgatcatgaaatcaaaacattaatttatttaaacatttacttgaaatgtggtggtttgtgatttagttgattttataggctagtgggagaatttacattcaaatgtctaaatcacttaaaattgccctttatggcctgacagtaacttttttttattcatttggggacaactatgtccgtgagcttccgtccagagattatagtagtaaattgtaattaaaggatatgatgcacgtgaaatcactttgcaatcatcaatagcttcataaatgttaattttgtatcctaatagtaatgctaatattttcctaacatctgtcatgtctttgtgttcagggtaaaaaacttgttgctgcaagtcaagctgccttaggcttataacatcacatttaaaagcatctcaggtaactatattttgaattttttaaaaaagtaactataatagttattattaaaatagcaaagattgaccatttccaagagccatatagaccagcaccgaccactattctaaactatttatgtatgtaaatattagcttttaaaattctcaaaatagttgctgagttgggaaccactattatttctattttgtagatgagaaaatgaagataaacatcaaagcatagattaagtaattttccaaagggtcaaaattcaaaattgaaaccaaagtttcagtgttgcccattgtcctgttctgacttatatgatgcggtacacagagccatccaagtaagtgatggctcagcagtggaatactctgggaattaggctgaaccacatgaaagagtgctttatagggcaaaaacagttgaatatcagtgatttcacatggttcaacctaatagttcaactcatcctttccattggagaatatgatggatctaccttctgtgaactttatagtgaagaatctgctattacatttccaatttgtcaacatgctgagctttaataggacttatcttcttatgacaacatttattggtgtgtccccttgcctagcccaacagaagaattcagcagccgtaagtctaggacaggcttaaattgttttcactggtgtaaattgcagaaagatgatctaagtaatttggcatttattttaataggtttgaaaaacacatgccattttacaaataagacttatatttgtccttttgtttttcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagttatggattataaacattcaaaataatattttgacattatgataattctgaataaaagaacaaaaaccatggtataggtaaggaatataaaacatggcttttaccttagaaaaaacaattctaaaattcatatggaatcaaaaaagagcctgcagaaccaaagtaagactaagcaaaaagaacaaattacctgatttcaaactacactataaggccatagtcaccgaaacagcaaggtactggtataaaaataggcacacagaccaatggaatagaacagaatagagaacccagaaataaatccacatacttacagctaactgattttagacaaagaaaacaaaaacataaggtggggaaaggacaactttttcaacaaatggtgctaggataattggcaagcacatgtaggagactgaagctagatcctcatctctcaccttatacaaacatcaactcaagatggattaggaacttaaatctaaggcctaaaactataaaaattctagaagataacattgggaaaaacccttctacatataggcttaggcaaggatttcatgaccaagaacccaaaacaaatacaatgaaaacaaagataaattgctgggacttcattaaactaaagagcttttgcatggcatggcaaaagaaacagtcagctgagtaaacagacaacccacagagtgagaaaaaaatcttcacaatctatacttctgacaaaggactaatatccagactctacaatgaactcaaatcaacaagaaaaaaaaaatcccatcaaaaagtgggctaaggacatgaatagacaattctcaaaagaaaatatacaaattgaaaacaaacatgaaaaaatgctcatcatcactaataatcatggaaatgcaaatcaaaaccacactgtgataccaccttacctctgcaagaatggccataattaaaaaaataaaaaaatagtagatgttggcatggatgcaatgaacaggaaacacttctacactgatggtgggaatgtaaactggtacaattactatggaaaacagtgtgaagattcctcaaagaactgaaataaaactaccatttgattcaataatcccactactgggtatctatccagaggaaaaaaagtcattatacaaaaaagatacttgcacacgcatgtttatagcagcacaatttgcgattgcaaaaatgtgggaccaacccaaatgcccatcaatcaacgagtagataaagaaacagtatatatcactgtttctttatccactcgttgattgatatacatcatatatattgatatacatgatgatatatatacacatatatatagatatacatatatatatgtagtatttcattgtgtgtatggatatatgtatatatcaatggaatactactcagccataaaaaggaatgaattaatgacatttgcagcgacctggatgagactggagactattattctaagtgaagtaactcaggaatggaaaagcaaacgttatatgttctcacttataagtgggagctaagctatgaggatgcaaaggcataagaatgacacaatggactttggggactcataaaagactacaaacatggtacagtgtatactgctcgggtgatgggttatgggtgatgggtgcaccaaaatctcacagatcaccactaaagaatttactcatgtaactaaacacgacctcttccccaataacctatggaaattaaaaaattttaaaaaataaaatagctagtaatattacaaaacacccatatgatgcaatgttataccatcactcaatagcattttcagggccatttgtcctgtaggtgttaaatttattaaatacttattatatgccaaaatgtaaaacatggcttttctttactattcagacactataagaaattttgaggaacaaaggagatagagatgatgataagtgtggttgacagaattgggggaaaaaagtgatcttagaagaaatttaagacagtttagaataacagcactcaaagagtgtaagaagtttggagaagccttattggaagaggaattagaacacctggagaaacatacagtaagaagtgatgaaggtctactgaactgatgagctggaggagttggagggtgaatgtttcttgtaaaacactaaaatattattctgggcctctttttcctgttcccagaggtaagtcatatcatacctttgtctataaatgtacaagtctatcagacctttgtttatgaatttacaggcctcttagatctttgtctattaattcacatacttattttatccttattagtttgtgtttttaaaatttttatcaaattggtttcatactgtacatgctattccacaacttgttcttaacaacactgcttaatagtttcattttaagtgtggtgcttacgaaaggttctagtacaaagttacaaaaagtttctttctattgctggaatgttctgcgctccccaccattccactcccctgtccctaagcagcccccactttggtccgtgttgaatgtatcgaacatattttttttcacatttgttgcaatcatcacaaaagtcagagagtgctcagaaaaagagaaatggagatggtgggccctggctggtcaaaggccccagagacggacctagaaaatgttcaataaagcgctgtcactgaactggacctacacaggaccgggtctgggcaccctgtatcaatagcaatgccaccctgaccagtctcaggcaccaaagacgaacttaaaacttttggaaaaagattcccccatatatggtaacctgagctccagcttccccacttcccatggagtcgaccagaatcccagaggaactcaacagttaagcctatagagccagactcactgctctagtttcagagagtggtctggcaagctcatcactctggctagctggcttttttgtttgtttgtttttttcctgcacagtgtggaagattggtacacccgaatgtaccaatggtgcaggcacatcgatgtgcgtgcacgtgtgtgtgtgtgtgtgtgtaaaatgttgttttcatataatattggagggcacatggtatgatatcaacatgatttatcatggggatattaggattgatcacttggttaaggtggtgtttgccaggtttctctaccgtgaagttatcacttttccctttccatactctatttttggaagcaaatcatgaaatccagcccacactgaaagagagggagagggataagcttctgaaaatgggagtagctacatgtcttatttatattttcataagaaagacttgttatttaattgttcatttatgtcagtataaactcatatatattatatactttgggttataattcaatgccacattatttagttgctcaaagtatctcagctttggggcctctttttggttggctcccctatgcctttgacaggtctctatactttgttttctttctggcattgcaagctgcctcaggctcatcttatatttccctttcccagccctagaaatggccatttcttaaggaaggcctggttctctttattagagaatggttttacaaagatctgagtgctgggtattctcattgctaatgggatatcactgcttctagaccatttcagggaatggagctaagaaaggtaggtatgaatactaatattcatatcttcatttgaatacacacacacaaacataactgtaattatttctgtacgtatgtagctatctttctggttaatgatgagttcatactgatgtctctgactctaatccagaaccacaggacttattctagccttcctccttgcctctatgacagcaagaaacttctcttccactatctagcctccatctacccatttgttccacctcaggatgcatgtaaaggagtttcagagttataaacccatttctccatgaaaatcaaatttactaactagagtgcagtgtttacatacagttccttttgtctttagccatacgatttccagtcaaaacattattctccaaagtcatgtaggtcagctccatttttgcattaccatcttctgtgaagtcatgacaggtgactttgggtggctcattcacactgaacacaaaataagtttagggcactggcctttgacttgcctttgggcttgagctgtatgtgtgggccacccagcagctctttccacctaagtaggctttgcctacaatacataaaggtagcagcagtggtgacaggtatcctttacccagtgcattctctgccacaggtacccagggtggtcactccatttctctatagattccacatcaattgtcaggcagtctttgagggtgaccatgcctatctcttccaagggctttgaagaccatgggtctgcaataccagtggacccttccagtggatgtcctctcttgcctccatcgacatggttacattatgcttccctgggttggttttaaagtcctgccaaacatttcttggaggaatgtgaacactctttttgtttcaccttaggcccctcacctattcttactgttggtggttgtgtgtggaaggcaggggtgtaagtaacattaaaataggtcacattgtagaaatgctgtgatcatgtcctaagaatttaggagaaaacgtggtcgaaagatgtgttgttctctttatgttaagaaagtctgagtagtaaatttaacatgacagagatttgcatttgtgcttattatcagtgaaacacaagagtcactggaagccagaattgagggtgacgtgatggatgatgcaggatcataagtaatgatgtaaccagctttaaattaaatcaatggtaatcgagaactgtagaggcaagaagatttatttgtttcaatacgaacaacctccaaagagacattgtgtcttgagtaataacagcattgctactttttttttttgagatgggagatataaagttagcccggaatgaaatgcatttgacaataaagaacgtagttccacctcaggatggtaccaataggtaccatcagggtaccaacagggtaccaacagggtagacctgaacaggaagagatggtgcctgaacattaagaagaatcttcatgtgcaccaattggacagtaagaaactatgtcagtctggcttctatactcgttattctaaatctcaataaattaatacagtttacatgagtgcatgctggtgttgcataaatcagagggcactattaatgtaaaataaaatgcgaagggtgcctcctggaatttagcaacgtgggctatttttattactattgttaacattttagggatttggtttatgaaagggcagctgagattgtgataaggcagctattttgtgacagatgagctggatacatggaaagtacacatggaagcccatcattcctacccttccctgctgacctaacaagtctctttgctcttcttaactactttacaaagtccagacctgactacccttccaatctctttttcttcctgccttcaatgccctaatcagtttgaacttcatactattcattagcacaccatgcttttcatgcctcccttacatggattcctattatctggaatgtctttctttgtcttttttatccgtttaatccagctgaaatgttacgttctttgaggaaatttttctgaatagagctggtcatttctttcctgatggtccttgactctttgaacctgacttattacagcactcacattctttttaaaaacttcatgttaatatccacatttatattttattataataattgtagattttatatctactttaaatatatatgatctgagtcccagggcttgaatttgaacacacaaggttctgacccctgaaagctgactcatttaa

SEQ ID NO: 169 - DNA, 7574 bp, Homo sapiens
attgcggtttatcatttgcttcacccatttttctacttggacgttgaatttcatgaaaaccacatagcaaaaataagctgttaagagaagcaagctttcccaccacatgatgacattatccaggaaaaatatgatcagcatgatcaagtcaacaatgtagaaagacacatctcgaaagagcggccaccatgtcaggtttaagatttctctagaaaacagagcacacatgccaataacaaagaggatgttgaatactgctgaacctacaattgtgcctatgccaacgttgctgtgagcgataaatacccctatgagagatgtgaaaagttctggggctgaccctcctgcagccatgaaggtggctccagccacatcatcagagatgcccagtttttcagtgatgacagtcaaagaaggaacaaagaactcatcacagacaatggctaaggctatgaacatgtagatcattccaatgacatgcagaatgatcgcaccttttcttctctcctcaagggaaaagatgtctttcgggtagtctccttgggcgtgatctgtactattctcagactcgccttccttagaaagaggtggctgtggagtataatccagaatcttgtcatttaaatctaagagagttctctgatggtaaccctgtgctaccctagggccacttacaacactggcctctcctgtgctctgtgtatctgtctcagaaaaggcactgattgaaaatgagacagtgctaatggctaccagacccatgaaaaggcctaagactcgaattaacttcagttttttcttgacactataatgtcttctgcagccagacagtgactcatccaaacaccatttctctagggaagtgatggtggtgctttgttgcagatccatcctgggtcttctggtggatatggtgatcttccaactttagactcaaccagatggttctttcatacttttccttactttatagttaacgatgcttgtggggtactttcacaatcagggattgttatgcttcacaggaaactttcatcatttatgcttaaataaaaataaaaacgagaataagtaaatcataaaatcacgtctttttaataaagatctttgcagatatgataaagtcctgtcctgcagctgtgcgatcttgggtaagttacttaacttctctgtgcctcagtttcctcatttaaaatggggacaattacggtacctaccacccaggattgttttcaagatgagtaaaaacatatgtagcacttagtatgggatgtggcacttatgaagatgtatgtataaacccaaataaatattttggtaaatccaatgttaggtgcagagaaggcagatgtaagaataaaaattttacaggtgaaaatctatcagattatctcaccttaaatcatgtaataaccttccagtgctataaaggtacctagacttctttcagaactgtctaggtacttggcaactaacaattattcattgtttacttttggtccaattacataattctcagttgtaggcaactttttctgatttaacctatcatttggaaagtgagtgattctttaatttagtgatcttttttctgcacacataatgatatcagatcttatttttcataaaaagtctctcctttatcagatgcgggaaagtagtcctttacaaatttaagtttacaaaaaaaaattctggtgacatgcacaagctgccttccctaaacatctagacattgttttcagctaaatattttttttaaaaaaacaacctttagtcatatttaaaataggcagcttagtaagtcaaagaactcccaatgcagtgaaataacaagtaggctatttcgagagaccacatgtgtatttcataaacaatacgcaagttgtagcaatacctctgtccacaaaatctgcccaaaatagccccaccactgactttaataggttagatatccaaagcagagttttctttctctatcccacggaggagatgggtaaaatagccagacttgacagctgatattctgaagagttctctttttagtttttctttaaaaagactattcttttccatatcaacgatttcattttggaggcagtcgctgagataatctcaggtgtaaaataagctaattaaacacacgccacttaaatactgagattagctggagctcaggttttcagagcaaagcaagagcacaaatcaaccccgctgagttgctgctactcctgagataacccgaccccatcacggagattcccaggtggctgcgaacgtcaacgcttagcaggaacgattaagcgattcacagcactcaggggattgtgtaaatgcccggcccgggcgaccagcagggacagattcaactccccgggcgcaaagtcatctccagcccgatcctcgctccccctgaaaacccaccgctcgtctccccgggagctgcctccgtaggagaatgttcgcccccagccgcgccccaactttgccttgcgtggtcccaaactttccctggtggattaataggaaaataaatctaaaggacagacgccccacctgtgagcttggagctgggttgcatttggtgaggcgcttggcccgcatccccctgagtcgtttgtaggtggctggggaatggaagcgcccctctgcgcgtctcccccgacggcaggccctgccccacgccccccatcccaagccaaaagcaagggtaggagaggcgggggctccaaatccacgccccggagcacagagagttggctaactcctagcggggcctggggcgcccacatccacggcagagccacctgtgagcctgcagagcagcaacgggatgcgcgcaaccgggatgcggggacgaccgccacagcggctacagcggcaggcggggcgcagccgcccgcacttaccaggataagatgggaggacgcgcacacggcggggcccccgagcgcggcccgccgctccagtccgccggccctccgcctacccgctctgaggcccgggctctggctcgcactggctgccgctctcgccagccgggctgggttcgggaggagactgagccgctgtgagcccggcgctccgagtctggcgctgcccggcccccgccggcccctccctctgggctgtgcgctgtgcgctgggagcggggccgcagcgcgctcagctcccgagtcctttgctccacgcctcctgggcgcagaggcgacgctggcagccgtctcttaggagatttctccgcagtgtggacgggggtcaggatttgcaggcgagcaagggcagagaggagaaatcgtacaggtcggtgacgcgcctaattcacaaagcctgaaagtgctgtcaactttggggtcatcttatgctgggcaccgcctctccaattatctgcaaaaagtgatagcagtcgcgcttttctttaggaggcgatgtgatgtgtaatggtggaaaagacgttcaatgaaaaggcacggaggcctgcaggacaggctgttggggtccagggtttcttgagtgttggatttggatgcttgggacactgcaggggcttcagtcttgcagggtgacctttcatttcatgggtgatgaaagtgagacccaaaaccccgtgtcattttgaatcactgacaggcttcggcttttggcctcgggatgtccagcccagtgctccttcctgtcctatctggaaagcaagatccccttgaccacaagaaatagaatcaggcttgttggggatgagagactagaatctgggccaaagaatggaagacggtggtaagacaaattggtagtgagggaaccccttttacccaaccctgtgaccaccagcaaagctgccaagaggtacccaactcgtgaagctctgaaagcttttcgcacattttcccctctccttaccctccatccttctgttctctcccccatccaagagggtttcttcatgccctccttacaatgggggtaatgggtatatcctgagagctcatgacctctgacttagagtacagctctgtagtcagacctctgggcctactcatcaataagtaaagggaagcctagggaacttagaaatatttttcttccccccaccccccaatcaaagccaggcattcaagactcaacttttctttttctttctcctttcgagactgaatcttgctatgttgcccaagcttgtcttgaattcctgggctctagccatcctccagcctcagactcccaagtgcttgcagactataggtgcctgactgaatttttttatctttaacttttaatttagaaaatttcaaacatatacaaatgtaagaaagtagtataatgaatctccatggggccataaccagcttgaacaattatgaactcatggacagtcatatttcatctatacccctttttcctatgtcatcattttgaagcaaatcccagagcatcatatcattttatctgtaaatattttcagaaagcaagaaaactatcaactaccactagggttgtgtcaagaaggggacaattcaaataggctgtcactgaccaaagacgggctaatttgagcatcaaaaaaaaaaaaaaaaaagataatcgcaattgtttaaaacacatcaaacatgattatatctattaattgataatattttaaaaacaactgaacagattgattgcttgatggttcagagggaaccagctcataattttcaaaactgttttaggaaaaggaaaacaattgtgcatttattttgccttttctatacaaattggacctctgggtaaccaattaggctttatttttaccctgcctttgtctactttcctagtttaacaatcctattcttccctgaggcaataggtgcctctggctacatggggtgcggaggggaatatcacaatgtctagaagagtttttcttatgttatcttctagaatttttatggtttcaggtttttcccctacagctcagagatgaccctgagtcttgattcggtgagaagaggaatgagatccagatgaagacctcatgagtccatagattgtattggctgggatttgcacttggttgcacataataaaaattcattcttggtgattaaaccaaacaagaatttatttttctcatggtaaaaagaagtctgaaagcagactgcccagggtttataaaatagcttcaagatgctatctgggaacccagatcttttgatctgtctttcttaatgtatggctttatcctcatggctacaaaatggtttattcttttgcattacatctgtgttccaggcaggaagaagggaaagagtgaagggtgaaaggcagaaggcctccttgctaggctttgtctttttatttaggaagggattctgtcaatgcttcacttacatttcactgatcacgacttggtcacaagacatagctgcaagggagtgtaaacagtatttcaactgagcacatagtcatcttttagaaaatcagggctctcttagtaagggagaagggggagataaatgttgtgggagtgactactcctacacagttccaaagcatctcaatgagatccatattcgactcaagatttgacagttgaccaagaacttggcaattaattgccacaacagttgagaaggctacaacttccatcctggtagtaatggagaaaagcagggcctgtcatttgtccaaatcacactacgtggaagcagaggaattgaataacaactgtaggtctcccagatccacagaccttattgcctagtcataaagaaagggtagcttcaggagaaaatttactaccatcaaatgagttattaaacagtagcatttgctaagagactcaagtagattaatcaatgggtctctttttagaaattattaaggagctacttctttatatttgtagatacttgtgtaagtataaacattagttggcctcatatttacccttctattagctgtaagattggttttaacatatagtttataggagtaattggtattaccagttaagaacaatgggctctttttgttttgaagaggaggctttcaaaaatcagtaatgaattttaaaaatcactaggtcatacctaagctaataaaggatttttaatgtaaaactgccaaaggggtgctagttaatagttttgctaagcacccatataattttcacatagttatctaggctggcatgatttaaaataggttaggaatatccccttgccccatctgaaataacatccccagggggccacagtgtctacaattccaccattagaaattcattgctttggctttatattttataatttcaggaatttttaaagaagcaagtagctctggagtcatagtaatgattagcaattttttattgtttttgacttgacattcagtctcaagggaaaaaaattctagtaaactgtcatgagcagaaggtgaaagagatggttgagggccaggtgtgggtgtggtggctcacgcctttaatcccagcactttaggaggctgaggtggatcacctgaggtcaggagtttgagaccaacctggccaacatggtgaaaccctgtctctactaaaaatacaaaaaaaaaaaaaaaaaaaaaaaatgctgggtgtggtggcaggtgcctgtaatcccagctacttgggaggttgaggtaggagaatcacttgaacctgggatgcggagggtgcagtgagccgagacggcgccattgtactccagcctgggaaacaagaacaaaactccatctcaaaaaaaaaagataggatagctgagtcagaaagttgtgggcaacccagggacaaaataaagtacagtactcatacttactttgttaatcatttctttcttcattctctccacatatacaaccttttttctgacttattaaaatctctagcttctctgttattaaaattgcaggcagtcagcacacttatgaagtattcaatgtgcacaaaaccagtagttccaaacctcgactttagctaaacaaaagaactggggttatttttaaaagactcctgacaatgaccctcactctcctcccattactgtgagccccgtgagaacaaagagtcagtatcatgcatttctcagcatctagccctgcgcttggcattttggctaacacatatctgtggagtgaattaagatgatggcaaatacagttacttaaaggaaggtgagtcaatcaggaggatgtaggttatgttatgataacaaaaagttcaaaaatcacagtggcttaaaacaatgaaggtttttgtttctcacttgtgctacctgtcctttgtgaagtttgctgtgtcatcctaactcctaaccccaagctggtcactatctagaacactgccatttgctgttgcagggagaaaagatgcatggcaaacctagaacttgcttttaaagcttcagcttggaagtggtgcatcactgctgctagtatctcatggactgaagcaaatcagatggtcatatctattttcaagggagcaagaaagtgcagttgcattgtgtgcttcagagaagaatggaaagatttggtgatgatcaataataactaccacaatgggcatcagtggtggaaaa

SEQ ID NO: 170 - DNA, 7630 bp, Homo sapiens
acagtgaaatactattcactcccaacttttgtctgattctacctctatgtcaaggcaatgcactcaccatctgtcataggatcttacaaaggtggaatcccatgttctgcctgacagccgggacttcctgcagctggagtctcttaccaatggctgtcacatcctagttctgaatcttaaccccttccattggtatgcctaaccattaatgtattcaacaattacttactgagcatctctgttctaagtgctagggatacagtagtaacaaaaaaatggtcctgcccttgtgaggtttacattctagtaggagaatacagaaaataaacaaactaatgaataactgttaggcagacaaatgttaggaagaaaaatgaggtagagtatgaggataaaacctgacagggtaacaggcaggtggaagacttgtgtgatgagacaacacatggtaacaaacctgaatgaaaggaaggagtgagcaatgcggaaacttgggaaaaggccaagtgtggtggctcatgcctataatcccaacactttgggaggcagtggcaggaggatgtgatgggaagccattagcaggttttgattttatggagctaatatgatcagatgtatagtctaaagggcctgctctaaaggctacttactacagaattccctttctatgacattctggaaaatacagaagtataggggcagaaaatagatcagtggggatggagtaaagggatgaccacaaagggagtagtgtaagagaatctggggagcagttctgtatcttgatttaggtggtggttatacaactgtatgcgtctacaaaactcctgagagtgtacactcaaaagtgaattcaattcaaagaaagtagaacatagacacacccagcctactctggctgctatgtaaacaacataccccctatggcagggggatatggcaagaagggagatcaattaggagactattacaataatccaggcaaagataatggtagcctcaactagaatggtagcagtgaaatttataaaatgtgtttggattcagaatataatatgaaaatagaggcttggcacagtggctcaggcctgtaagatcccagcactttgggaggccaaggtgggcagattacttgaggtcaggagctcaagaccaacctggccaacatggtaaaaccccatgtctaccaaaaaatacaaaaattaactgggcacggtggcacacgcctgcagtcccagctacttgggaggctactgtgggagaattccttgaacctgagagacagaggttgcagtgagccgagattgcaccactgcactcaaacctgggtgacaaagagagacttgtctcaaaaaaaaaaaaaaaaaaaaccagagcctagatttgcacatacttttcatctcccagtgtcagtctctcataggagcactgatggggtacaagtgcttcttatagtctcttatgtaatttttaacctaaaacaaaaatagctcaaactactgccagattctaactgtcttcagagagaaaaccattttcaaaaatttgtattttaaatacttgaaaaaaatttgattagtataattttgattgttatataaaatatatattattttatgactaatttacattatactaattcagtcttaggtttgcctcattgaatttgcctaagtaggaaagtttaactagctgaaaagaataaaactgcattcaatttctctaaaagcattcacataataatggttataggaggccaggcgcggtggcttacgcctgtaatcccagcactttgggaggccaaggtgggcggatcatgaggtcaggagatcgagatcttcctggctaacatggtgaaacctcatctctactaaaaatacaaaaattagccaggcgtggtggcaggcacctgtagtcccagttacttgggaggctgagacagaagaatggcgtgaacccgggaggtggagcttgcagtgagccgagatctcaccactgcactccagcctgggtgataaagcaagactccatctcaaaaaaaaaaaaaaaattgttataggaaccaaaaattcattcataataagttcctaaagcagacactgaagtacagttttttctacttaacagtatcttcctcagtatcttagaagtatgccggaatggtggaactttaaaatgaaaatatgcagctgggatcatttatttcgtgatttgaaagctacagggcccacattaccatgggtctgtgaaatcatcaatgaaggtccacaaaagtggttcaaaaagcatatagaaattattccttagctatgacaaagcctgagtaagcttaaaaaaaaaaaaaaaaaaagcctatattcgctgggcatggtggctcatgcctgtaatcccagcactttgggagaccaagccgggtggatcacctgaggtcaggagttcaagaccagcctggccaacatggaaaaacgctttctctactaaaaaaaacaaaaattaggcagcatggtggcatgcgcctgtaatccagctactcgggaggttgaggtgcaagaatcacttgaacccaggaggcggaggttgcagtgagccaagattgcaccactgcactccagcctgggtgacagagtaaaactccatctcaaaaaaaaaaaaaaaaacaacctatattttaaatgtttttatattaaagtgggaaaataattattcaacatttgtaatatgtaattgtaatatgtagtttagtatacaaatttttcaaaacatattgtctgtaaaagaaacctaaaaaataaaacaagttcttggtgaagaagccagttgatctggtttggttctgtgtccccacccaaatttcatcttgtagctcccataattcccacgtgttgtgggagggagacagtgggagatgactgaactatgggggcaggtctttcccctgttgttctcgtaatagtgaatgggtctcacagatctgatggctttaaaaatgggagttgccctgcacgagctctttttgcctgccaccatccatgtgagatgtgacttgtccctccttgccttctgccgtgattgtgaggcctccccagccacgtggaactgtgaatccaattaaacctctttttttttttaaattgcccagtctcaggtatgtctttatcagcagcacaaaaacagactaatatagcaaattggtaccagtagagtggggtgctgctgaaaagatacccaaaaatgtggaaccaactttggagctgggtaacaggcagaggctggaacagtttggagggctcagaagaagacagaaaaatgtgggaaagtttggaactcactggacacttgttgaatggctttgacaaaaatgctgatagtgatatggacaatgaaatccaggctgaggtggtctcagaaggagatgaggaacttgttgagaactggagcaaaggtgactcttgttatgttttagcaaagagactggcaacattttgcccctgccctaaagacttatggaactttgaacttgagagagatgatctagggtatctggcagaagaaatttctaagcagcaaagcattcaagaggtgacttgggtgctattagaagcattcagttttaaaagggaaatatagaataaaagtttggaaaatttgcagcctgacaatgcagtagaaaagaaaatcccactttctgagcagaaattcaatccagctgcagaaatttgcataattaacaaggagctgaatgttaatccccaagacaatggggaaaatgtctccagggcacgtcagatgtcttctcggcagcccctcccatcataggcctggaggcctaggaggaaaagatggtttcatgggccaaacccagggctcccgtgctctgtgcagcctaaggacttggtaccctgcattccaaccactccagccatggctaaaagggagcaaggtagagctcaggctgttgtttcagagggtggaagccccaagccttggcagcttctacatagtgttcagcctgcaagtgcacagaagtcaagaattgaggcttgggaacctccgcctagaatacagaagatgtatagaaacagtctgtctgggcatggtggctcacgcctgtaatctcagcactatgggaggctgaggcgggcagatcacctgaggtcaggagtttgagaccaccctggccaacatggtgaaaccctgtctctgctaaaaatacacacaaattagccaagcgtggtggcacacgcctgtaatcccagctacttgggaggctgaggcacaagaattgcttaaaccttgaaagcagaggttgcagtgagccaagatcaaaccactgcactgcagcctgggtgacagagtgagactctgtctccaaaaaaaaaaaatgtatagaaatgcctggatgcccaggcagaagtttgctgtaggagtggggccctccaggggaacctctgctagaatagtgcagaaggaaaatgtgggtgggagcctccacacagagtccctactgggacaccacctagtggagctgtgagaagagggccaccatcctccagaccccagaatggtagatctactgacagcttgcaccatgcacctggaaaagcagcagatactcaatgccagcccatgaaaacagccaggagaggggctataccctgcaaagtcacaggggcagacctgcccaagattatgggaacctatgttttgcatgagcttgacctggatgtgagacatgaagtcaaaggagatgattttggagcttttcgatttgattgtccactggatttcagacttgcatggagcctgtagcccctttgttttggccaatttctcccatttggaacagctgtatttacccaatggctgtacccccattgtatctaggaagtaactaacttgcttttgattttacaggctcataggcagaagagacttgccttgtctcagatgagactttggactgtggacttttgagttaatgctgaaacttttgagttaatgctgaaatgagctgagactttggaggactgttgggaaggcatgattacaatgtgaaggtattacaatgtgaagatatgctatttgggatgtgccagggcagaatgatacggtttgactctgtgtccccacccaaatctcatcttgtagctcccataattcccacgtgttgtgggagggacctggtgggagacgactgaattatggggcaggtctttcctgttgtctttcctgttgttcttgtaatagtgaatgggtctcatgtgatctgatggttttataaatgggagtcgccctacacaaactctatttttgcctgcctccatccatgtaagatatgacttactcctccttgccttccaccatgattttgaggcctccccagccacatagaactgtgagtccaattaaacctctttcttttgtaaactgcccagtctcaggtatgtctttcccagaggcatgaaaacggactaatacaccagtgaatcacacacattgagactgaggtccaaaaaggctgaatccttagcccctagttatataccaagctggtggcaaagccaggatcacaggttccaactattaagtcctggtctaatacccattccctcaccctgagaatccctgaaaactataacatgtttatagagggcaggaagtatctcactttctagtacataaggtacctaggaaagtatcttgcagtaactgcttgatggatgaaaacaataaaaatgaacttcctttaaatgattatataatttagatattcctcaaattcaaatctgtctctcctccaaattattctgaattaattaggatttatgataactagcattaactaaagcaataattacattcaatagatttctagaaaggctgggccttcgattgaagtttcatcaactattcatgacatttgtagaattgtatataagaaagcaaaaacttagagacataggaacaaagagagtatttagaaattctgctatgtataagatacatatcttaaggtaataaaatgtatcttaagggaataaaaatcctctctcaaaacttgtttcagtgatttatatacatacatagtttgtgctaagttataaaatacttcctacagtggatagctacaaaaagtttgaaagcctctgttgcagaacttaccatttttttggcatgttcttcacacagaggtgtctgatgtgtaatgtcaaaaactggcacagagcactgctgtccatctgcaaacttggctgtgcaacttgagaagagctgctgagagtggttcaagaggatatctgggtttttttaagttaggagtaaaatacactgaaactctaatttttcaatttctatataaaatttgcttgttcccttacatttcataagtacaagctttattatccataatataaatattacccatatcagtactagctcaactactgatatgggaaaataatagaatttatcagatgacaactctgaaggactctattttgctaatgagaccctggcaccagtctccttaatgaccattctgaaccaaattgtgttatttggaaaagcagggccatttccttcttaacatgtgaactccacttaaagttccacttcatgttttttttgttttgttttttgttttgagatgaagtcactctgttgcccaggctggagtgcaatggcacgatctcagctcactgccacctcggcctcccgggttcaagcaagtgattctcctgtctcagcctcccgagtaactgggattacaggcatctgtcaccacatccagataatttattgtatttttagtagagacagggtttcaccatattggccaggctggtctcgaactcctgacctcaagtgatctagccgcctcagcctcccaaagcgttgagattataggcataagccactgcacctggccaatggttttctttttttaaacagctcttaaaaggaaaattttctgcctatgatacttaccaagaataaaaatttaaagatatagttattagaaactcatctttccaaatttgaatattttgcttcacacttccagcaacaaactcaaactcacaacccatgaaaaattacttttaaatcaaaacttcactattggccaggcacagtggctcacacctatactcccagcactgtgggaggctaaggtgggttgatttattgagcctcagaagttcaggatcagcctgggcaacaaaaaagtacaaaaattagtcaggcatggtggtgcatgcctgtagtcccaggtactcaggaggctgtgatgcaaagatcacctgagcccagggaggtcgaggctgcagtgagctgtgatcgtgccactgcacttcagccggggtgacagagtgagatcctgcctctaaacaaacaaacatgagctttacatcatcaatatttttaagcactcatacttttagctactacatttccttaacacttaccttatatctattaagtgcctttgtgtttttcctttatggtttttaggtaaaactataaagcctttattacatagaaagtgctgctgaacaagctgttccaagaacagaaaggagggcaacaattaaatagatggtaaagataagtaattgctgctatttttaca

SEQ ID NO: 171 - DNA, 7694 bp, Homo sapiens
atccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctagga

SEQ ID NO: 172 - DNA, 8314 bp, Homo sapiens
cagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaatag

SEQ ID NO: 173 - DNA, 8630 bp, Homo sapiens
acaaaaaatgatcgaatatcatgctgtttttctttttcgaactaggaaaagcaaacagtagttatcaaagtaagaagcaatctaatatgttcttcttacataaaagagcttaacaaaatattttaattaaccatattgccttatcctttaaataccttttggaaatgaattcattatgctctgactcttcatatatacatatataaatatatatatgtaaaacatatccatgtacttcctgtgtctaacttttttctcagcacttattgtgtgccaagcatttaacatatattaactcatttaatcctcacatcagctctatgaagtcaatactagtattattataacatttcggaagaaactgcagctttagagaggtaagataacttggttagagcagttatataacaaaaatatacttaatacattaccctaaatatatgtcacggaaaaaaaggcaactgtgtattcaaatatttcaggtcaatcaaggacctaaaaaaatgctttcacacctaaaatataaacacaatgctcacacataatgttattcatatgaaaatgttttcttgaccaggaagctgttaattaggctgggtgcggtggctcatgccgataatcctagcactttgggaggctgatatggcaggactgcctgagcccaggagttcaagactagcttgggcaacacggtgaaaccccgtcactacaaaaaaacacaaaaaaacaaaaaacaaaccccaaaacaaaaattagccaggagtggtggtgtgcacctgtagtcccagctactcggggagctgaggtgggaagactgctggagcctcggaggttgaggctacagtgagctgtgattgtgccactgcacttcagctgaggcaaaggagtgagaccctgtcaaaaaaaaaacacacacaaaaaaacgggggatggagccaagatggccgaataggaacagctccagtctacagcttccagcatgactgaagatgggtgatttctgcatttccaactgaggtaccaggttcatctcactggggagtgtcagacagtgggtgcaggacagtgggtgcagcgcactgagcattagctgaagcagggcgaggcatcgactcacccgggaagcgcaaggggtcagggaattccctttcctagtcaaagaaagaggtgacagatggcacctggaaaatcgggtcactcccaccctaatactgcgcttttccaacggtcttagcaaatgccacaccaggagattatatcccgcgcctggctcagagggtcctacacccatggagccttgctcattgctagcacagcagtctgaaatcaaactgcaaggctgcagtgaggctgggggaggggcgcctgccattgctgaggcttgagtaggtaaacaaagtgcctggaagctcgaactgggtggagcccaccacagctcaaggaggcctgcctgcctctgtagactccatccacctctgggggcagggcacagccaaacaaaaggcagcagaaacctctgcagacttaaatgtccctgtctgacagctttgaagagagtagtggttctcccagcatgcagctggagatctgagaatggacagactgcctccttaagtgggtccctgaaccccgagtagcctaactgggaggcagcccccagtaggggcagactgacacctcacatggccaggtactcctctgagacaaaacctccagaggaatgatcaggcagcaacatttgctgttcaccaatatccgctgttctacagcctctgcttctgatacccaggcaaacagggtctggagtggacctccagcaaactccaacagacctgcagctgagggtcctgactgttagaaggaaaactaacaaacagaaaggacatccacaccaaaaccccatctatacatcaccatcatcaaagaccaaaggtagataaaatcacaaagatggggaaaaaacagagcagaaaaactggaaactctaaaaatcagggtgcctctcctcctccaaaggaacgagctcctcaccagcaacggaacaaagctggatggagaatgactttgacaaggtgagagaagaaggcttccgacaatcaaactattccgagctaaaggaggaagtttcagccaatggcaaagaagttaaaaaccttgaaaaaaaattagacgaatggctaactagaatacccgatgcagagaagtccttaaaggacctgatggagctgaaaaccatggcacgagagctatgtgatgaatgcacaagcctcagtagccgatttgatcaactggaagaaagactatcagtgatggaagatcaaatgaatgaaatgaagcgagcagagaaatttagagaaaaaagaataaaaagaaatgaacaaagcctccaagaaatatgggaccatgtgaaaagatcaaatctacatctgattggtgtacctgaaactgatggggagaatggaaccaagttggaaaacactctgcaggatattatccgggagaacttccccaatctggcaaggcaggccaacattcaaattcaggaaatacagagaacgccacaaagatactcctcgagaagagcaactccaagacatacaatcgtcagattcaccaaagttgaaatgaaggaaaaaatgttaagggcagccagagagaaagctcgggttacccacaaagggaagcccatcagactaacagcggatctcttggcagaaactctacaagccagaagacagtgggggccaatattcaacattctcaaagaaaagaattttcaacctagaatttcatatccagccaaactaagcttcataagtgaaggagaaataaaatcctttacagacaagcaaatgctgagagattttgtcaccaccagacctgccctaaaagagctcctgaaggaagcactaaacatggaaaggaacaaccagtacaagccactgcaaaaacatgccaaattgtaaagaccatcgaggctaggaagaaactgcatcaactaacgagcaaaataaccagctaacatcataatgacaggatcaaattcacacataacagtaataaccttaaatgtaaatgggctaaatgctccaattaaaagacacagactggcaaattggataaagagtcaagacccatcagtgtgctgtattcaggaaacccatctcatgtgcagagacacgcataggctcaaaataaagggatggaggaagatctaccaagcaaatggaaaacaaaaaaaggcaggcgttgcaatcctagtctcggataaaacagactttaaaccaacaaagatcaaaagagacaaagaaggccattacataatggtaaagggatcaattcaacaagaagagctaactatcctaaatatatacgcacccaatacaggaacactcagattcataaagcaagtccttagagacctacaaagagacttagtctcccacacaataataatcagagactttaacaccccactgtcaacactagacagatctacgagacagaaagttaacaaggatatccaggaactgaacccagctctgcaccaagcagacctaacagacatctatagaactctccaccccaaatcaacagaatatacattgttttcagcaccacacctattccaaaattgaccacatagttggaagtaaagcactcctcagcaaatgtaaaagaacagaaattataacaaactgtctctcagaccacagtgcaatcaaactagaactcaggattaagaaactcactcaaaaccgcataactacatggaaactgaacaacctgctcctaatgactactgggtacataatgaaatgaacgcagaaataaagatgttctttggaatcaatgagaacgaagacacaacataccagaatctctgggatacattcaaagcagtgtgtagagggaaatttataccactaaatgcccacaagagaaagcaggaaagatctaaaattgacaccctaacatcacaattaaaagaactagagaagcaagagcaaacacattcaaaagccagcagaaggcaagaaataactaagatcagagtagaactgaaggaaatagagacacaaaaaacccttcaaaaattcaatgaatccaggagctggttttttgaaaagatcaacaaaattgatagaccgctagcaggactaataaagaagaaaagagaagaatcaaatagacgcaataaaaaatgataaaggggatatcaccaccgatcccacagaaatacaaactaccatcagagaatactataaacacctctatgcaaataaactagaaaatctagaagaaatggataaattcctcaacacatacaccctcccaagactgaaccaggaagaagttgaatctctgaatagaccaataacaggctctgaaattgaggcaataattaatagcttaccaaccaaaaaaagtccaggaccagatggattcacagccaaattctacgagaggtacaaggaagagctggtaccattccttctgaaactattccaatcaatagaaaaagagggaatcctccctaactcactttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaagtgggcttcatccctgggaagcaaggctggttcaacatacgaaaatcaataaacgtaatccagcatataaacagaaccaaagacaaaaaccacatgattatctcaatagatgcagaaaaggcctttgacaaaattcaacaacccttcatgctaaacactctcaataaattaggtattgatgggatttatctcaaaataataagagctatctatgacaaacccacaaccaatatcatactgaatggacaaaaactggaagcattccctttgaaaactggcacaagacagggatgccctgtctcaccactcctattcaacatagtgttggaagttctggccagggcaatgaggcaggagaaggaaaaaaagggcattcaattaggaaaagaggaagtcaaattgtccctgtttgcagatgacatgattatatatctagaaaaccccatcgtctcagcccaaaatctccttaagccgataggcaacttcagcaaagtctcaggatacaaaatcaatgtacaaaaatcacaagcattcttatacaccatcaacagacaaacagagagccaaatcatgagtgaactcccattcacaattgcttcaaagagaataaaatacctaggaatccaacttagaaaggaagtgaaggacctcttcaaggagaactacaaaccactgctcaatgaaataaaagaggatacaaacaaatggaagaacattccatgctcatgggtaggaagaatcaatgtcatgaaaatggcgatactgcccaaggtaatttatagattcaatgccatccccatcaagctaccaatgactttcttcacagaattggaaaaaactactttaaagttcatatggaaccaaaaaagaacccacattgccaagtcaatcctaagccaaaagaacaaagctggaggcatcacactacctgacttcaagctatactacaaagctacagtaaccaaaacagcatggtactggtaccaaaacagagatatagaccaatgggacagaacagagccctcagaaataatgccgcatatctacaactatctgatctttgacaaacctgagaaaaacaagcaatggggaaaggattccctatttaataaatggtgctgggaaaactggctagccatatgtagaaagctggaagtggatcccttccttacaccttatacaaaaattaattcaagatggattaaagacttaccatgttagacctaaaaccataaaagccctagaagaaaacctaggcaataccattcaggacacaggcatgggcaaggacttcatgtctaaaacaccaaaagtaatggcaacaaaagccaaaattgataaatgggatctaattaaactaaagagcttctgcacagcaaaagaaactaccatcagagtgaacaggcaacctacagaatgggagaaaatttttgcaatctactcatctgacaaagggctaatatccagaatctacaattaactcaaacaaatttacaagaaaaaaacaaacaaccccatcgacaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatgtagaactagaaatactatttgacccagccatcccattactgggtatatacccaaaggattatcaaacatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaactaaacaccacatgtcctcactcataggtgggaattgaacaatgagaacacatggacacaggaaggggaacatcacacactggggcctgttgtggggtgggggaaggggggagggatagcattaggagatatacctaatgttaaatgacgagttaatgggtgcagcacaccaacatggcacatgtatacatatgtaacaaatctgcacgttgtgcacatgtaccctaaaagtataactaaaaacaaaaaacaaaaaacaaaaaaacctgttaattaggacagcttctttagtagacacattttaataataaccttgttttcaagaaatgttatttcttttgtttaagaacagctacatcattgcatgtttttcatcttttcaatgtgtgaatctcagtttcctaattagagtaagtaggatacctatctccatggttaattagctacagttagggcaaattaaaggatttagtttcagaggtggagttgggaactatgttagaaacacagtgtggctgaatatattttcaatgatggtcacaccaattcttatgtcatttcacatgctcttcatacaatgtgacactgacatgcctccattgagaggtgggatctatgttcttcttccttgaacgtgagtagacctttgtaactgtctcacccaacagaatgcagttaaagtaatgctgtgtgactttttttttttttttttgaggcagagtttcactcttgtctcccaggctggagtacaatggcgcaatcttggctcactgcaacctccgcctcccgaaagtagctgggattacaggtgttcactatcacgcccagctaatttttgtatttttagtagagatggggtttcacctggttgcccaggtgggtcttgaactcctgacctgaggtgatccacccgccccggcccccacaaagcgatgggattacaggcgtgagccaccgtgcctggccaatgctgtgtgacttctgaggctaggtcattgaaggtaatatggcttcaacttggctggccctctgtctctccctttctttctctcttgggacacttgccttgggaacctagccaccattggtatgaggaaacccaggccacatggagaaatcctgcggtgttccagttgacagccccagaaaagctcccaggtgacagacagcaccaattgccagacatgtgagtgaacaagccttcagagaagttttcagcccctggcatgggtgtcttccatcaagggccacagtcatcatggaggagacatgtcattcctgttgtaccctggttgaatactgcacccatagaaactataagaaataatacaaggctattgttgtcttaagacactaagttttggagcaatttgttatgcagtaatagataactaagacagaccctgtagataatgatagcaaaataccatatattgtaaatgatattttacataatgaatattatctgtacttcttagtggtactatataagaaagaattataaaattcataaaaacagaaagattagtggttaccagaggctggaggggaaggggaaatggagagtgattgctacataattatagactctctggggtaatggaaaatttttggaaatactggtggtgggtgcacaacacactgtgaatgtaatgacactaactgtacacttaaaaatggttaaaatgacaaattttatttaccacagtataaaaaatcaaaaaaaaaaggaagcgaaaaaataaggaaggaaaatttaggctgttcccatatttgtaaaattaaaacatgttatcatagggaaaaagctctctcccc

SEQ ID NO: 174 - DNA, 9120 bp, Homo sapiens
ccctgtgtctaagaagtatgagaattacaatattgggtagcagagactgataaagatggtgatataggttgagcatcccttatccaaaatacttgagacagaaagtgtttcaggtttgatttttttattttgtattttggactattttcatatatataaaatcagatatttggggatgagacccaagtccaaacacaaaattcatttgttttcatttcatttatatatgccttctacacatagcctgaagataattttatacaatatttttgtgcatgaaacaaggttttttgtttgttttaagacagggtctcactctatcaaccaggctggagtgcagcctcaacttcctgggcttaagcaatcctcccacctcagcctccctagtagctgggagaagaagcatgcatcaccatgccctgctaagttttaaatttttttattgtagagatgggaatcccactatgttgcccaggctggtctcaaattcctgggctcaagtgatcctcctgccttagcctcccaaacagctggattacaggcataagccactgtgcccagccccatgaaacaaagttttgactgcaatctatcacatgagatcaagtgatggaatgaaatttttcacttctgacgttacgtcggtgctcaaaaagtttttgattttggagcatttcagattcgagatttttgcattaaggatgctcaacctgtacttgtgtgccaatgtctgatgggaatggtggccccctgtttcagggagtgaaggcaatgatggatcctgagttctggatatttgtaggaattgcagtagatgagtcttatgtgctgagagatttggagccctgtatttcagagaatgaaggaaccagtggtccctgtgacttgctaactgatgagaacagaacagaggccttatgtttcagaaactaatgggaattatggtcactgttcctggggggcttaagcaagtcccagcctaatccacaagtcatttattattcactcatctcctcattcattcacttagcaaacattttcctgagcccctgctctgagccatgcctgggtggagtgatattgaggacacagaaatgactcagacccagactgtgccctcagtaaattcccaaagacagacccagacgtagaaaatcacaacacaacaggatcagggccaggacaaggactgtgatgtggtgcctgtcctgatctgtctacagggcatccagggtgaatgtagaatgacagtaactctagatcgtaagtgaaagtgaggggtctgacaaagggtccttcttaatcatacatgaatttgtgtgcatgacaagtttaaatgtacccagtgtcaatccttagaaatagcatattttcccagagcaagcccaccccaaagaaggagccagagaggcctgggtttgaatctctagctccatcacatactttgtgagcttgggcaactcgctattcagaactgcatcctattcagtattccatccttacaattgggataataatagtttctaataataaggtttctgtgtaatcaatgatataatgtataacaaatactcatcccaggaactggctccaagtagtcattcaataaagggtatctgttgtcattattattatcccattgttagtaattatcaacaaattttaaaggatctagaagtaagcatttatcgaatatctgggtttagaggcttaaaagcattggacaaaatcactttaaaaatcagcaaatttgggccaggtgtggtggctcagccaaggtgggaggatcacttgaggtcagaagttcaagaccagtccagcaaacgtggcaaaaccccatctctacagaatacacaaaaattagccgggcctggtggcgcaggcctgtagttccaaccacgtgggaggctgaggtgggagaatggcttgaacctggaaggcagaggttgcagtgatctgagataatgccactgcactccagcctgggcaatccgtctcaaaaataaatacatacatacatacatacatacatacatacatacatacatacataagcaaatctgtaaatatcaatatgcataaccattagtttcttgacataaaaaacctcccaatctcccaattaactgaatacactaggaataaatagatgaatacaatggaatattatatcactattaaaatgaatgaggaggttctataagcctagatatgggaggatctttggatatcatgtaaaaaaaaaaaaaaaaaccaaggtgcagaataatgtgatcctatcaggggacagaaaagaggagggtggtatatatgtgcatagatgtataaaattcctctggaaagatacataagaaattagtgaatatatgctgtccccagagaggagaactgggtggctggaggatagggagggagggagatgcactgttgaaagcccagcaccatgcatcctgaacgttttccctggctcttaatgtccactaagttctcagatgcccacagcatctctctcctctaccctcttcttcctcctagttccccattgaaagcaactcctgccccatccgttcctgggccagactcagggagttgtagttttcctacctgtttcccgcccacaggttcctgttctctgcccccagtgcccagcagtctccagccatctccagctcctcacattcctgccccaccccttcctctctccccaggtcctagcccgcaaactgcagggagggggcctcctccccagcctccacccgtctctccccctccactccacacagcctcagcggggtctgacattcagctataaccgtgtccccgccccttgctcacaaccttccagggctccctgtcaccctcagaaggctaagttcccagcctggcctgaaactccctaagaatctgaccccgcccgctcgccccaccagcctcatctcctgtgctccttggctcctggcttcggaggctctagtcagacttaagggctttgttgtcctcccagcacctccttggtttcctgccttgggccttcgcttcagctgtgccctctgcctggaagggccttagtggaggtcatgccacaaccacgccttctctggaggtcctctctgccgtctccagctgccaggattcctcccgccctgggctctcacagcctctggcctctccctgtgtcatacccagatcacccgggattgggactgtctgcggctggctctgtctcttccatcagactgtgagctccatctgcaagggcagattcgggtctgattcacctttgagcccccagtgggtgggggtggggggtggagatactaaagctggtgggggcgaagctgggagagcaggaagggggagagagagacgggcagaccctgactggttcggggagagaggggaggagaaagcgagagagaggaagaacagagacacagagacaggaagggagggagagaaacagagaaaagggaagaataaatgggagacacagataatgccccacaggcagagaaagaggatggagatagggagagggcgaaaggaaggacagatgtgcagagacagaagggaggacagacggaaagagacacagagaggcagcaaaagcaaccaagaatgacaggagcagagaggaggagggaaagagggagagagagagagagagaacgagagagaagggagggagggagagagggagagagagagcgagagagcacgcacagagcgaggaggaggcgcaggagagaagagggagggaggccagcgagggacaggacggggcggagaggcggaggggagctagggaaagccggggaggagcgagactggccgaggaggagggcgggcgagcgggagcgccggccccgccgcctcccggcctcttttgtcccttccctcctctgcgtcaggcttctctggcccggcctccccctcccgctccctcctcctccccggggctggatggaattttttcccctggacctgggccagctccggggcaggggggaagccaggccggactgggctgggcggtggggaggggccggggcggggggccccctggggagggggctggtccgacggccgcgcagccggcggggtccagggagggggagccccggaccgcagagccggggaggaggtgacggccggagggagtcggggagaagggaaggaggatggcggggacggcgggaggaaggggagaggccgccgtgcggcgaaggcggggagaggatggagagcgctcggcggcggtggggcccggcctgcgggcccggggcggcggagaagaccccttccctgcgacgcgggagccgcgggagccgtgagtctgcggaaagggagggtggggggctggggcccgcactcctgggtccctgagggaggagcacccgggggcctggatttcagggttcttggaggaggagttgggggtggggagggtggggtggctgggagcccagactcctgaatccttgaaggagggggctgggacctggatcccggggtccagaatctggagaaggctggggacacttcctggattcaagagggaggacagagatgggggctggggctggtaggatcgtggctggaagagactaggggcgagctgcccgagccctcgggggaggtggaggaagactggctttggagtgcctgcggcagcggaagggttaacgtctggctggaggggagggggaggcgcagggatggggctgcggggctttgaggggtcaagggtgagccgtgccagtgggagggggccgaggaggagggggaggttgtctgggctgccagacaggccagggtcagcggcgggggcaggagatgtctggaggaggagaggcccagcatccatgctccctcggggacccgggattccaggtcccagacccctcctccctcagatctgggagtacaccacccagtcccccacccattccagaatccgagcccccagcccccttttttccaggatccaggagtctgagcccccagtctgttctctcagaccagggaatccacactccagcccctaactccttcaaaaccccagagttcagaacctcagcccctcttcccaaggagcgcggcccccaaccctctgttcctctagaacccaagcgttcaggctccggcatctttctccctttgaagcctgcagttctggggatccccaggcccctcctcctccggaacccaggagtccccacctcctctttagccccagctggagtccagccctccaggggttaagggggcgggaccagctagttgccatggtgccagactgtttgggtctgctctctgacccttgggggctccccagggtccgcagagagggggagggggacctaggcctgggggaagtccagagcctaccccttccccaaagcggggctatgggcccagggagttcgcgtttccaccaacgccttgtccagtgaccttgaacaagtcctgacccttctctctccgcctcagtttccccaaggagacactggttggcgggtgggggagatgcttaggtccggggaatctctgagattctcggcttcccctctcccctcaccctcctcctcaggccccaggcagccccggggcatgctgggaacccaggcctgggctccgggccaggttggtgtgggggggtgggggcgggggcagcctcctcccttccccttcctccccaccttggcctgactctcgcccccgcctgagggtctgggaggttgggaaggagggaagggggaagagagctggccgtagacccgtctccggcccccgcctccccctttcctcctccgcccctttcccgcctctcctccccctcctcaggtcgctaccccagccctgggccccttctcaaaccacccccaccccacccccagctccagacctggctcgagctgcgagggggagggagagagggaaggagaaaagagagagagagaagggagggagacccaaagagagaagggggaggggaggaaagagagagacctaagagggagggaaggagagagagagggagagagacagagactgagagagagcaggagacggaggtgagggatggagagagggaaggggcggagggagaggaagtgaggaaagacatccgaaaaaagggggtggagaagggtgagaaagaggagagagactgagagagggccagagagagaatgagagagacaaagagggggaagggggagaaggggaggatgaaagacagaaggtagaggaaaagcaggagaaagagggggagagaaggaagaaaacagaagcggggagaggagagaggcgatgggcagagagagaagccagcgcagagccagggagggatgtcctgatgcaggaggaggctgggaaccagggaaggtggaaagaaagagggagagagaaaaaggcagggccagagagacctggactgcgagaaaggaaccggaaggtgcgcctggagcaggggcagcgagaaccagacagtccaggaggaggggctgggcacgggagagaccccagctggaggggctcagagcccaggggtggggagggtgggtgctgggtcccggggtccagaagctggagaaggctggggacacctcctggattcaagagggaggacagagatggggctgggcagactttgggagcctcttcccctctctgaggctcagccccctcacctgccaaatggggatgctgagggcacctcgctctctggagtgggaggtgtcagggagaggactggtgctcagggcctggtatggggtcagcgctgggagattgtggctgtcatagttgtaaatgacccaaagaagggaggagagaggaaagaaagcacctagggaggctctgatggttggctagcccctggcctccttagccctgggcctggagtctctgcagactgacaggagggtaggtaggaagcaggtgtgcccaaagggccaaattacgagacaaatgaggttccctcccagccggcacccaggaagccaggttttctatcaggccatgccttccccaggaggcctgcctggccggagggaggaggggctgggggcagggactcctgggtctctggggagaaggaggctttggatctggactcatgagtctgagggaggaaggggctgagtccttggattccaggaacatttggggagaaaagggccagaggcctggattcctgggtctgtggtgaggaagggcctagacttctgggttctttagggaggagggggatgagagccttgactccagggtccctgatgaggaaggggctgagggcctggactcctgggttccttggggaggaggggccgggggcccggactcctgggtcctggcacccacccgtagaaccgaccttgcggggccttcgccgcacacaagctcgtgtctgtgggtccgtgtcgggggctcaccatcgcggctggggcctccccggccctccccctcatccctggtcctcctggtccctgtctgtctgtctgtcgggtctgtccacctgccgcgccccccgggctgaggtaggaggttgtatagttgaggaggacacccaaggagatcactatacggcctcctagctttccccaggctgcgccctgcacgggacggggcccggcggggacccccagccccactcagggacccttagccccactgggctgccccagggaccctgggaggaagagccgggctcttttctgtccttgtccctgcatcccctccttcccctgaaatctgttttccttccctgtctgtctccatctctgctgtgtctctgtggcttctgtgtctctttcacagtggatcctctgactccctcttattctggctttctaggtctctgcccctcccgatatctctctgtgtctctatttctgtcgtttttggtctttctgtctctggctctcagaatgtctctgtgcctatctccatctctgacccccaccccagggtctaccgggccaccgcacaccatgttgccagtctctaggtccctgagaccctttaacctgtgaggacatccagggtcacaggtgaggttcttgggagcctggcgtctggcccaaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcgggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggagga

SEQ ID NO: 175 - DNA, 9207 bp, Homo sapiens
gcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctagga

SEQ ID NO: 176 - DNA, 9228 bp, Homo sapiens
gcaggactcattttctagaccctaagaacagtgtcatgatctgttctcacattgggccaggcactgggtgtggccggcccttcaggggtgtcatctcattttgtctcacagttgcccttgcgcaggagttctcaaaactttttggtctctgaattcctctttttttttttttttttaagacggagtctcactgtgttgcccaggctggagtgcaatggcgtgatctcagctctctgcaacctccgcctcccaggttcaagtgattttcctgcctcagcctcctgtgtagctgggactgcaggcacccaccaccacgcccagcttatttttgtatttttagtacaggtcgggggtttcaccatgttggtcaggctggtcttgaactcctgacctcaactgatccaccctcctcagcctcccagagtgctgggattacaggtgtgagccaccgcacccggcctctggatccctttatgctcttgaaaattattgagaaccccaaagtgcttttgtttatgtgggtggtttgtatggatatttgctgtcttagaaatggaaactgtggctgggcgcagtggctcacgcctgtaatcccagcactctgggaggccggggtgggggtggggggagcggatcacctgaggtcaagagttcgagaccagcctggccaacatgacgaaaccccgtctctgctaaaaatacaaaaattagccaggcgtggtggccagctcctgtaatcccagctactcgggaggctgaggcaggagaatcgcttgaacctgggaggcagaggttgcagtgagccgagatcgcgccactgcactccagcctgagtgacagggtgagactctgtctcaaaaaaaaagaaaacaagtagtttttaaatttttattatttttatttatttttattttatttttttagcagagacggggtttgccatgttgaccaggatggtcttgatctcttgacctcatgatccatctgcctcggcctcccagagcgctaggattataggtgtgagccaccacacccagctgatttttttttttttttttttttttttttgagtcagagtcttgctctgtcacccaggctggagtgcagtggcacaatctcagctcgctgcaacctccgcctctcgggttcaggcgattctcctgcctcagcctcctgagtagctcagattataggcagctgctaccatgcctggctaatttctgtatttttagcagagatggggtttcgccatgttggccaggctggtctcgaacttctgacctcagatgatccacccacctcggcctctcagagtgctgggattacaggcatgagccactgtgcctggccttctagttccttctaaatgcctgtctgcaaacttctcttcatgttgacatcttcctttctctgacctctttccccactccgttccttccttcttaccccttggctgccccaggtatttggcctctgcctcattgcccgctaccccctggagaggcacctccttaaggtcactcgctgtgtgctgggctgtgctccgtgttaactgctgtggccagagggaggaggcactgaactggcactggggaccagaaggcctgggctcccgtcgtggctgggccccttcctaaccaggtggcctccttgcctgaggtgctgttaatgacatgggccactggaaggacagggttcatgaggtcacaggtgagaaagttctctgagaacctgaagatgaggtcaagtctggtactattagagatggccctgatgtcccagggcccccatgtgggggtcttcaggctgtcttcatgctgagctcaaaaccccactgaaagggcagggcaggcttccaggtctgaccatgcccccaagcagatccgggtccctgagctttctagcttctcctggggctccctcctaccccagggcccccacctggggctggcacctggagaccaccctccggggcctcacactgatcggggggtgtctgtgtttgctgtctaggagccgaaggctggtgggccagaagtgtggggggctctgagcaccccccacaatggagcccaaatggggtcctcctgagcccagaagacgaggaggagctcacagcaccaggtacctccagcaccaggtgggggctggccgccctgtgtcggttcctcctgctgctaaacaacttgccgcatattagaggctgaaaacaatgccagtttattctcttagagttctggagaagtcagaaataggtctctcggagctaacatcaaggtgtcagcagggctgagttccttctggaggcccatgggaaagtcccttccttgcctttcccagcctctagaagccgcctgcattcctgggctcatggcctcttcctccatcttcaaagcagctgagtttttctcacgccccatcactggcaccaactcccctgcctccctcttgtgtatttgccattaatctctaatgattgatggggcccagctggataacccaagaggctcttcctacctcaggtcagctgattaacaaccttaatgtcccctgccacagaacacaccatatttatggattccagggattagaatgtggatgccttgggaaggctgttattctgccatcagaccaccgtatctgatgaaacccccgtttttctggtcatagctttgtcatggagggcttcttcagtgccacagggccatagccactgtcatggcccagagaatctgtgtttcccatcagcccctcacccgccaggccactgcaccctaagcccagggccatggcattcttgcaaaaggaaggaggttcttgatcattctgacctctccaccccacagtgaggggaactgtggtctcctggcgactgtctcagccccagaacccagagcctagagcccatctttagccccactgtggctgattcaggacctgccagcacccccgaccagctctgccctttccctccctccctctgccagagaggccggggagatgatgtcacaggtggctgaggagccgtgtgccctgcagccaggaagtcaaaggcgtcgggcccctcgtggggcaggcgctccaagctcagaggcccatgagcaaaaaactcactctgttccatggccactctgctggcatatgtaagaaaaggggcttattcctgaaagaagcgcttgctgggtgttgggcacactgcaggggtgagatggatggacggcctgtcctcatggtgctctcaggccggcccgctcccggggcaccctgagcagctggaggtgagggcatggcaggggagccaggcttctgcctgttgcttacggtggggacacagaaacaaacgtctgggctggctggtgacagcatcagagggaatgaacacatcgaccctctggccagcatgtccaccttctgtattctgcctacgagcactcagtggggcaaagagcaggagctgagggaagataagtatttaggccgagcgcaatggctcacacctgtaatcccagcactttgggaggctgaggttgggggggatcttctgaggtcaggagttcaagaccagcctgaccaatatggtgaaacctcgtctctactaaaagtacaaaaaagttagccagacgtggtggtgcatgtctgtcatcccagctactcaggaggctgagacaggagaattgcttgaacctgggagatggaggttgcagtgagccaggattgcaccactacactccagcctgggcgacagagtgagactccatctccaaaaaaaggaaaaaaaaaaaaagagtatttaatggtgcaagcttggggcagtcccaggaggggctgggtagcctgttggtggactgtgatgcggccggttgtggaacagtgtgtgaaaccatctcacgtgtagaacgtgagtagcaaaggatgggaggggagcattgcgctcgtgctggtgattgattctggaggccgaatcggagtgcagccggggcatgtggccaccagctcccggggctccccgcttcaggccgcttctgcacaggtaagaaattcccccagccaggaaacgctctggggcagagggacacagggactttcagtgtttcgggagctgtccaccaaagctgtggcggggcgcgctacagaatttgagggatgcactgcagaattaaaatcccacccccccagttcccaaatagggggaagtactattaaaggtactaaaatataaacactttttttcccctgcagttttgccctttatttgtcatggtgttttttggtttgctatttgatgccattctaggtaaaggaaaattttaagttattagcatgaaacatataaagttattagcatgaattttaccattctttttttttttttttttgagacggagtcttgctctgttgccaaggctggagtgcattggcgtggtcttggctcactgcaacctctgccttctgggttcaagcaattccctgcctcagcctcctgagtagctgggattacaggcacccaccaccatgcccggctaattttttgtatttttactagagatggggtttcaccatcttggccaggctggtcttgaactcctgaccttgtgatccactcgcctcagcctccaaaagtgctgggattacaggcgtgagccacaatgccaggctgcgtattttgttcttacgaggacagtggaaatactgcacacaacaagcccagccacttttatttcactccttgacacacgcatgttccaccaacatggcacacctctgtggctttctcacgggtaagggaaagaccactgggaaaggaggagggagggtactgggaaaggaggagggagggtggcctgtgtcctttcctcctgggtcacgaacttctgaagaaatgatgggctgatgcagtgaaatgacatgagtcagaaggtaccgcacagcgcttggtggttcgtgtctcagaaaactagtgccttctttccgagttcagggcaagttctgattggaagggaaagcatggcccggggcccagagcacctctgctcactcagccagctcacttaccttgctgtcacctggaggtcccgctaaactcctgctgctgggtgttccctaggaatttcgtgctcatgggcatcgtgaatgctacacatgagcagacggcagcctctctggtcacacgtgtgtgtatcccctccgttcaccctcggactccgtgttccatcggacgtcacttctaaaacccaagttcaaagataaaattattaagaatgtgaagatggtcacagcagagcatgaagccaagtgtgggggcgtgtgtgactgcagaggtgtgggtgggccccctgcagggtctgctgtgcaggaagcttttgattttctacccactgcacttttatcttttttgaatgtttagttgccgataaaatcaacatagacatttaaaatcaagctaaccatatgaagactgtcaaagccttcttctcttgtcttcagagaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccgggcatcccagggaggtagagctcaggttccagtaagtatccccttctgtcctgagagatggggaggtgagaggggtggtctctgaggtccgggcacatttcagatgcccctgtagtctggggggctaccccccatccccaggcatggtacccccccaccctatgtcgggatctcactttgaccgcttctctcgccagcctgcaggagacctccgaggacgtggcccctccactgccccccttccacttccagcggctcctcgccaacctgaccagcctccgcctccgcgtcagtcccggccccagccctgccggtcagtaaagacaaccacatgcccaagacccgagtgcttgccaggtctcagaactgggctgggctccggcggtcacagtcttgtcagggccttgcggccgggtggttattgtcctgttttgccaagaaggaaccttagtcaaaagtcaggacagttgccagaggccatataacctgtgaaggcaatggggatggtggctgaggtcagatgcagggaatggacaggagagaggcctgaaggatgggcctcagaggcaggtgtgcggccagcaagccacccagacccgctgggtgtgctcactccaccttcactggatccaccaagccccctgtccccgctggacacagcccacagccggcagtccaggagtcccctggcagagtgactcccctgctggtcactggcggtattgtacctaagccaccctaggagggtctggtcttcccaaagagggggccaagccatcacacatcattgatgggggtctgtcaccacctcccaccctggtcacagtgattgacagccttagcctctgatctgttcctcattagaacctctacccacacgctattttaaaaatcaatataggtcgggcgcagaagctcacgcctgtaatcccagcactttgggaggccaaggcgagtggatcatgaagtcgggagtttgagaccagcctggccaagatggtgaaaccccacctctactaaaaatacaaaaattagctgggcgtggtggcacacacctgtaatcccagctacttgggaggctgaggcaggagaatcgcttgaacccaggaggcggaggttgtagtgagccaagattgcgccactgcactccagactgggcgacagagccagactccatctcaaaacaacaacagcaacaataacaaaaaacagtctggtggggtggtctgcacctgtaattccagctactcaggagactaagactggaggatcgcttgagcccaggaggttgagactgtagtgactgtgccactgcactccagcctgggtgacaaagcgagaccttgtctctaaaaaaaaaaaaacaaaacaaaaaacaaaacccctagtgtatgtgtgtaaaatgaagctgagctctaggctcagatgtttacaaaggggtttttctacccttccagcaccacgcaggacatttgaaagtcatgtggggagtttctgggaatgtcaatttctgggaactttaggcctcttcatccacatgacaaccaacatgtcctcagatttgcttccaggggagggagattttgctctttttgaggacctctggctcagagggtcagtcttcccctgggcctcttttgagtccaagggtgctgggatgccctggagaagcagaggacatagcgaccctccccagcacccgcaatccccaaacttcctctttccatgggtaatgttttgggaggcctctctctaaacctttctgtgtgtacgtacttaacatctgtatttttttaaaaacatagaaatgtgattacacagccgggcgtggtggctcacgcctgtaatcccagctctttgggaggctgaggcgggcggatcacttgagctcaggagtttgagaccagcctgggcaatatggtgaaaccccatctctactaaaaatacaaaaattagccgggtatggtggcatgtgcctgtaatcccagctactcgggagggagaattgcttgaacctgggaggcggaggttgcagttagccaagatcatgccactgcactccagcctgggtagcagagccagaccttgtctcaaagaaagaaagaaaaagaaagagagaggggaagggagggggagaaagagagagagagagtgagagagagagaaagaaagaagaagggagggagggagcaagggagggaaaagaaaagaaagaaaggtaatcacacagtacgatattctgggacttgctttttgtcagctaacagtgcgtcgtggaggttgttccttgtcattacgcgtagaaagcctggttttctgtgtctggtgtgtaagattctgtggtatgggtgctctgtgaggttttagccatccccctattgacaggcgcttaagtggcctccagttttccccattacaaccgtgtcacagggaatagggaccagcctcatagaaaggtcttggtattccagtataagtgtcgctttaggacagagtgctggaaatggagatgttaggtcaaagagggagcattttccattttgatccacactgccaaattttccttcagaaaggctgctctgatgaggagtgtcggccgcctccagtctccctgttctgtgtctacagatggtcattttcatattttgcccagagtttatagttgttttctgtgggaaggttgatctgccaggatcccctgctcctctgttactggaagcaaaaccttctgattagtattcgtacatccacactcttttttcttttctttctttttttttttttttttttgagacggagtcttgctctgtcacccaggctggagtgcagtggcatgatctctgctcactgcaagctccgcctcccgggttcatgtcatcctcctgcctcagcctcccgagtagctaggactacaggcgcccgccaccacgcccggctaattttttgtattttttagtagagacggggtttcaccgtgttagccaggatggtctcgatttcctgaccttatgattcgcccgcctcagcctcccaaagtcctgggattacaggctcgagccaccgcgcccggcccatttttttttccaaatatcagatttctttatttttaaaatgtacacattatagttgatctaaatacaagatgttcactttccttgcaggtaagaaatgtcactgacatttctgtgtcaattagcttcttttacatcaaaatcctgttacattcattagtctcaaaatctcctataacacttagaactttaggctgggcgtggtggctcaagcctgtaattccagcactttgggaggctgagacaggagtccttgaggccaggagttcaaaaccagcctggacaacaaggcgaaaccgtttttctacaaaaaatttaaaaaattagctgggtgtggtgccacacacctttggtctcagctacttgagcggctgaggcaggaggatcatttgaggccaggagttcaaggctgcagtgagctatggttgtaccactgcactccagcctgagtgacagagcaagattctgtctctcttaaaaacaaccaaaacaacaagaaaaatcttaaaac

SEQ ID NO: 177 - DNA, 9584 bp, Homo sapiens
aagaggttttttttcccctattaacatcaatgtaattcctgtgtgtgtgtgagagatctcagaaagggagagagagtgccaaggtcttgctctgtcacccaggatggagtgcagtggcacgatctcagctcactgcaacctctgcctcctgggctcaagtgatcctcccaactcagccgcctgtgtagctgggactacaggcatatgcctaattaatttttatatttttagtagagacaaggttttgccatattgtccaggctggtctcgaactcctagactcaagtaatctgcccacctcggcctcccaaggtgctgggattacaggcatgagccaccacacccagcctggttcctccccttttaaaccatataaagtaacttctgggtttgccatggcatttgtaaactgtcatggtgccagtgagagtgtcttttagcatgctagtgcattataattaatgtataacaagcactgagagcaactagaggttttgcagtttctttacggcatcctcagaaaacaagtcctgctgacctcataccttaggaatgccatctctgcatttccaaaggcgtcagtgtagtcttttgtaggctgcagtcttttgtaggcaagggataggcagatgctcctaaactataaatgcctgtgcgcgtattaaaaacagatacttctttggtgagactactgaaaaaacagtgctctttgatctggactattgtagaccttctcttacctaatacactccacctggggagatacattccttcatctgttttttgttaaaggcttttaataacttttagtaaaactacccaatatatgcatggaagaaacctgcaatttcacccctaaatacataaaaataaattttttaaaaaagttattgaggccaggtgtggtagctcatgcctgtaattgtagcactttgggaggccaagacaggagaattgcttgagcccaggagcttgagagcagcttgggcaacatgatgagacccccgtctctacaaaaaaaaaaaaaaaaaaaaaattagccaggcatggtggcacgtgtctgtggtcctagctactcaggaggctaaggtgggaggatcacttgagcccaggaggtcaaggctgcagtgagctgtgatcatgtcactgcattccagcttgagtgaaagagcaagacccccatctcaaaaacaaaacaaaaaacttttggtaatgaactataaacgaccctaataggaaaaacacattaagtcattaccagcttgtaacaccattctgtgacttcattgacacgttattatgtatttgtcacttagctttctaatgaccctgcacaattttgttggcagaacaggtggagaggtatgaagaacgaggaacactgcccggggagtttcttcctctgcaaaataagggagtgtgtactgaattaccgtttccagctccaacatccaggatttcagcactacctgcagagtagtgggaggagagataggtaagaagttaaaaagagacctgatggaatacgtggcatcctggtactgctggggtccatccccacacctcatgctcatgagagggagacaagcttcttggagctcctcctcatctacagggctctcctcacagggcctggaagttctgccccagccctgtggggattttctagagtcatttgcctctctttaaagccttggcagagggagccggtgtggggaaggggtggtaacgtagatggcaatgcttgtcagaacatattagagccctcttccacgctctgcagcccctgggcctagggctagcattattctccccttttatagccatctgttgatttcaccttatctcgcactaagcaatgggcttcttgtgggcaggtgctctctctcacccatcttatttctctctggctctttcacggggcctgctgcatggtaagcgctcagtgttcagtgagtgaatggacaggaaggggcagggaagtgaatcaaatctcctcaggttgagacatcagcaccatctgtgatcctttcctcatttggaccttcacatgcaattaggctctaaaatccagtgagtttttttttttttctttttgacggagtcttgctgttgcccaggttggagtgcagtggcgtgatcccagctcactgcaacttccacctcccaagttcaagtgattctcctgcctcagcctcccgaggagctgtgattacaggcgcccaccaccatgcctggctcctttttatagttttagtagagatggggtttcgtcatgttgcccaggatggtctcgatctcctgacctcaggtgatctgcctgcctcagcctcccaaagtgctgggattacaggcgtgagccactgcgcccggtcctaaaatctggtgatttttatttccctgtgtctgtttctacggctgcctccctaagttctttctctgttgggtagtgggcttcggcctagctttctcatcaccgccacacccttccttacccatcctgtacagacagatagatttttctaatgtacattttcagcatatctctgggctgctcagaccatttcctcaactcgacacccaaattaatcagctcactcttccatgttttaccatcctatccgtccttctaataaatacatcctgagcttctggggaggaggtctcatctcagattctctgcccaagccagatggtttcaacatagtcctgcctctgagcccttatgcaagccatctccctgcctgtcccaactacttgcttctatccagagcttggtaagcccacttctcccagagaagcctcctggggtcatcccaggccacttcgaattttctctttggtagcacttggtcacagcaaccttgggcaccaagctgagtatagaatggagtccaatcaatgttgatatgatttttaaatggtggcgacagtcatgtgccatctgaagcaggaatagggaaagagaagcagtgactagcctatacaaattagccaggcgtggtggcaggcgcctgtaatcccagctactcaggaggctgaggcaggagaatcgcttgaacctgggaggtggcggttgcagtgaggcgagattgagccactgcactccagcctgggtgacacagcaagactccatctcagaaaaaaaaaccactctgggaggccaaggcaggtggatcacgaggtcagtagttcaagaccaacctggccaacatggtgaaaccccgtcgctactaaaaatacaaaaattagccgggcacggtggcgggcgcctgtaatcccagctactcgggaagctgaggcagagaattgcatgaacccgggaggcggaggccgcaatgagctgagatcacgtcactgcactctagcctaggcagcagagccagactccgactgaaaaaaaaagagtctacagagcctttcttggaaactagtgtggaaagagaagagcagcatgaaaagccgaggccctgacagcctgatgtcccgctccctccttcacagctctgtgcccagggcctgcctgatgtgcagtgctgcagagaatccagcacactctgctcatgtatgtgcccgggcatgttttctttcttggctacctctttagtcatttgttatgtgttatgaagaaataaactcccagcaaaataatgtcttttgcacagtcttaaagtgatccattacctaagatcatcatagatgattgtgaattgggttgacctgaaatcacctaagaccagggcaggttgaccagagatgaagatggaacatggtatgttgggaactgttgagtactgtgcccttcttactagggcatgtagtttaagtactgtgaaactcaaaacattttatttttcttattgcaaaagtgatacagaattgttctaaagcgtttagaaaatacagacaagcaaaaataaaaatctgccataattccaccatattctagagtatatcttttattcttatttatttatttatttatttgagatggagtttcatttttgtcacccaggctggagtgcaatggcatgatctcggctcactgcaacctccacctcctgggctcaagcgattctcctgcctcagcctcctgagtagctgggattacaggcacctgccaccatgcccggctaattttttgtattttttttaagtagagatgggggtttcgccatgttggccaggctggtctccaactcctgacctcaggtaatccaaccgcctcaaaaaaaaaaaaaattcaatattattattgataagtagggatttactcctaccattttgttatttgttttctggttgttttgccatcttctcttccttctttccttcctgtctttcttttagtgcaggtgattttctctggtgatgtgcttcatttttttgctttttactttttgtatatccattgtatgttttttgatttgaagttaccatgaggcttgcaaatactatcttatagcccattattttaaactgatgacaacacttactgcataaacaaacatgcaaataaatactaatataaactctacagtttaggctgggcacggtggctcacgcctgtaatcccatcactttgggaggctgaggtgggtggatcacgaggtcaggagttcaagaccatcctggccaacatggtgaaacttcgtctctactaaaaatacaaaaattagccaggtgtggtggcatgtgcctgtaatcccagctactcaggaggctgaggctggagaatcgcttgaacctgggaggtggaggttgcagtgagccgagatcatgccactgcattccagcctgggtgacagagcgagactccatctcaaaaaaaaaaaaagaaaaactctacagtttaacttcatccccctgctttttttttttttttttttttgagacagagtcttgcacggttgcccaggctggtgtgcggtgctgcgatcttggcttgctgcaacttctgccttctgggttcaaatgattctcctgcctcagcctcctgagtaactaggattacaggtgcccgccaccatacctggctactttttgtatttttagtagagatggggtttcactgtgttgtccaggctggtctcgacctcctgacatcgagatctgcctgcctcggcctcccaaagtgctgggattacaggtgtgagcccccatgcctggccatccccctgctttttaactttttgttattttcctttatggcttattgtactgtctatgccttgaaaagttgtagttatttttgattggttcatcatttggtctttctacttaagatgagtagtttatgcatcacaatttcagcgttatattattctgtttttctatgtgcctactattcccagtgagttttgtaccttcagatgattccttttgctcattaatgtcttttttgattgaagaaatccctttagcatttgttacaggacaagtatggtgttgatgtaatccctcagcttttgtttgtctgtgaatgtctttacttctccttcatgctcgaaggatattttcactggatatactattataaaaaatttttcctggccaggtgcagtggctcatgcctgtaatcccagcactttgggaggccgaggtgggcagatcacgaggtcaggagattgagaccatcctggctaacatggcgaaaccccgtctctactaaaaaaaaatacaaaaaaaaaattagccgggcgtggtggcgggtgtctgtagtctcagctactcgggaggctgaggcaggagaatggcgtgaacctgggaggtggagctggcagtgagccgagatcgcaccactgcactccagcctgggcaacacagtgagactccatctcaaaaaaaaaaatttttttttcctttagcactttaaatatgtcatgccattctcccctgacctgtaatgtttccactgaaaagtctgctgccagactggagctccactgtatgttactgtttttttttttgtagttgttgtttgtttgtttttcttgcttcttttaggatcctttctttatccttgatctttgggagttagattattaaataccttgaagtagtcttcttttggttaaatctgcttggtgttctgtaaccttcttgtatttgaatgttctttctgtaggtttgggaagttctctgatactatccctttgaataaacattctaccactagctcttcctctacctcctcttcaaggcctataacagatttgcccttttgaggctattttctagatctggtaggcatgcctcattgtttttattcttttttttttttttgagacagagtctcactctgtcacccaggctggagtgcagtggcacgatctcagctcactgcaacctccgcctcccaggttcaagcgatccccctgcctcagcctccggagtagctggaactacaggcatgtgccaccatgcccccggctaatttttgtatttttagtagagatggagtttcaccatgttggccaggctagtctcaaactcttgacctcatgatccgcccacctcggcctcccaaagtgctgggattacaggcaggagccactgcaactggccttttattctgttttcttttgtctctgtgttatctgactgtgtattttcaaatagcctgtcttcaagctcactaattcttctgcttgatcaattctgctattaagagacggacgcattcttcagcatgtcaattgcatttttcaactctagaatttctcgattcttttaaattatttcattctctttgttaaatttatctgatagaattctgaattccttctctgtgttattttgaatttctttgtttcctcaaaacagctattttgaattctgtctttaaggtcatatttctctgtttattcaggattggtccctgctgacttacatagttcatgtggggaggttgtgttttcctggatggtgcagatgcttgcagatgttcgttggtgtctgcattggagaattaggtatttattgtagtcttcacaatctgggcttgtttgtgcccatcctccttgggaaggcttcccagttatttgaagggacttaggccccaagcccaataatgtagttgtttttgcagactcagaaagatcccaccttggtggtcctggataaaatccagaaaaattctctggattaccaggcagagactcttcttcttttcccttattttttgccaaacacatgggtttctcactctgtgatgagccacttggaattgggagtgtggtgatgcaagcacccccgtggccatcaccactgggactgcactgggtcagacctgaagtcagcacagcaccgggccttcccaagacccttcccttcagggcagcgagttcccccaggccctgggcatgtccagagatgctgtctgggagccagggatagcaataaaaaaccttagcaatttacttgatgttctagtctactgtggctaagctggcactcaaaccacaatacaaagtccttctcacgtttccctgccctttccacagggagaggagcctctccatgtggccaccaccaccactggtccacagtgggttctgccaggcaaccgctgatgttcacctaaagcccaaggactcatctgtcagcttgtggtgaatgttaccaggcctgggactcacccttcagggcagtgggtacccctctggcccagggcaggtccagaaatgtccaagcgcctaggcttggacttggagactccaggagcctgcttgttgctctacctcactgtggcctaggtggtacctaggagcacagagcacttcagcccacggtggtggagcctgccgagaaactcaggttccagccgttgggatgggcagttcccccctggctagggctggtgcaaatgttccctccatgcacaggcactggctgagtccagcgcagctttattctcttctgtgacatggcagcactgagttcagtgtgaagtcccctagttgctgtgctctccctttcccaaagtgcacagatcatctctctgttccatatggctgctgccgggggtgggagaggggtggcgtcagtgattcaagactgtctctctgagcctcttcaatggcccttttagcgatatgaggttaaaaccaggtactgtgatcgcttacctgacttttggttcttgtgacggtgcttttttgcaagcagacagttgttaaaatttgatgttccagcaagggcatgaattgtgctctaccttctctactatagattttttaaagtctgcataattttgcattttatgcatgtgccatactgtatttgaccagccttcagctgttcaatgtgaggggctatggtttgaatgtttgtgtccctccaaagttgatacactaaaagctaatacccaatgggataggtttaagaggtggggcttttggggaagtgattaagtcatgagtgctctgctctcatgagtgggattagtgcccttatcaaagaagctcaagggcccctttgccctttttccctttacaccatatgaagatacagcctttgtcccttcaaccatgtgaggacgcagcagcaaggtgccatcttggcatctgctggtgccttgatcttagacttcccagacaccagaactatgagaagtcaacttatattattattttttcttttttctttttttgagacagagttttgctctttttgcccaggctggagtgcaatggcgcaatcttggctcactgcagtctctgcctcatgggttcaagtgattctcctgcctcagcctcctgagtagctgggattacaggcacgtgccactacacctggctaattttgtatttttagtagagatggagtttcatcatgttggtcaggctggtctcaaactcctgacctcaagtgatccgcctgccttggcctctcaaagtgctgggattacaggtgtgagccatcatgccctgccaatttatattatttataatgtaccctgcctgtgatattttgttataccagcaggcacaagtaagacatgagttaacttcattaaaaaaattatagacagtaattcactgaacattcttaccattaagtcttactacacacccttgattattcctttagaataaacttttgggaatagaatcactaggtcaaaggtcgtatgcctatttaaaactttgttattgagaaagcttgtgctaattttattgacagcagtggatgagagtgtctctgcttcctcaagtttttaccatcactggttattttatgtgtgtgtgtgtgtgtgtgtgtgtgtgtgtgtatacatatatatatatatatttttttgagatggattttcgctcctgttgcccaggctggagtgcgatgccatgatcttggctcactgaaacctccgcctccggggttcaagcaattctcctgcctcagcttcccaagtagctaggattacaggcacccaccaccacccctggctaatttttgtatttttagtagcgatgaggtttcaccatgttggtcaggctggtctcgaactcctgacctcaggtgatccgtccacctaggcctcccaaagtgctgggattacaggtgtgaaccagtgctcccggcct

SEQ ID NO: 178 - DNA, 10607 bp, Homo sapiens
aggtgcatcacatcctcagcgatttccaccagggtaagagatgctccctgcaaacgcctcccaagggtctgctcccagcctaggcaggtgatcctgccctggggagatcttgcattagtggatctcccattgtggagaggagccacaggcctgcacagcctaggtggggtcgggggtgagatgatggctccccagtgcccacctgcgacccccagctccctccccagtccctgactcttctctttatacccgtggtggggttgggggccgggtacgtgacgctttttggatcctgtaggggaatttcccactcaccccgttgagactggcctcccttggtgtgtctaaacactggggattcaggctcagtctcctggcctccacttattgagcacctgctgtttgccaggcactgtgctgagcacctaacatgcaaggattctcattcccctttcaatgatgaagtaactgagacctacaaaaggtaggccacttgcctgaggccacataacagttgtgagcactgcatttgtcagctcctgagttttgctcctttttttttttttttttttttttttttttggacacagggtcttgctgagtcaccaaggctgaagtgcagtggtgcaagattgcacagcacagctcactgcagccaccacctccctgggctcacgtgatcctcccacctcagcctcctgagtagctaggaccacaggtgtgcaccaccgtgcccggctaatttttatatttttttctaaagacagggttttgccatgtctttagacccaggctggtctcaatctcctgggctcaagtagtctgcccacctccgcctcccaaaatgctgggactacaggcgtgcaccaccatgccgagctaatttttgtattttttttttttttttttttttttttgtacagacggggtcttaccatgttgcccaggctggtctagaactcctgagctcaggcaatcccgcccacctcggcttcccaaagtgctgggattatgagtgtccgcgcccagctgttttgcccttaaccgctgtggtggcctataccgtggtccctgactccaggtggcacagccgcatatttaaagaggaaagcagcagagctcggagctctgcattaaaccagaggctgcgtgggccccagcgatgtcccacggagcgccccgcaccttccgcctgtccccaggaaggagcgaggcatcagctgaaacagaagaacctcagggccgacgctggggcggccccagacatgagggccgcgcgccctctgctggaagccgcgcagaaagcaggaccgagagatgcgcggaccggcgccgcgtgtctgggtcctgggtccgggggtctagggtgtcagcgttgggcaggactcattttctagaccctaagaacagtgtcatgatctgttctcacattgggccaggcactgggtgtggccggcccttcaggggtgtcatctcattttgtctcacagttgcccttgcgcaggagttctcaaaactttttggtctctgaattcctctttttttttttttttttaagacggagtctcactgtgttgcccaggctggagtgcaatggcgtgatctcagctctctgcaacctccgcctcccaggttcaagtgattttcctgcctcagcctcctgtgtagctgggactgcaggcacccaccaccacgcccagcttatttttgtatttttagtacaggtcgggggtttcaccatgttggtcaggctggtcttgaactcctgacctcaactgatccaccctcctcagcctcccagagtgctgggattacaggtgtgagccaccgcacccggcctctggatccctttatgctcttgaaaattattgagaaccccaaagtgcttttgtttatgtgggtggtttgtatggatatttgctgtcttagaaatggaaactgtggctgggcgcagtggctcacgcctgtaatcccagcactctgggaggccggggtgggggtggggggagcggatcacctgaggtcaagagttcgagaccagcctggccaacatgacgaaaccccgtctctgctaaaaatacaaaaattagccaggcgtggtggccagctcctgtaatcccagctactcgggaggctgaggcaggagaatcgcttgaacctgggaggcagaggttgcagtgagccgagatcgcgccactgcactccagcctgagtgacagggtgagactctgtctcaaaaaaaaagaaaacaagtagtttttaaatttttattatttttatttatttttattttatttttttagcagagacggggtttgccatgttgaccaggatggtcttgatctcttgacctcatgatccatctgcctcggcctcccagagcgctaggattataggtgtgagccaccacacccagctgatttttttttttttttttttttttttttgagtcagagtcttgctctgtcacccaggctggagtgcagtggcacaatctcagctcgctgcaacctccgcctctcgggttcaggcgattctcctgcctcagcctcctgagtagctcagattataggcagctgctaccatgcctggctaatttctgtatttttagcagagatggggtttcgccatgttggccaggctggtctcgaacttctgacctcagatgatccacccacctcggcctctcagagtgctgggattacaggcatgagccactgtgcctggccttctagttccttctaaatgcctgtctgcaaacttctcttcatgttgacatcttcctttctctgacctctttccccactccgttccttccttcttaccccttggctgccccaggtatttggcctctgcctcattgcccgctaccccctggagaggcacctccttaaggtcactcgctgtgtgctgggctgtgctccgtgttaactgctgtggccagagggaggaggcactgaactggcactggggaccagaaggcctgggctcccgtcgtggctgggccccttcctaaccaggtggcctccttgcctgaggtgctgttaatgacatgggccactggaaggacagggttcatgaggtcacaggtgagaaagttctctgagaacctgaagatgaggtcaagtctggtactattagagatggccctgatgtcccagggcccccatgtgggggtcttcaggctgtcttcatgctgagctcaaaaccccactgaaagggcagggcaggcttccaggtctgaccatgcccccaagcagatccgggtccctgagctttctagcttctcctggggctccctcctaccccagggcccccacctggggctggcacctggagaccaccctccggggcctcacactgatcggggggtgtctgtgtttgctgtctaggagccgaaggctggtgggccagaagtgtggggggctctgagcaccccccacaatggagcccaaatggggtcctcctgagcccagaagacgaggaggagctcacagcaccaggtacctccagcaccaggtgggggctggccgccctgtgtcggttcctcctgctgctaaacaacttgccgcatattagaggctgaaaacaatgccagtttattctcttagagttctggagaagtcagaaataggtctctcggagctaacatcaaggtgtcagcagggctgagttccttctggaggcccatgggaaagtcccttccttgcctttcccagcctctagaagccgcctgcattcctgggctcatggcctcttcctccatcttcaaagcagctgagtttttctcacgccccatcactggcaccaactcccctgcctccctcttgtgtatttgccattaatctctaatgattgatggggcccagctggataacccaagaggctcttcctacctcaggtcagctgattaacaaccttaatgtcccctgccacagaacacaccatatttatggattccagggattagaatgtggatgccttgggaaggctgttattctgccatcagaccaccgtatctgatgaaacccccgtttttctggtcatagctttgtcatggagggcttcttcagtgccacagggccatagccactgtcatggcccagagaatctgtgtttcccatcagcccctcacccgccaggccactgcaccctaagcccagggccatggcattcttgcaaaaggaaggaggttcttgatcattctgacctctccaccccacagtgaggggaactgtggtctcctggcgactgtctcagccccagaacccagagcctagagcccatctttagccccactgtggctgattcaggacctgccagcacccccgaccagctctgccctttccctccctccctctgccagagaggccggggagatgatgtcacaggtggctgaggagccgtgtgccctgcagccaggaagtcaaaggcgtcgggcccctcgtggggcaggcgctccaagctcagaggcccatgagcaaaaaactcactctgttccatggccactctgctggcatatgtaagaaaaggggcttattcctgaaagaagcgcttgctgggtgttgggcacactgcaggggtgagatggatggacggcctgtcctcatggtgctctcaggccggcccgctcccggggcaccctgagcagctggaggtgagggcatggcaggggagccaggcttctgcctgttgcttacggtggggacacagaaacaaacgtctgggctggctggtgacagcatcagagggaatgaacacatcgaccctctggccagcatgtccaccttctgtattctgcctacgagcactcagtggggcaaagagcaggagctgagggaagataagtatttaggccgagcgcaatggctcacacctgtaatcccagcactttgggaggctgaggttgggggggatcttctgaggtcaggagttcaagaccagcctgaccaatatggtgaaacctcgtctctactaaaagtacaaaaaagttagccagacgtggtggtgcatgtctgtcatcccagctactcaggaggctgagacaggagaattgcttgaacctgggagatggaggttgcagtgagccaggattgcaccactacactccagcctgggcgacagagtgagactccatctccaaaaaaaggaaaaaaaaaaaaagagtatttaatggtgcaagcttggggcagtcccaggaggggctgggtagcctgttggtggactgtgatgcggccggttgtggaacagtgtgtgaaaccatctcacgtgtagaacgtgagtagcaaaggatgggaggggagcattgcgctcgtgctggtgattgattctggaggccgaatcggagtgcagccggggcatgtggccaccagctcccggggctccccgcttcaggccgcttctgcacaggtaagaaattcccccagccaggaaacgctctggggcagagggacacagggactttcagtgtttcgggagctgtccaccaaagctgtggcggggcgcgctacagaatttgagggatgcactgcagaattaaaatcccacccccccagttcccaaatagggggaagtactattaaaggtactaaaatataaacactttttttcccctgcagttttgccctttatttgtcatggtgttttttggtttgctatttgatgccattctaggtaaaggaaaattttaagttattagcatgaaacatataaagttattagcatgaattttaccattctttttttttttttttttgagacggagtcttgctctgttgccaaggctggagtgcattggcgtggtcttggctcactgcaacctctgccttctgggttcaagcaattccctgcctcagcctcctgagtagctgggattacaggcacccaccaccatgcccggctaattttttgtatttttactagagatggggtttcaccatcttggccaggctggtcttgaactcctgaccttgtgatccactcgcctcagcctccaaaagtgctgggattacaggcgtgagccacaatgccaggctgcgtattttgttcttacgaggacagtggaaatactgcacacaacaagcccagccacttttatttcactccttgacacacgcatgttccaccaacatggcacacctctgtggctttctcacgggtaagggaaagaccactgggaaaggaggagggagggtactgggaaaggaggagggagggtggcctgtgtcctttcctcctgggtcacgaacttctgaagaaatgatgggctgatgcagtgaaatgacatgagtcagaaggtaccgcacagcgcttggtggttcgtgtctcagaaaactagtgccttctttccgagttcagggcaagttctgattggaagggaaagcatggcccggggcccagagcacctctgctcactcagccagctcacttaccttgctgtcacctggaggtcccgctaaactcctgctgctgggtgttccctaggaatttcgtgctcatgggcatcgtgaatgctacacatgagcagacggcagcctctctggtcacacgtgtgtgtatcccctccgttcaccctcggactccgtgttccatcggacgtcacttctaaaacccaagttcaaagataaaattattaagaatgtgaagatggtcacagcagagcatgaagccaagtgtgggggcgtgtgtgactgcagaggtgtgggtgggccccctgcagggtctgctgtgcaggaagcttttgattttctacccactgcacttttatcttttttgaatgtttagttgccgataaaatcaacatagacatttaaaatcaagctaaccatatgaagactgtcaaagccttcttctcttgtcttcagagaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccgggcatcccagggaggtagagctcaggttccagtaagtatccccttctgtcctgagagatggggaggtgagaggggtggtctctgaggtccgggcacatttcagatgcccctgtagtctggggggctaccccccatccccaggcatggtacccccccaccctatgtcgggatctcactttgaccgcttctctcgccagcctgcaggagacctccgaggacgtggcccctccactgccccccttccacttccagcggctcctcgccaacctgaccagcctccgcctccgcgtcagtcccggccccagccctgccggtcagtaaagacaaccacatgcccaagacccgagtgcttgccaggtctcagaactgggctgggctccggcggtcacagtcttgtcagggccttgcggccgggtggttattgtcctgttttgccaagaaggaaccttagtcaaaagtcaggacagttgccagaggccatataacctgtgaaggcaatggggatggtggctgaggtcagatgcagggaatggacaggagagaggcctgaaggatgggcctcagaggcaggtgtgcggccagcaagccacccagacccgctgggtgtgctcactccaccttcactggatccaccaagccccctgtccccgctggacacagcccacagccggcagtccaggagtcccctggcagagtgactcccctgctggtcactggcggtattgtacctaagccaccctaggagggtctggtcttcccaaagagggggccaagccatcacacatcattgatgggggtctgtcaccacctcccaccctggtcacagtgattgacagccttagcctctgatctgttcctcattagaacctctacccacacgctattttaaaaatcaatataggtcgggcgcagaagctcacgcctgtaatcccagcactttgggaggccaaggcgagtggatcatgaagtcgggagtttgagaccagcctggccaagatggtgaaaccccacctctactaaaaatacaaaaattagctgggcgtggtggcacacacctgtaatcccagctacttgggaggctgaggcaggagaatcgcttgaacccaggaggcggaggttgtagtgagccaagattgcgccactgcactccagactgggcgacagagccagactccatctcaaaacaacaacagcaacaataacaaaaaacagtctggtggggtggtctgcacctgtaattccagctactcaggagactaagactggaggatcgcttgagcccaggaggttgagactgtagtgactgtgccactgcactccagcctgggtgacaaagcgagaccttgtctctaaaaaaaaaaaaacaaaacaaaaaacaaaacccctagtgtatgtgtgtaaaatgaagctgagctctaggctcagatgtttacaaaggggtttttctacccttccagcaccacgcaggacatttgaaagtcatgtggggagtttctgggaatgtcaatttctgggaactttaggcctcttcatccacatgacaaccaacatgtcctcagatttgcttccaggggagggagattttgctctttttgaggacctctggctcagagggtcagtcttcccctgggcctcttttgagtccaagggtgctgggatgccctggagaagcagaggacatagcgaccctccccagcacccgcaatccccaaacttcctctttccatgggtaatgttttgggaggcctctctctaaacctttctgtgtgtacgtacttaacatctgtatttttttaaaaacatagaaatgtgattacacagccgggcgtggtggctcacgcctgtaatcccagctctttgggaggctgaggcgggcggatcacttgagctcaggagtttgagaccagcctgggcaatatggtgaaaccccatctctactaaaaatacaaaaattagccgggtatggtggcatgtgcctgtaatcccagctactcgggagggagaattgcttgaacctgggaggcggaggttgcagttagccaagatcatgccactgcactccagcctgggtagcagagccagaccttgtctcaaagaaagaaagaaaaagaaagagagaggggaagggagggggagaaagagagagagagagtgagagagagagaaagaaagaagaagggagggagggagcaagggagggaaaagaaaagaaagaaaggtaatcacacagtacgatattctgggacttgctttttgtcagctaacagtgcgtcgtggaggttgttccttgtcattacgcgtagaaagcctggttttctgtgtctggtgtgtaagattctgtggtatgggtgctctgtgaggttttagccatccccctattgacaggcgcttaagtggcctccagttttccccattacaaccgtgtcacagggaatagggaccagcctcatagaaaggtcttggtattccagtataagtgtcgctttaggacagagtgctggaaatggagatgttaggtcaaagagggagcattttccattttgatccacactgccaaattttccttcagaaaggctgctctgatgaggagtgtcggccgcctccagtctccctgttctgtgtctacagatggtcattttcatattttgcccagagtttatagttgttttctgtgggaaggttgatctgccaggatcccctgctcctctgttactggaagcaaaaccttctgattagtattcgtacatccacactcttttttcttttctttctttttttttttttttttttgagacggagtcttgctctgtcacccaggctggagtgcagtggcatgatctctgctcactgcaagctccgcctcccgggttcatgtcatcctcctgcctcagcctcccgagtagctaggactacaggcgcccgccaccacgcccggctaattttttgtattttttagtagagacggggtttcaccgtgttagccaggatggtctcgatttcctgaccttatgattcgcccgcctcagcctcccaaagtcctgggattacaggctcgagccaccgcgcccggcccatttttttttccaaatatcagatttctttatttttaaaatgtacacattatagttgatctaaatacaagatgttcactttccttgcaggtaagaaatgtcactgacatttctgtgtcaattagcttcttttacatcaaaatcctgttacattcattagtctcaaaatctcctataacacttagaactttaggctgggcgtggtggctcaagcctgtaattccagcactttgggaggctgagacaggagtccttgaggccaggagttcaaaaccagcctggacaacaaggcgaaaccgtttttctacaaaaaatttaaaaaattagctgggtgtggtgccacacacctttggtctcagctacttgagcggctgaggcaggaggatcatttgaggccaggagttcaaggctgcagtgagctatggttgtaccactgcactccagcctgagtgacagagcaagattctgtctctcttaaaaacaaccaaaacaacaagaaaaatcttaaaac

SEQ ID NO: 179 - DNA, 10984 bp, Homo sapiens
tgtgccatactgttaaatgtttataatgcctgttctgtttccaaatttgtgatgcttatgaatattaataggaatatttgtaaggcctgaaatattttgatcatgaaatcaaaacattaatttatttaaacatttacttgaaatgtggtggtttgtgatttagttgattttataggctagtgggagaatttacattcaaatgtctaaatcacttaaaattgccctttatggcctgacagtaacttttttttattcatttggggacaactatgtccgtgagcttccgtccagagattatagtagtaaattgtaattaaaggatatgatgcacgtgaaatcactttgcaatcatcaatagcttcataaatgttaattttgtatcctaatagtaatgctaatattttcctaacatctgtcatgtctttgtgttcagggtaaaaaacttgttgctgcaagtcaagctgccttaggcttataacatcacatttaaaagcatctcaggtaactatattttgaattttttaaaaaagtaactataatagttattattaaaatagcaaagattgaccatttccaagagccatatagaccagcaccgaccactattctaaactatttatgtatgtaaatattagcttttaaaattctcaaaatagttgctgagttgggaaccactattatttctattttgtagatgagaaaatgaagataaacatcaaagcatagattaagtaattttccaaagggtcaaaattcaaaattgaaaccaaagtttcagtgttgcccattgtcctgttctgacttatatgatgcggtacacagagccatccaagtaagtgatggctcagcagtggaatactctgggaattaggctgaaccacatgaaagagtgctttatagggcaaaaacagttgaatatcagtgatttcacatggttcaacctaatagttcaactcatcctttccattggagaatatgatggatctaccttctgtgaactttatagtgaagaatctgctattacatttccaatttgtcaacatgctgagctttaataggacttatcttcttatgacaacatttattggtgtgtccccttgcctagcccaacagaagaattcagcagccgtaagtctaggacaggcttaaattgttttcactggtgtaaattgcagaaagatgatctaagtaatttggcatttattttaataggtttgaaaaacacatgccattttacaaataagacttatatttgtccttttgtttttcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagttatggattataaacattcaaaataatattttgacattatgataattctgaataaaagaacaaaaaccatggtataggtaaggaatataaaacatggcttttaccttagaaaaaacaattctaaaattcatatggaatcaaaaaagagcctgcagaaccaaagtaagactaagcaaaaagaacaaattacctgatttcaaactacactataaggccatagtcaccgaaacagcaaggtactggtataaaaataggcacacagaccaatggaatagaacagaatagagaacccagaaataaatccacatacttacagctaactgattttagacaaagaaaacaaaaacataaggtggggaaaggacaactttttcaacaaatggtgctaggataattggcaagcacatgtaggagactgaagctagatcctcatctctcaccttatacaaacatcaactcaagatggattaggaacttaaatctaaggcctaaaactataaaaattctagaagataacattgggaaaaacccttctacatataggcttaggcaaggatttcatgaccaagaacccaaaacaaatacaatgaaaacaaagataaattgctgggacttcattaaactaaagagcttttgcatggcatggcaaaagaaacagtcagctgagtaaacagacaacccacagagtgagaaaaaaatcttcacaatctatacttctgacaaaggactaatatccagactctacaatgaactcaaatcaacaagaaaaaaaaaatcccatcaaaaagtgggctaaggacatgaatagacaattctcaaaagaaaatatacaaattgaaaacaaacatgaaaaaatgctcatcatcactaataatcatggaaatgcaaatcaaaaccacactgtgataccaccttacctctgcaagaatggccataattaaaaaaataaaaaaatagtagatgttggcatggatgcaatgaacaggaaacacttctacactgatggtgggaatgtaaactggtacaattactatggaaaacagtgtgaagattcctcaaagaactgaaataaaactaccatttgattcaataatcccactactgggtatctatccagaggaaaaaaagtcattatacaaaaaagatacttgcacacgcatgtttatagcagcacaatttgcgattgcaaaaatgtgggaccaacccaaatgcccatcaatcaacgagtagataaagaaacagtatatatcactgtttctttatccactcgttgattgatatacatcatatatattgatatacatgatgatatatatacacatatatatagatatacatatatatatgtagtatttcattgtgtgtatggatatatgtatatatcaatggaatactactcagccataaaaaggaatgaattaatgacatttgcagcgacctggatgagactggagactattattctaagtgaagtaactcaggaatggaaaagcaaacgttatatgttctcacttataagtgggagctaagctatgaggatgcaaaggcataagaatgacacaatggactttggggactcataaaagactacaaacatggtacagtgtatactgctcgggtgatgggttatgggtgatgggtgcaccaaaatctcacagatcaccactaaagaatttactcatgtaactaaacacgacctcttccccaataacctatggaaattaaaaaattttaaaaaataaaatagctagtaatattacaaaacacccatatgatgcaatgttataccatcactcaatagcattttcagggccatttgtcctgtaggtgttaaatttattaaatacttattatatgccaaaatgtaaaacatggcttttctttactattcagacactataagaaattttgaggaacaaaggagatagagatgatgataagtgtggttgacagaattgggggaaaaaagtgatcttagaagaaatttaagacagtttagaataacagcactcaaagagtgtaagaagtttggagaagccttattggaagaggaattagaacacctggagaaacatacagtaagaagtgatgaaggtctactgaactgatgagctggaggagttggagggtgaatgtttcttgtaaaacactaaaatattattctgggcctctttttcctgttcccagaggtaagtcatatcatacctttgtctataaatgtacaagtctatcagacctttgtttatgaatttacaggcctcttagatctttgtctattaattcacatacttattttatccttattagtttgtgtttttaaaatttttatcaaattggtttcatactgtacatgctattccacaacttgttcttaacaacactgcttaatagtttcattttaagtgtggtgcttacgaaaggttctagtacaaagttacaaaaagtttctttctattgctggaatgttctgcgctccccaccattccactcccctgtccctaagcagcccccactttggtccgtgttgaatgtatcgaacatattttttttcacatttgttgcaatcatcacaaaagtcagagagtgctcagaaaaagagaaatggagatggtgggccctggctggtcaaaggccccagagacggacctagaaaatgttcaataaagcgctgtcactgaactggacctacacaggaccgggtctgggcaccctgtatcaatagcaatgccaccctgaccagtctcaggcaccaaagacgaacttaaaacttttggaaaaagattcccccatatatggtaacctgagctccagcttccccacttcccatggagtcgaccagaatcccagaggaactcaacagttaagcctatagagccagactcactgctctagtttcagagagtggtctggcaagctcatcactctggctagctggcttttttgtttgtttgtttttttcctgcacagtgtggaagattggtacacccgaatgtaccaatggtgcaggcacatcgatgtgcgtgcacgtgtgtgtgtgtgtgtgtgtaaaatgttgttttcatataatattggagggcacatggtatgatatcaacatgatttatcatggggatattaggattgatcacttggttaaggtggtgtttgccaggtttctctaccgtgaagttatcacttttccctttccatactctatttttggaagcaaatcatgaaatccagcccacactgaaagagagggagagggataagcttctgaaaatgggagtagctacatgtcttatttatattttcataagaaagacttgttatttaattgttcatttatgtcagtataaactcatatatattatatactttgggttataattcaatgccacattatttagttgctcaaagtatctcagctttggggcctctttttggttggctcccctatgcctttgacaggtctctatactttgttttctttctggcattgcaagctgcctcaggctcatcttatatttccctttcccagccctagaaatggccatttcttaaggaaggcctggttctctttattagagaatggttttacaaagatctgagtgctgggtattctcattgctaatgggatatcactgcttctagaccatttcagggaatggagctaagaaaggtaggtatgaatactaatattcatatcttcatttgaatacacacacacaaacataactgtaattatttctgtacgtatgtagctatctttctggttaatgatgagttcatactgatgtctctgactctaatccagaaccacaggacttattctagccttcctccttgcctctatgacagcaagaaacttctcttccactatctagcctccatctacccatttgttccacctcaggatgcatgtaaaggagtttcagagttataaacccatttctccatgaaaatcaaatttactaactagagtgcagtgtttacatacagttccttttgtctttagccatacgatttccagtcaaaacattattctccaaagtcatgtaggtcagctccatttttgcattaccatcttctgtgaagtcatgacaggtgactttgggtggctcattcacactgaacacaaaataagtttagggcactggcctttgacttgcctttgggcttgagctgtatgtgtgggccacccagcagctctttccacctaagtaggctttgcctacaatacataaaggtagcagcagtggtgacaggtatcctttacccagtgcattctctgccacaggtacccagggtggtcactccatttctctatagattccacatcaattgtcaggcagtctttgagggtgaccatgcctatctcttccaagggctttgaagaccatgggtctgcaataccagtggacccttccagtggatgtcctctcttgcctccatcgacatggttacattatgcttccctgggttggttttaaagtcctgccaaacatttcttggaggaatgtgaacactctttttgtttcaccttaggcccctcacctattcttactgttggtggttgtgtgtggaaggcaggggtgtaagtaacattaaaataggtcacattgtagaaatgctgtgatcatgtcctaagaatttaggagaaaacgtggtcgaaagatgtgttgttctctttatgttaagaaagtctgagtagtaaatttaacatgacagagatttgcatttgtgcttattatcagtgaaacacaagagtcactggaagccagaattgagggtgacgtgatggatgatgcaggatcataagtaatgatgtaaccagctttaaattaaatcaatggtaatcgagaactgtagaggcaagaagatttatttgtttcaatacgaacaacctccaaagagacattgtgtcttgagtaataacagcattgctactttttttttttgagatgggagatataaagttagcccggaatgaaatgcatttgacaataaagaacgtagttccacctcaggatggtaccaataggtaccatcagggtaccaacagggtaccaacagggtagacctgaacaggaagagatggtgcctgaacattaagaagaatcttcatgtgcaccaattggacagtaagaaactatgtcagtctggcttctatactcgttattctaaatctcaataaattaatacagtttacatgagtgcatgctggtgttgcataaatcagagggcactattaatgtaaaataaaatgcgaagggtgcctcctggaatttagcaacgtgggctatttttattactattgttaacattttagggatttggtttatgaaagggcagctgagattgtgataaggcagctattttgtgacagatgagctggatacatggaaagtacacatggaagcccatcattcctacccttccctgctgacctaacaagtctctttgctcttcttaactactttacaaagtccagacctgactacccttccaatctctttttcttcctgccttcaatgccctaatcagtttgaacttcatactattcattagcacaccatgcttttcatgcctcccttacatggattcctattatctggaatgtctttctttgtcttttttatccgtttaatccagctgaaatgttacgttctttgaggaaatttttctgaatagagctggtcatttctttcctgatggtccttgactctttgaacctgacttattacagcactcacattctttttaaaaacttcatgttaatatccacatttatattttattataataattgtagattttatatctactttaaatatatatgatctgagtcccagggcttgaatttgaacacacaaggttctgacccctgaaagctgactcatttaatggtgtcagttcattacatatctctctcttcaactagatagtgtttctcatcagaagggatcatgaattagaagtccatgtatctctcctggtacttagtgtaacctggtacatagtaagtatgcaattaaaattagatgaataaattaatttataccatgggctttaaatattctaaactacaaatcacagaatcctgacttacaataatttcctggacttccaaaatagcatatatagtatattgaattttataaatatttgaatcatgagaatttgtgctttaagaaaataaccatgattcattttatttttcaactttgaataataacaatttctccacattaagaagtatcaagaactgcgtgtccgaaggtggcagacatagtaatgtctcatatggtggtgtcacttttgtatcactttaattggtttagaattatccaaattatctctctcgtgtgagtaactgatgaataaatacatgaatacatggatggcaccaaaaaaagaactttggcattttgatatttatcttttggggaaggtagaatcttctgaccagtgaaatattttatgttaataaaatgttatgtgtgatggttgatgtacagggggagtaatagtcatttgcccattttacttaattcatgtgtatgctgtgtaatttcttcaacactagagtgtgaagcagttacttggacaatatctgaaaaatactgcatacaaatgaacaaattacttttccatatttactctctatctccattcacgtctcactcagttctttttgttgcaaaaatctttattcatttggtcaattgatatctgtgccctggagactggtttcttaaaaccccagcaaagagtctcaagggaagaattgaaataaggagctatttgaaataagaattgaaataaggggtgttgtaaataccaaatagaggaagtccatcctgtttgtgtggggagaggtcctcatctacctcaggtggagtaatttggttggtgacttgaagagccatccagatgagtattaggagtcataaatatcttcaagtgatggaagaggacgcctgcaaggcagacacatgctcccaagcttccaatgaggttatcccatgtctttgggcttggcactgggacattagagcagaggctacaaaggagcagagcacagagtttagctccaatggctgccaagaagactacgtgccaaaattaggatgcttctgcactataggaaagatgatctcttggttttaaaaactgtaatagaaaaaaaattgtagaacaccacaaacaacacccaaatactagctctacttattctttccactgcctgaaggattggctcttctatactcagaacagtcttggatgacacagctggcctccctaactttgtgatggggcagacaacagatgccatgtttggacaatactgactcagtgcaaagatgaccaggaggcattgggaatggcaatggagatttcttctgacctagcttctgactttttttaatgacagaaattgtgaggccacagtaaaatccactcacaaatttcttacatcccgcagaatacaagagagcacatatgttcttattcttttttaggaacatcaaaaataagagcatttctctaaataaaacagagcttgtttagaaataggtagtctatcttctgggaagtggcatgacttgcttaagaataataaataataattctagtttttattctatatattttctatgataagaatatatattgacaattctctctctctctctctttccctgtgtgtgtgtgtgtgtgtgtgtgtgtgtgtgtgtgtcttagtcttctcaagctgtcaaaacaaaataccatagcctgggtgacttaaacaacagaatttattttctcatagttctggaggctagaaagtttatgatcaagattctggcaaagtttagtttctggtgagggctctgttccaggcctatagttgaccaccttcttgctacgtccttatatggcagagaaagcaagcaagctctttgacattataggggtagcaatctcatcatgaggctcctgcttgcatgatctcatcgaaccctaattacctcctaaagactccatctccaagtgtcatcacattgggggttaggacttcaacatatgaatttgctaaggggaagagagagacacaaacatctagtccataacagacagtgaaatctcttgactaagtaaggaattttttctgaaacttctataacaatgagccatcactgaaccttgtgaaatgctatagtttaaatgcatgtgttgctccaaaattcacaagtaagaacataatatccagtgtgatagcaataagagatagagccttttgggacgtgattaatccaccctcatggttgcattaatgctcttataaaagaagctgaagggtgccctagtgcccttttggcattccctttcttctgacttgtggggacacctaaatgagaaacagtcctcacccggcacagaacctgttggtgccttaatcttggacttcctggtctctggaactgtgagaaaaacatttctgttgttttcaacttacccagtttcaagtgttttgttatggtatcacaaatgatctaatggactaagacattaagaaaagggagtattagtattcagcaatgatgctgatgatggcagatggccatggacaccctttgttatttctaataccctgtcattgctatagaagctgggaagagaaggagtccatatgaaaaagtcattacaaaaaaagatttaggaagtgttattttctgtgcaagttattgttctaggagatgctttaaaagtgtttttctctcaagcagttgacagtctctttgagcatgtggaccagttctgctgttttaaggagctatgcccagcctagcataggcaaccaacttacagaataagaaatgctgttaatggaacatagatttttgtaaaatgtattttcagttggcccttgacttactttgctctatctctgcatgacccgtattgatgtcttagttcaccttgctgaccttgaggcacttctatccttttaagtttggcaggcaagattggttgcctaatctgactgactcctttgaatttgttcccgtgtgggagggagaaaaaaatgtattttttttccctttacaaaccagggacaagatccctttgatgaagtgaaatagtcttctttttttaagcaaatactttatttataagtataatagcttttggggggcagcaaatgggaaaggtgaagtcttgtactctagagcatgattcaaatagataggctcaaattaaacaaatggagggatagtttgttctgcctaaaagcagtaataggaggggaatctagaagctgggtctggatgggaagacattaagaaaggagagggagagagagcaagcaagaaggaggtcggtcagggctctacaagaagagagtcaggtggtattgata

SEQ ID NO: 180 - DNA, 14241 bp, Homo sapiens
aatcctgaaaagaaagaactggaatgataggagagaccatctaatccagggatagtaaatagatggtgctcgtactaccacctgctgtggcagacatcgctaatggagcactatcacaggcctcccgtttcacactcactgcagacatagctaatggagcactatcacaggcctcccgtttcacacccacagcagacatcactcatggagtattatcaacgctcccctttcacacccatgacagacaccactaacggagcactatcacaaccctttcacacccacggcagacctatcacagccctcccttttcacactcaatagacattactcatgcagcactgtcaatacacccctttcacacccacagcagacatcactaatggtatacccatggtacacatcactaagggagcactatcacagtcttcccctttcttacccacagcagatatcactaatggagcactatcacaaccctcccttttcacactcacggccaacatcactcatggagcattgtcaatgcacccctttcacacccacagcagacatcactaatggtataaccatggcaaacatcactaatggagaactatcacagcctccccctttcatacccacagcaggcatcactaatggagcactatcaacccttgcctttcacagccatggcagacatcactaatggtgccatatcaaactttccctttcatagccatggcaggcatcactaatgaagcactactacaacccttctttttcacacccatagcagacatcattcatggagcactgtcaacacacccctttcacacccacaacagacatcactaatggcatacccatggcagacatcactaagggagcactatcacaaccctcccctttcatacccacagcagacatcactaatggagcaccatcaactctcccctttcacaccatggcagacatcactgatggcatacccatggcagacatcactaaggcaacactatcacaaccctcccctttcacacccacaacagacatcactaatggggcacagcagtcttggccatgagccctactataacctcaggatccttcttaacaccctgcttcaggaagcccctacccactgagctggattttgagcctgtttgccatctttgcagtctgatcatggtacaaatggggcatctgaagctctgcaagtcaaaggggctctcccaaggccaggaagtacataaacttcctctttcaagtgttcaagaggcctccaagctccagcagtgcggccagcagacaaacatgggtttagctccttgggtacacactatctcttcttcctggctttgtgtctgacattcaccagagctgcttggagaagtggcagattctggggctggggctggaaaaagacaagataagcccaaggcgtcttacagtgccaggaagcaaggaaatgctgaaaaacagagacagacacaaacaaaacagcccaaaccagaacgtgggcccatgtcaaaaggacacaggagccgacgtgaaagagctctcagggctgaaacaatttgagcaacaaaataaacgatagtattggattataacccagagaataaagtcaaatccacgaatccatactgatgtaaatagatgattgaatacataaatagatgggcatgaagagacaaaccttccttgcagaagaattccaagtaatgaatgtagaaatgaaggaactggaaaaccactgttcagacctcacagtggtaattgctacaggcaagagctgccgatgaatgctgacattggtgggcagaactttaaggaaagagaggatatttgcataacctcaaaatatctattaattactggggtggctttaacatctgtccgtgggttctttgatactcttcctctaggaggtcgagcttaatccccctctttttgagactgggctgcatttagtgacttgctgcttttttttttttttttgagacggagtttcgctcttttgctcaggctggagtgaagtggtatgatctcggctcactgcaacctctgtctcccgggttcaagcgattctcctgcctcagcctcctaagtagctaggattataggcacccaccaccacgcctggctaatttttgtatttttagtagagatggggtttcaccatgttggtcaggctgatctcgaactgacctcaggtgatccacccacctcggcctcccaaagtgcgtgagccggccaggcgcggtggctcatgcctgtaatcccagcactttgggaggccgaggtggatggatcacgaggtcaggagttcaagaccagcctggccaacatagtgaaaccctgtctctactaaaaatacaaaaattagccgggcatggtggcgcacacctgtagtcccagctacttgggaggctgaggcaggacaattgtttgaacccgggagacagaggttacagtgagctgaaatcgtgccactgcactccagcttgggcaacagagcgagacttcgtctcaaaaaaaaatttaaagtgcttgagccaccgcgtccggcctattcagtgacttgcttctaatgactggaccgtggtgattgcacagtggagagactggtagacagcacaggtgatgaaagtcagcatcgcttggatgtcatgtgggtttcctgtgcccccatgtgatatgacgagaagggtacttcacctctgtgtatttctttcccaagcctataactctggtctaatcatgagaaacatcagacattctaaaaatacctgatcagtgcttttcaaaaagtgtcaagatagtggcagacaaggaaagactgagaagcggtgataggttggaggagaacaaggataccactaaatgcaacaccgtgtcctggatgggatcctgcagcagaaaccagacattagaggaaaaagtggagaaatcctattaaagtcgctgggcgcggtggctcaagcctgaaatcccagtactttgggaggctgaggcgggcggatcccctgaggtcaggagttcgaggtcaacctgccaacatggtgaaatcccgtttctactaaaaatacaaaaattagccgggtgtggtggcaggcgcctgcaatcccagctacccgggaggctgaggcaggagaatcacttgaacccgggaggcggaggctgcagtgagccaagattgcaccattgcactccagcctgggccacagaacaagactctgtctcaaaaaaaaaaaaaaacaacaacaacaaaaaaacaaaacctaataaagtctggagtttagttaacttagttttgacaaatgtactgtggtaatgtcagatgtcagcatcaggggaggctgtctgaagcaggtatgggaacaatctgtaatgttcttactactcttctagaattctgaaaaaaaattgtttttaagtttctgcagtgattctagactctcattggtccagctgggataccctggccccgccccttcctggctgattcacgtggccctcgtgggcatgtcctgcctccatttcagatgtcgcccggggacctttaacctgcagccccacaatccagctggctgcagcagctgtttctgctatggccactccaaggtgtgcgcgtccactgcccagttccaggtgcatcacatcctcagcgatttccaccagggtaagagatgctccctgcaaacgcctcccaagggtctgctcccagcctaggcaggtgatcctgccctggggagatcttgcattagtggatctcccattgtggagaggagccacaggcctgcacagcctaggtggggtcgggggtgagatgatggctccccagtgcccacctgcgacccccagctccctccccagtccctgactcttctctttatacccgtggtggggttgggggccgggtacgtgacgctttttggatcctgtaggggaatttcccactcaccccgttgagactggcctcccttggtgtgtctaaacactggggattcaggctcagtctcctggcctccacttattgagcacctgctgtttgccaggcactgtgctgagcacctaacatgcaaggattctcattcccctttcaatgatgaagtaactgagacctacaaaaggtaggccacttgcctgaggccacataacagttgtgagcactgcatttgtcagctcctgagttttgctcctttttttttttttttttttttttttttttggacacagggtcttgctgagtcaccaaggctgaagtgcagtggtgcaagattgcacagcacagctcactgcagccaccacctccctgggctcacgtgatcctcccacctcagcctcctgagtagctaggaccacaggtgtgcaccaccgtgcccggctaatttttatatttttttctaaagacagggttttgccatgtctttagacccaggctggtctcaatctcctgggctcaagtagtctgcccacctccgcctcccaaaatgctgggactacaggcgtgcaccaccatgccgagctaatttttgtattttttttttttttttttttttttttgtacagacggggtcttaccatgttgcccaggctggtctagaactcctgagctcaggcaatcccgcccacctcggcttcccaaagtgctgggattatgagtgtccgcgcccagctgttttgcccttaaccgctgtggtggcctataccgtggtccctgactccaggtggcacagccgcatatttaaagaggaaagcagcagagctcggagctctgcattaaaccagaggctgcgtgggccccagcgatgtcccacggagcgccccgcaccttccgcctgtccccaggaaggagcgaggcatcagctgaaacagaagaacctcagggccgacgctggggcggccccagacatgagggccgcgcgccctctgctggaagccgcgcagaaagcaggaccgagagatgcgcggaccggcgccgcgtgtctgggtcctgggtccgggggtctagggtgtcagcgttgggcaggactcattttctagaccctaagaacagtgtcatgatctgttctcacattgggccaggcactgggtgtggccggcccttcaggggtgtcatctcattttgtctcacagttgcccttgcgcaggagttctcaaaactttttggtctctgaattcctctttttttttttttttttaagacggagtctcactgtgttgcccaggctggagtgcaatggcgtgatctcagctctctgcaacctccgcctcccaggttcaagtgattttcctgcctcagcctcctgtgtagctgggactgcaggcacccaccaccacgcccagcttatttttgtatttttagtacaggtcgggggtttcaccatgttggtcaggctggtcttgaactcctgacctcaactgatccaccctcctcagcctcccagagtgctgggattacaggtgtgagccaccgcacccggcctctggatccctttatgctcttgaaaattattgagaaccccaaagtgcttttgtttatgtgggtggtttgtatggatatttgctgtcttagaaatggaaactgtggctgggcgcagtggctcacgcctgtaatcccagcactctgggaggccggggtgggggtggggggagcggatcacctgaggtcaagagttcgagaccagcctggccaacatgacgaaaccccgtctctgctaaaaatacaaaaattagccaggcgtggtggccagctcctgtaatcccagctactcgggaggctgaggcaggagaatcgcttgaacctgggaggcagaggttgcagtgagccgagatcgcgccactgcactccagcctgagtgacagggtgagactctgtctcaaaaaaaaagaaaacaagtagtttttaaatttttattatttttatttatttttattttatttttttagcagagacggggtttgccatgttgaccaggatggtcttgatctcttgacctcatgatccatctgcctcggcctcccagagcgctaggattataggtgtgagccaccacacccagctgatttttttttttttttttttttttttttgagtcagagtcttgctctgtcacccaggctggagtgcagtggcacaatctcagctcgctgcaacctccgcctctcgggttcaggcgattctcctgcctcagcctcctgagtagctcagattataggcagctgctaccatgcctggctaatttctgtatttttagcagagatggggtttcgccatgttggccaggctggtctcgaacttctgacctcagatgatccacccacctcggcctctcagagtgctgggattacaggcatgagccactgtgcctggccttctagttccttctaaatgcctgtctgcaaacttctcttcatgttgacatcttcctttctctgacctctttccccactccgttccttccttcttaccccttggctgccccaggtatttggcctctgcctcattgcccgctaccccctggagaggcacctccttaaggtcactcgctgtgtgctgggctgtgctccgtgttaactgctgtggccagagggaggaggcactgaactggcactggggaccagaaggcctgggctcccgtcgtggctgggccccttcctaaccaggtggcctccttgcctgaggtgctgttaatgacatgggccactggaaggacagggttcatgaggtcacaggtgagaaagttctctgagaacctgaagatgaggtcaagtctggtactattagagatggccctgatgtcccagggcccccatgtgggggtcttcaggctgtcttcatgctgagctcaaaaccccactgaaagggcagggcaggcttccaggtctgaccatgcccccaagcagatccgggtccctgagctttctagcttctcctggggctccctcctaccccagggcccccacctggggctggcacctggagaccaccctccggggcctcacactgatcggggggtgtctgtgtttgctgtctaggagccgaaggctggtgggccagaagtgtggggggctctgagcaccccccacaatggagcccaaatggggtcctcctgagcccagaagacgaggaggagctcacagcaccaggtacctccagcaccaggtgggggctggccgccctgtgtcggttcctcctgctgctaaacaacttgccgcatattagaggctgaaaacaatgccagtttattctcttagagttctggagaagtcagaaataggtctctcggagctaacatcaaggtgtcagcagggctgagttccttctggaggcccatgggaaagtcccttccttgcctttcccagcctctagaagccgcctgcattcctgggctcatggcctcttcctccatcttcaaagcagctgagtttttctcacgccccatcactggcaccaactcccctgcctccctcttgtgtatttgccattaatctctaatgattgatggggcccagctggataacccaagaggctcttcctacctcaggtcagctgattaacaaccttaatgtcccctgccacagaacacaccatatttatggattccagggattagaatgtggatgccttgggaaggctgttattctgccatcagaccaccgtatctgatgaaacccccgtttttctggtcatagctttgtcatggagggcttcttcagtgccacagggccatagccactgtcatggcccagagaatctgtgtttcccatcagcccctcacccgccaggccactgcaccctaagcccagggccatggcattcttgcaaaaggaaggaggttcttgatcattctgacctctccaccccacagtgaggggaactgtggtctcctggcgactgtctcagccccagaacccagagcctagagcccatctttagccccactgtggctgattcaggacctgccagcacccccgaccagctctgccctttccctccctccctctgccagagaggccggggagatgatgtcacaggtggctgaggagccgtgtgccctgcagccaggaagtcaaaggcgtcgggcccctcgtggggcaggcgctccaagctcagaggcccatgagcaaaaaactcactctgttccatggccactctgctggcatatgtaagaaaaggggcttattcctgaaagaagcgcttgctgggtgttgggcacactgcaggggtgagatggatggacggcctgtcctcatggtgctctcaggccggcccgctcccggggcaccctgagcagctggaggtgagggcatggcaggggagccaggcttctgcctgttgcttacggtggggacacagaaacaaacgtctgggctggctggtgacagcatcagagggaatgaacacatcgaccctctggccagcatgtccaccttctgtattctgcctacgagcactcagtggggcaaagagcaggagctgagggaagataagtatttaggccgagcgcaatggctcacacctgtaatcccagcactttgggaggctgaggttgggggggatcttctgaggtcaggagttcaagaccagcctgaccaatatggtgaaacctcgtctctactaaaagtacaaaaaagttagccagacgtggtggtgcatgtctgtcatcccagctactcaggaggctgagacaggagaattgcttgaacctgggagatggaggttgcagtgagccaggattgcaccactacactccagcctgggcgacagagtgagactccatctccaaaaaaaggaaaaaaaaaaaaagagtatttaatggtgcaagcttggggcagtcccaggaggggctgggtagcctgttggtggactgtgatgcggccggttgtggaacagtgtgtgaaaccatctcacgtgtagaacgtgagtagcaaaggatgggaggggagcattgcgctcgtgctggtgattgattctggaggccgaatcggagtgcagccggggcatgtggccaccagctcccggggctccccgcttcaggccgcttctgcacaggtaagaaattcccccagccaggaaacgctctggggcagagggacacagggactttcagtgtttcgggagctgtccaccaaagctgtggcggggcgcgctacagaatttgagggatgcactgcagaattaaaatcccacccccccagttcccaaatagggggaagtactattaaaggtactaaaatataaacactttttttcccctgcagttttgccctttatttgtcatggtgttttttggtttgctatttgatgccattctaggtaaaggaaaattttaagttattagcatgaaacatataaagttattagcatgaattttaccattctttttttttttttttttgagacggagtcttgctctgttgccaaggctggagtgcattggcgtggtcttggctcactgcaacctctgccttctgggttcaagcaattccctgcctcagcctcctgagtagctgggattacaggcacccaccaccatgcccggctaattttttgtatttttactagagatggggtttcaccatcttggccaggctggtcttgaactcctgaccttgtgatccactcgcctcagcctccaaaagtgctgggattacaggcgtgagccacaatgccaggctgcgtattttgttcttacgaggacagtggaaatactgcacacaacaagcccagccacttttatttcactccttgacacacgcatgttccaccaacatggcacacctctgtggctttctcacgggtaagggaaagaccactgggaaaggaggagggagggtactgggaaaggaggagggagggtggcctgtgtcctttcctcctgggtcacgaacttctgaagaaatgatgggctgatgcagtgaaatgacatgagtcagaaggtaccgcacagcgcttggtggttcgtgtctcagaaaactagtgccttctttccgagttcagggcaagttctgattggaagggaaagcatggcccggggcccagagcacctctgctcactcagccagctcacttaccttgctgtcacctggaggtcccgctaaactcctgctgctgggtgttccctaggaatttcgtgctcatgggcatcgtgaatgctacacatgagcagacggcagcctctctggtcacacgtgtgtgtatcccctccgttcaccctcggactccgtgttccatcggacgtcacttctaaaacccaagttcaaagataaaattattaagaatgtgaagatggtcacagcagagcatgaagccaagtgtgggggcgtgtgtgactgcagaggtgtgggtgggccccctgcagggtctgctgtgcaggaagcttttgattttctacccactgcacttttatcttttttgaatgtttagttgccgataaaatcaacatagacatttaaaatcaagctaaccatatgaagactgtcaaagccttcttctcttgtcttcagagaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccgggcatcccagggaggtagagctcaggttccagtaagtatccccttctgtcctgagagatggggaggtgagaggggtggtctctgaggtccgggcacatttcagatgcccctgtagtctggggggctaccccccatccccaggcatggtacccccccaccctatgtcgggatctcactttgaccgcttctctcgccagcctgcaggagacctccgaggacgtggcccctccactgccccccttccacttccagcggctcctcgccaacctgaccagcctccgcctccgcgtcagtcccggccccagccctgccggtcagtaaagacaaccacatgcccaagacccgagtgcttgccaggtctcagaactgggctgggctccggcggtcacagtcttgtcagggccttgcggccgggtggttattgtcctgttttgccaagaaggaaccttagtcaaaagtcaggacagttgccagaggccatataacctgtgaaggcaatggggatggtggctgaggtcagatgcagggaatggacaggagagaggcctgaaggatgggcctcagaggcaggtgtgcggccagcaagccacccagacccgctgggtgtgctcactccaccttcactggatccaccaagccccctgtccccgctggacacagcccacagccggcagtccaggagtcccctggcagagtgactcccctgctggtcactggcggtattgtacctaagccaccctaggagggtctggtcttcccaaagagggggccaagccatcacacatcattgatgggggtctgtcaccacctcccaccctggtcacagtgattgacagccttagcctctgatctgttcctcattagaacctctacccacacgctattttaaaaatcaatataggtcgggcgcagaagctcacgcctgtaatcccagcactttgggaggccaaggcgagtggatcatgaagtcgggagtttgagaccagcctggccaagatggtgaaaccccacctctactaaaaatacaaaaattagctgggcgtggtggcacacacctgtaatcccagctacttgggaggctgaggcaggagaatcgcttgaacccaggaggcggaggttgtagtgagccaagattgcgccactgcactccagactgggcgacagagccagactccatctcaaaacaacaacagcaacaataacaaaaaacagtctggtggggtggtctgcacctgtaattccagctactcaggagactaagactggaggatcgcttgagcccaggaggttgagactgtagtgactgtgccactgcactccagcctgggtgacaaagcgagaccttgtctctaaaaaaaaaaaaacaaaacaaaaaacaaaacccctagtgtatgtgtgtaaaatgaagctgagctctaggctcagatgtttacaaaggggtttttctacccttccagcaccacgcaggacatttgaaagtcatgtggggagtttctgggaatgtcaatttctgggaactttaggcctcttcatccacatgacaaccaacatgtcctcagatttgcttccaggggagggagattttgctctttttgaggacctctggctcagagggtcagtcttcccctgggcctcttttgagtccaagggtgctgggatgccctggagaagcagaggacatagcgaccctccccagcacccgcaatccccaaacttcctctttccatgggtaatgttttgggaggcctctctctaaacctttctgtgtgtacgtacttaacatctgtatttttttaaaaacatagaaatgtgattacacagccgggcgtggtggctcacgcctgtaatcccagctctttgggaggctgaggcgggcggatcacttgagctcaggagtttgagaccagcctgggcaatatggtgaaaccccatctctactaaaaatacaaaaattagccgggtatggtggcatgtgcctgtaatcccagctactcgggagggagaattgcttgaacctgggaggcggaggttgcagttagccaagatcatgccactgcactccagcctgggtagcagagccagaccttgtctcaaagaaagaaagaaaaagaaagagagaggggaagggagggggagaaagagagagagagagtgagagagagagaaagaaagaagaagggagggagggagcaagggagggaaaagaaaagaaagaaaggtaatcacacagtacgatattctgggacttgctttttgtcagctaacagtgcgtcgtggaggttgttccttgtcattacgcgtagaaagcctggttttctgtgtctggtgtgtaagattctgtggtatgggtgctctgtgaggttttagccatccccctattgacaggcgcttaagtggcctccagttttccccattacaaccgtgtcacagggaatagggaccagcctcatagaaaggtcttggtattccagtataagtgtcgctttaggacagagtgctggaaatggagatgttaggtcaaagagggagcattttccattttgatccacactgccaaattttccttcagaaaggctgctctgatgaggagtgtcggccgcctccagtctccctgttctgtgtctacagatggtcattttcatattttgcccagagtttatagttgttttctgtgggaaggttgatctgccaggatcccctgctcctctgttactggaagcaaaaccttctgattagtattcgtacatccacactcttttttcttttctttctttttttttttttttttttgagacggagtcttgctctgtcacccaggctggagtgcagtggcatgatctctgctcactgcaagctccgcctcccgggttcatgtcatcctcctgcctcagcctcccgagtagctaggactacaggcgcccgccaccacgcccggctaattttttgtattttttagtagagacggggtttcaccgtgttagccaggatggtctcgatttcctgaccttatgattcgcccgcctcagcctcccaaagtcctgggattacaggctcgagccaccgcgcccggcccatttttttttccaaatatcagatttctttatttttaaaatgtacacattatagttgatctaaatacaagatgttcactttccttgcaggtaagaaatgtcactgacatttctgtgtcaattagcttcttttacatcaaaatcctgttacattcattagtctcaaaatctcctataacacttagaactttaggctgggcgtggtggctcaagcctgtaattccagcactttgggaggctgagacaggagtccttgaggccaggagttcaaaaccagcctggacaacaaggcgaaaccgtttttctacaaaaaatttaaaaaattagctgggtgtggtgccacacacctttggtctcagctacttgagcggctgaggcaggaggatcatttgaggccaggagttcaaggctgcagtgagctatggttgtaccactgcactccagcctgagtgacagagcaagattctgtctctcttaaaaacaaccaaaacaacaagaaaaatcttaaaac

SEQ ID NO: 181 - DNA, 15522 bp, Homo sapiens
ccctgtgtctaagaagtatgagaattacaatattgggtagcagagactgataaagatggtgatataggttgagcatcccttatccaaaatacttgagacagaaagtgtttcaggtttgatttttttattttgtattttggactattttcatatatataaaatcagatatttggggatgagacccaagtccaaacacaaaattcatttgttttcatttcatttatatatgccttctacacatagcctgaagataattttatacaatatttttgtgcatgaaacaaggttttttgtttgttttaagacagggtctcactctatcaaccaggctggagtgcagcctcaacttcctgggcttaagcaatcctcccacctcagcctccctagtagctgggagaagaagcatgcatcaccatgccctgctaagttttaaatttttttattgtagagatgggaatcccactatgttgcccaggctggtctcaaattcctgggctcaagtgatcctcctgccttagcctcccaaacagctggattacaggcataagccactgtgcccagccccatgaaacaaagttttgactgcaatctatcacatgagatcaagtgatggaatgaaatttttcacttctgacgttacgtcggtgctcaaaaagtttttgattttggagcatttcagattcgagatttttgcattaaggatgctcaacctgtacttgtgtgccaatgtctgatgggaatggtggccccctgtttcagggagtgaaggcaatgatggatcctgagttctggatatttgtaggaattgcagtagatgagtcttatgtgctgagagatttggagccctgtatttcagagaatgaaggaaccagtggtccctgtgacttgctaactgatgagaacagaacagaggccttatgtttcagaaactaatgggaattatggtcactgttcctggggggcttaagcaagtcccagcctaatccacaagtcatttattattcactcatctcctcattcattcacttagcaaacattttcctgagcccctgctctgagccatgcctgggtggagtgatattgaggacacagaaatgactcagacccagactgtgccctcagtaaattcccaaagacagacccagacgtagaaaatcacaacacaacaggatcagggccaggacaaggactgtgatgtggtgcctgtcctgatctgtctacagggcatccagggtgaatgtagaatgacagtaactctagatcgtaagtgaaagtgaggggtctgacaaagggtccttcttaatcatacatgaatttgtgtgcatgacaagtttaaatgtacccagtgtcaatccttagaaatagcatattttcccagagcaagcccaccccaaagaaggagccagagaggcctgggtttgaatctctagctccatcacatactttgtgagcttgggcaactcgctattcagaactgcatcctattcagtattccatccttacaattgggataataatagtttctaataataaggtttctgtgtaatcaatgatataatgtataacaaatactcatcccaggaactggctccaagtagtcattcaataaagggtatctgttgtcattattattatcccattgttagtaattatcaacaaattttaaaggatctagaagtaagcatttatcgaatatctgggtttagaggcttaaaagcattggacaaaatcactttaaaaatcagcaaatttgggccaggtgtggtggctcagccaaggtgggaggatcacttgaggtcagaagttcaagaccagtccagcaaacgtggcaaaaccccatctctacagaatacacaaaaattagccgggcctggtggcgcaggcctgtagttccaaccacgtgggaggctgaggtgggagaatggcttgaacctggaaggcagaggttgcagtgatctgagataatgccactgcactccagcctgggcaatccgtctcaaaaataaatacatacatacatacatacatacatacatacatacatacatacataagcaaatctgtaaatatcaatatgcataaccattagtttcttgacataaaaaacctcccaatctcccaattaactgaatacactaggaataaatagatgaatacaatggaatattatatcactattaaaatgaatgaggaggttctataagcctagatatgggaggatctttggatatcatgtaaaaaaaaaaaaaaaaaccaaggtgcagaataatgtgatcctatcaggggacagaaaagaggagggtggtatatatgtgcatagatgtataaaattcctctggaaagatacataagaaattagtgaatatatgctgtccccagagaggagaactgggtggctggaggatagggagggagggagatgcactgttgaaagcccagcaccatgcatcctgaacgttttccctggctcttaatgtccactaagttctcagatgcccacagcatctctctcctctaccctcttcttcctcctagttccccattgaaagcaactcctgccccatccgttcctgggccagactcagggagttgtagttttcctacctgtttcccgcccacaggttcctgttctctgcccccagtgcccagcagtctccagccatctccagctcctcacattcctgccccaccccttcctctctccccaggtcctagcccgcaaactgcagggagggggcctcctccccagcctccacccgtctctccccctccactccacacagcctcagcggggtctgacattcagctataaccgtgtccccgccccttgctcacaaccttccagggctccctgtcaccctcagaaggctaagttcccagcctggcctgaaactccctaagaatctgaccccgcccgctcgccccaccagcctcatctcctgtgctccttggctcctggcttcggaggctctagtcagacttaagggctttgttgtcctcccagcacctccttggtttcctgccttgggccttcgcttcagctgtgccctctgcctggaagggccttagtggaggtcatgccacaaccacgccttctctggaggtcctctctgccgtctccagctgccaggattcctcccgccctgggctctcacagcctctggcctctccctgtgtcatacccagatcacccgggattgggactgtctgcggctggctctgtctcttccatcagactgtgagctccatctgcaagggcagattcgggtctgattcacctttgagcccccagtgggtgggggtggggggtggagatactaaagctggtgggggcgaagctgggagagcaggaagggggagagagagacgggcagaccctgactggttcggggagagaggggaggagaaagcgagagagaggaagaacagagacacagagacaggaagggagggagagaaacagagaaaagggaagaataaatgggagacacagataatgccccacaggcagagaaagaggatggagatagggagagggcgaaaggaaggacagatgtgcagagacagaagggaggacagacggaaagagacacagagaggcagcaaaagcaaccaagaatgacaggagcagagaggaggagggaaagagggagagagagagagagagaacgagagagaagggagggagggagagagggagagagagagcgagagagcacgcacagagcgaggaggaggcgcaggagagaagagggagggaggccagcgagggacaggacggggcggagaggcggaggggagctagggaaagccggggaggagcgagactggccgaggaggagggcgggcgagcgggagcgccggccccgccgcctcccggcctcttttgtcccttccctcctctgcgtcaggcttctctggcccggcctccccctcccgctccctcctcctccccggggctggatggaattttttcccctggacctgggccagctccggggcaggggggaagccaggccggactgggctgggcggtggggaggggccggggcggggggccccctggggagggggctggtccgacggccgcgcagccggcggggtccagggagggggagccccggaccgcagagccggggaggaggtgacggccggagggagtcggggagaagggaaggaggatggcggggacggcgggaggaaggggagaggccgccgtgcggcgaaggcggggagaggatggagagcgctcggcggcggtggggcccggcctgcgggcccggggcggcggagaagaccccttccctgcgacgcgggagccgcgggagccgtgagtctgcggaaagggagggtggggggctggggcccgcactcctgggtccctgagggaggagcacccgggggcctggatttcagggttcttggaggaggagttgggggtggggagggtggggtggctgggagcccagactcctgaatccttgaaggagggggctgggacctggatcccggggtccagaatctggagaaggctggggacacttcctggattcaagagggaggacagagatgggggctggggctggtaggatcgtggctggaagagactaggggcgagctgcccgagccctcgggggaggtggaggaagactggctttggagtgcctgcggcagcggaagggttaacgtctggctggaggggagggggaggcgcagggatggggctgcggggctttgaggggtcaagggtgagccgtgccagtgggagggggccgaggaggagggggaggttgtctgggctgccagacaggccagggtcagcggcgggggcaggagatgtctggaggaggagaggcccagcatccatgctccctcggggacccgggattccaggtcccagacccctcctccctcagatctgggagtacaccacccagtcccccacccattccagaatccgagcccccagcccccttttttccaggatccaggagtctgagcccccagtctgttctctcagaccagggaatccacactccagcccctaactccttcaaaaccccagagttcagaacctcagcccctcttcccaaggagcgcggcccccaaccctctgttcctctagaacccaagcgttcaggctccggcatctttctccctttgaagcctgcagttctggggatccccaggcccctcctcctccggaacccaggagtccccacctcctctttagccccagctggagtccagccctccaggggttaagggggcgggaccagctagttgccatggtgccagactgtttgggtctgctctctgacccttgggggctccccagggtccgcagagagggggagggggacctaggcctgggggaagtccagagcctaccccttccccaaagcggggctatgggcccagggagttcgcgtttccaccaacgccttgtccagtgaccttgaacaagtcctgacccttctctctccgcctcagtttccccaaggagacactggttggcgggtgggggagatgcttaggtccggggaatctctgagattctcggcttcccctctcccctcaccctcctcctcaggccccaggcagccccggggcatgctgggaacccaggcctgggctccgggccaggttggtgtgggggggtgggggcgggggcagcctcctcccttccccttcctccccaccttggcctgactctcgcccccgcctgagggtctgggaggttgggaaggagggaagggggaagagagctggccgtagacccgtctccggcccccgcctccccctttcctcctccgcccctttcccgcctctcctccccctcctcaggtcgctaccccagccctgggccccttctcaaaccacccccaccccacccccagctccagacctggctcgagctgcgagggggagggagagagggaaggagaaaagagagagagagaagggagggagacccaaagagagaagggggaggggaggaaagagagagacctaagagggagggaaggagagagagagggagagagacagagactgagagagagcaggagacggaggtgagggatggagagagggaaggggcggagggagaggaagtgaggaaagacatccgaaaaaagggggtggagaagggtgagaaagaggagagagactgagagagggccagagagagaatgagagagacaaagagggggaagggggagaaggggaggatgaaagacagaaggtagaggaaaagcaggagaaagagggggagagaaggaagaaaacagaagcggggagaggagagaggcgatgggcagagagagaagccagcgcagagccagggagggatgtcctgatgcaggaggaggctgggaaccagggaaggtggaaagaaagagggagagagaaaaaggcagggccagagagacctggactgcgagaaaggaaccggaaggtgcgcctggagcaggggcagcgagaaccagacagtccaggaggaggggctgggcacgggagagaccccagctggaggggctcagagcccaggggtggggagggtgggtgctgggtcccggggtccagaagctggagaaggctggggacacctcctggattcaagagggaggacagagatggggctgggcagactttgggagcctcttcccctctctgaggctcagccccctcacctgccaaatggggatgctgagggcacctcgctctctggagtgggaggtgtcagggagaggactggtgctcagggcctggtatggggtcagcgctgggagattgtggctgtcatagttgtaaatgacccaaagaagggaggagagaggaaagaaagcacctagggaggctctgatggttggctagcccctggcctccttagccctgggcctggagtctctgcagactgacaggagggtaggtaggaagcaggtgtgcccaaagggccaaattacgagacaaatgaggttccctcccagccggcacccaggaagccaggttttctatcaggccatgccttccccaggaggcctgcctggccggagggaggaggggctgggggcagggactcctgggtctctggggagaaggaggctttggatctggactcatgagtctgagggaggaaggggctgagtccttggattccaggaacatttggggagaaaagggccagaggcctggattcctgggtctgtggtgaggaagggcctagacttctgggttctttagggaggagggggatgagagccttgactccagggtccctgatgaggaaggggctgagggcctggactcctgggttccttggggaggaggggccgggggcccggactcctgggtcctggcacccacccgtagaaccgaccttgcggggccttcgccgcacacaagctcgtgtctgtgggtccgtgtcgggggctcaccatcgcggctggggcctccccggccctccccctcatccctggtcctcctggtccctgtctgtctgtctgtcgggtctgtccacctgccgcgccccccgggctgaggtaggaggttgtatagttgaggaggacacccaaggagatcactatacggcctcctagctttccccaggctgcgccctgcacgggacggggcccggcggggacccccagccccactcagggacccttagccccactgggctgccccagggaccctgggaggaagagccgggctcttttctgtccttgtccctgcatcccctccttcccctgaaatctgttttccttccctgtctgtctccatctctgctgtgtctctgtggcttctgtgtctctttcacagtggatcctctgactccctcttattctggctttctaggtctctgcccctcccgatatctctctgtgtctctatttctgtcgtttttggtctttctgtctctggctctcagaatgtctctgtgcctatctccatctctgacccccaccccagggtctaccgggccaccgcacaccatgttgccagtctctaggtccctgagaccctttaacctgtgaggacatccagggtcacaggtgaggttcttgggagcctggcgtctggcccaaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcgggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggaggatacagacttgggagggcagagactcagaaacagaatgttcgcattagggacatggtgttgcggggagctgcctcccccagcccctgctccctccctcaccgccagactatgatgagagaagccacctgcatgacaccttcacccagatgacccatgccctgcaggagctggctgctgcccagggtgagtgtgtggggatggggagatgggagatgtggacttggagcccctaagaaatgggtatgtgggagggcccagggcagaggaaggaggcccccagagttgggcagtgatccgggaggggaaagctgggaagacattgagctcagctacttgtccaaacgaaggctgaaggcagctctaagagccaggggctgaaggtggtgagggggaagggacgctgcagaaattgcctagagctggaagtccagatggggtcgggtaggcataggttctgccatggctgcatggctcacactcttactggctatgaagttctgggtgtgtcactgcccctctcctggcctcaacttacccatctgtaaagtgggacaatcttcttgcctcctaggatggccatggagctcagtgcaggggttggggctgcctgatgagcctgatcttagggaaggcatcttcctctaggatagaacacacacacactcgcacacagacacgctcagagacatacactcacactcacacacacacacagatttcttataaagtgattccacatttttgaggtgtgaggcaattagagggcgggaaaacaggaacagcagagtggatcactcaggtgacagcagtgaaaagagacaaggtgtgactgtcctggtgagacaggcacatgtgacagccttgaggtgtgtggctgtgcgaagagacctcagggctgggggccacgcaatgccgatgggcagcatgggcggtaatcatgcctgatcaccatggccatgatccccacgaggtgccagaccctggaactgtggaggctcggagttgcaggagttacagagccctgcgctatagaataaactggcttcctcttaggtccaggagctcagggcttattcccacacccacagtcgctccttttgcttcctgctttgccctccaagcgtcctgtcaacaatcccggaagagggaaggttcccatccacccagggggcatccagggccagcctggagaaggcctcagctgtggctctccccatctccaccctaaagggagacctgaggccctaaacctctccatgtgggggtgtgcaggattccaagaaatgccctttctccccacataggctgccttgttacagaagcttttgaaaagatgaggaacctttggatctgggaatggaagccttctgtggggccgcatgggggacaaacttggaggggagagagaagaggctgggtgagggtccaggccagagcggaggcccgagtgggggctggggccgtgaaggtggagaagggccagggccagagagttaggtctgctgggctgttttgggaagcatagagaacagcatctgagacaggtcctgctctgtgcctgttgggcggtgggtcatcaccgaaataaggagcctgagagaaagagccgggggcagatgataagctgggttagaaggcagtgactttgaggggtcccagggacgtttaggaggcagctagatacctaggtgcagagttcagcagaaaagtcagagagtgttgagtctctttcctcagggcgctggggagctgcagcaggagtgtgagcagtgaagaagtaggggcagctctgggtgtagaaagaaccctctggggtcgtgtcaaagatggaccagagggagagtctggaggccgggagaagctggtgcaatacgttcaattatacttactgaatgtgccaggaacaaccgctgtgaccaaaactgcaaaccacctgtcctcgggttgcttatattggggtggagtctggggagatagacaataaacataatcgataaaatatcttagtatcttagtatgtcagttggtgatccctgccatggaggaaaacagagaaggggaagagaaaggggtgatagtttttttgtttttttgagatagggtctcactttgtcacccaggctggattgcagtgatgtgattatacctcactacagcttcaaactcctgggctcaagcgatcttcctgcctcagcctcccaagtagctgggactataggtgtgcgccaccatctttggctaattttttaaatagtttgtaatgatggtgtcttgttatgttgcatgggttggtcttgaactcctgggctcaagtgatcttcccacctcagcctcccaaagtgctgggattacaggcatgaactaccgtacctggctgggtgataattttaaataggttggtcagggcaggtggaaatgacagggtccagttgagcaaagacctgagcaaggtgacagtgacagcgacagccatgcagataatctgtggaaagagattttcaggccacagggaatagccagtgcaagaccctggggcccgtggggctggagtaaaggtgaaatcagagagatagcaaggggccacctcctgtagatcctcatagacagggggttctcaagccccagcatacatcagaatcccctgggagcttatttaaaatgcagatttctgggcttcaccacctctgaccaggaggtccaaggtagggcccagacatggacgtttctgtcaagatcccagggaatgctgatgctgctgctccgggaacactctttgagaatcactgttgtaggcccttggaatgacttttgttttttgctcttgaaatgggggagctgttggaggactttacacagagagacaggatctgacctgggatttaacaagatctctctggcagctgtatggggcctggacaaaggcaggaagacttccagtgagaagccggcccatggtggcttggaccagtcacagtggtccgggggcccagatgaggtctgagcagagtggggtgggcataaggatttgaccgtgtgccaggcttgcccatgcgtgcaaaaggctgtgtttgccatacacagagtcattcatattaagtatcttcctaaaggatatcctctaccggccctgtgaggctgggttttatagccccgcttatcagaagggaacgctgggctcttctggacaagaacagtaggcccaggatatatttggagatagactggaccagatgtaggtgggtgagggcaatgggaagaatcaaggatgacttttgcgtctcctccagagggagcagcagggagatggaggagctgatgtaggctgactgcctcttggtgatcccaggtgatcttatttgtatatatgtatatataaaccatggagtagatgacgtggtacagactggatgcagtattaggtgtggagattatgtatgcagcgattaggtgtggaggctctggagcctgaccaccagggtcaaatgtagccatgtgattttggaccacttctctaatctccccatgcctccgtttccccacctcaaacttggagatggcaatcctaagtttgccagccttctctaacactcactacgtgctaggagccattctacacacttagtgacaccatctcatacaatcattaaacgatgccatggaagagtggggatgaggatgctttcatggttgtatggcgtctcatcctcccgctaattctgtgatacagacactgctgtcatcctcatttgatgaatgaggaaactgaggatcaggaaggtgaagtcacttggccaaggtcgcatggggaggagggcttgtgattgatactcagatctgagacaggtgtgctcaagacggaagcaccaggactcagacccagatgatctgaaccagggtcagagctcctgacgatatgcaactcctctgggggagactttacaacacccacccatgccgccttatggcccgcttgctataacccaggccacttggcctgttcggaacatttcactccacttatactcccctggtggagtataagcccacccggccaccatggcttacttggtatatcccacgctcaccctgcccatgagtcatttgatttggcacatagaaattctttggatgactcctccaacatcctggcctctcatttgtgcaccccagtctgaccacatgctcctgatcatcctgccatcttgagaccacactcctgctctgtggccaaggagagaccactgggtcctcatttggaacccacttctgggcatcagtgcttcctctctccaagtgtatatccagtgatcattgttttaggcactttcttgccaatatcctcagttccctccctttttgtatggctttaatcacagaggacgctttcccctgtccctgcaatggctttaagcccgtaggaagtttagctctcctatataaagtaagtcttgtggtaggcacttaaggctaatatggcacctccatttcttggggatccaagctccttcaagacttaatatcccagggagtagcccttgtcctcatggtcccgtgtggctgctagagctccaaccatcaaaacaaattttcaggcagcaggatggatgaggggaacaataagatggcaccaccttctctgtctttgttttttagagacagggtcttgctctattgcccaggctgggtggagggcagtggtgcaatcatagctcactacagccttgaactcctgggctcaaccatcctcccacttcagcttcctgagtagctaagactacaagcacaccatcacacctggctaatttataaaaatttgtttagagatggtgtctggatatgttgcccaggcttgtctcgaactcctggcctcaagtgatcctgtcacctcagcctcccgagtagctgtgattccaggtgcggtaccacctcccttttaaggccacctcctgtgactcacataacacatccatttgcatcctatggctacaacttggtcacatgaccacaactgcaaggaaggctgggagatgaagctttttatctgtgttctgtggatataggttatagatatataggtatttggaggcagtgaacaattcctgtgtgttggtttgctaggaccactgtaacaaagtaccgtagactgggtgactcgaacaacagaagtttctgccttctagaagtctgagaccaaggttttggtgtcagcagggttagtttcttctcacgcctctctctttggcttgtagatgccttccttcatatgtccctgtgtgcatctctgtgtcctaatttcctcttctcataaggacaccaatcatactgcattacagcccaccctaatgacctcattttaacttaatcacctctttaagaaccaagtacagtcacattctgaggtactgggagttaggacttcaacatacaagtttggttgcgggggatggggggtgggcggcacgatttagccgataaaaccctgccacattactgatttccacaaatcaccacgagatcaagtcagctgtctattcttattccactggaacaagccacaaacccatacaatttggaggccattgcagtggtcaaaacacaaggccaggcatggtggcccacacctgtaatcccagcactttgggaggccgaggcaggcggatcacctgaggttaggagtttgagaccagcctggccaacatggtgaaaccccatctctactaaaaatataaaaattcgccgagcatggtggtgggtgcctgtaatcctagctactggggaggctgaggcaggagaatcacttgaacctgggaggtggaagttgcagtgagccaagatcacaccactgtacgccagcctgggcaacagagcgagactctatctcaaaacaaaacaaacacctacaaagacaaggaacataaaagagtaaaagatgggtaaatatagaagtgaatagaggctggggactatggagaagtggccggtgtgtgccccatttcaagggagtgactgctacccatctccagctaattgctgccttatggaaatgcgatctctgtgttacagctcttccaactttgtaaaaaagagatgccaaacgttttatttgacattccaaattttatatgttggcaactggttcattttcttttaaacactttccaggccaaatataacacatcccagggatggatttgggtcataggccaccagctggggtctccagttcaagttggatcctggaattcattgtacaaatacttactgagcacttctaagactgagggccctctccaggatccagaggacacagtgctacagaagaacatgtttatttacttacgagacagacataagtgatcatcatctatatataaatatatgtaattgcagacagatgagagc

SEQ ID NO: 182 - DNA, 19146 bp, Homo sapiens
ttatcacgtaactctacatgtgattggctaaagagtcttgctgaggtccaggaaacagagacctagggaggaaaggctctcctgtcacctgcaggtcacctaggtcaccaggcagaggcataactgcctctactgctagaaggaatatcttttgttagctaattacatagcaagaaactccacttttggctgggtgcggtggctcatgcctgtaatcccagcactttgggaggccaaggtaagaggatcacttgagcccaggagttcaagaccatcctgggcaacacagtgagatcccatctctacgaaaaatacaaaaattagccaggtgtggtggtgcgtgcctgtagtctccactactcgggaggctgaggtgggaggatcagttgggcctggcaggtggaggctgcagtgagccaaaatcacaccactgcactccagcctgggtgacagagtgggaccctgtctcaaaaaaaaaaaaaaaaaaaaacaaaaaacaaaactctactttctggaaatcacgaatgcagatactttataatagctatagctgtaaatattttcaaaacctaattggggcttatggattaaaaagtatattagctgaaaacattttgactcaacacaattatacccagtggcattagaagagaagcacttaatgatacattatgcttgtggctaacaaagcatttgcactaaatgggtaacattttcatttcctatttcaatttccacatcgtttgtagagagcttcattacatacaccccaaacctaagtgaaagattgagcctgtaaattaggattctgacttccccatttactccaaactcttaaatggcttattttctatttctacaaaagccagagatcaagaattcacgcaaaagtcaggggatttaggaaatattaattcatctcccttagggagcccagtgccaaaagaccaaccacaaatttaaaaaataattatacattgcagggaggcagaggtgaacagaagacggagacaaggacaaagtcatgataagaagagaggaactgttttttacagaagctgacaacataaggaaacatgttagctccctttttctaaaaggtaaggaaggacaactatgaaattaattgttctgttagtggactatcaaggcaattaagtcttgatctattcggtatatttcctcttcaaatcataacacttattgaaatctggagagttggagtcatggtgtaagagtcttgtattttccgtgggctgtgtgaaggtgatagcattttgcacattccgctggtagcacgtatcttgctgcactgtaacgttgtttacatttatatgcaccgtgatggattatgaactcctgcgggtctgggcctctggactcataatcctctgtacaccagtacaacccattaaacatttcacagatcaactatgaagcagatgcacctttaccctacagttccttaaaactcattccatattcaattaatatccagaaggtctagaaaattcttagtccagcaatgaaatctggtagtttgtcaagagtcaactggtgttcagttgtttttaaaaaacagattagagttacttaaaaattttctatgggaagctgaggagggaggactacttgagcccaggaattcaaggctgcagtaagctatgattgcaccactgcacaccagcctgggtgacagagcgagaccctgtctctaaaaaaaaaaattctctgaaagtgcaatgagagagtttgtagtgaatagaatgctaaataaatatttgagaaatatattcaaagtgtgataggagaaatttaattttcacagataaaataagcttctcaatgacaaataactttgcaaaaaatttgttgccacaatggcactcaaatgtgtattcactttcctgtattcactaatactttactgtttttcttttctgtttttgtttttcattgttgttgttgtttgtttgtttgtttggacagggtctccatctgtcgcccaggttggaatgcagcagcacaatctcagctcactgcagcctcgaccttctgggctcaagtgatcctccctccttagcctccccaagtagctgggactgcaggtatgcaccatcatgcctggctaacttttttgtatttttagtagagacagggtcttactctacttactctactccatgttgcccaagctggttttgaacgctcaagtgatccacccgcctcagcctcccatagtctgggactacaggtgtgagccagtacacctggccctgtttttcaaatactataactgcttccccagttggaaattctaaggatcagtattgacccattcactcgtttactcactgattcacttaaccaatatttatcgagttctcaccatgtgtctaagcactaaggatatatatatatatatatatatatatatataatttttttttttttgagacggagtctcactctgtcgccaggctggagtgcagtgccgtgatctctgatcactgcaacctctgcctcccgggttcaagcaattctcctgcctcagcctcccgagtagctgggactacaggtgagcaccaccacgcccagctaatttatgtacttttagtagagacggggtttcaccatgttggctagaatggtctcaatctcttgacctcatggtccgcccgcctcggtctcccatagtgctgggattacaggcgtgtaaggatattttagtgtatgaatatagacatgccattgtggagcttagagttatcaaaccaatacacaaatagtcgaaacatttcagctgtgataagaagatgtatttgctgcacctggtgctaaagttattataagggagatttgctttaagccgggtcctcaagggaagctccctagaagaaatgatgaataaactaagatctggagggttgtagatgaaccaggtcaacagagcggggaagagcgatgcaggcacaagagaagccaaagtttctggtgtgggaagcaaagccagtggggcagaggctggagaccgtgccagggcatagataggtgttacggaatttgacttatccttggaaaatgggaagtcactgaagtgctttaagccagagaggggatgggttgagctatggtaagatctgatttgccttgcccgaggcgctctgatcctgtgcagaggaaatattagggggcagttgaattggattaggagttaggtgacttggacaggaggcttgagggaggcctaacgtgccccaatcccgcaaacagtggctccttcttagcaaaagtcagtgttttgctgcaaaattaaaataaaagctgaaaatgtacttcccaacttataaggagatggaatgccagccacattgaacccaaatgattttttaaatgtaattgttccgccacaaagcctacaagcttcttaaaggcaggacatgtatattattattattgattgtgtcttcaggccaaacataccagataaagtgattaaatggttgtcaaatacatgaagaaagcatggtgtgtttgtttgctagggccaccgtgacaaagtaccacagaccaggtggctgaaacaatagaaatgtattttctcatcttctagcgggtagaagcctgggatctgctgggtgcagtggctcagacctataatcccagcactttgggaggccaaggagggaggatcacttgaggccaggagtttgagaccagctgggaaaacacagcaagaccctgtctctgttttttaaaaagaagaagtctgggatcgaggtgtggacagggctggctcctcttgcggtctgagggaaggatctgtcccaggcctctctgcccggtaaattgctgctttttcgttgtcttctcatcctcttcctctatgtatgcttctgggcccaaatttccccttttatgacaccggccgttttggattagagcccactctactgacctcattttaagcttcactgcctctgtatagaccctatcccaatccaaataaggtcacagtctgaagtatcgggtgttagggtttcgacataggaatttgaggagataaaatttagcacacacacccatgggctgtgcattttggtagctgggcagtgttagaagaagccctttaatgtggcagcctgtgctagtagccagtgggccccgtcgtgggccaggcatgagcagagttggtggtgggtagggcagggcagagagcatgcctttacctggtctcttcaaagcccatctcattttctttctttccttttttttttcagatggagtttcgctctgttgcccaggctggagtgcaatggtacgatctcggctcactgcaacctctgcttctcaggttcaagcagttctcctgcctcagcctcctgagtagctgggattacaggcatgcaccaccacacctggctaattttgtatttttagtagagacagggtttcgccatgttggccaggctggtcttgaactcctgacctcaggtgatccgccggcctcagcctcccaaaatgctgggattacaggcgtgagccactgcgcctggccccatctcattttcttgaaaaggcccaagtaaagtagatagattttccaaactgttagaggttgaattgtgtttcccaccgaaaaaaaaaaaaatcctctgttgaaatcctaacttccccagtacctaggaatgtgactgtatgtggaaatagagtctttaaacaggtaattaaattaaaattaggtcattagttgtgctgtaatccaatatggctcatgtgtttacaagaggaaatctggacagacaggtgcaggcatgtgaagacacaggcagaagacggtcatctgcaagccgaggtgagagacctcaaaagaaaccaaccttgccgacactttaatctcagacttctatttgacaggatgatgagaacatagatttctgttgtttcagccacccagtctgtggaattgtgttatggcagcctgagtaaactaacacacaatccaacctggctagcactcctactctcaaagcccaggtttcactcaataattccaaaccatggttcacttctttttttaaaattagtattattattttttgagatggagtctcactctgtcgcccaggctggagtgcaggggagcaatctcagctcactgcaacctctgccgcccaggtccaagcaattctcctgcctcagcctcccgagtagttgggattacaggcgccagccaccacgcccagctaatttttgtagtttttagtagagatgggatttcaccatcttggctaggctggtcttgaactcctgacctcgtgatctgcccgccttggcctcccaaagtgctgtgattacaggtgtgagccaccgcgctcggccatttcacttcttattaatcacgaccagtgtttcctgagcacttaccacatgtcagacatggtactaagaatgttatcagtgttatttacttaacctgtacaaatagagatagggactattatgaacttaatttttatagaaaagaaacctgagagtaagagacatgaagaaacttgcctgaggtcatccagaaggaagaataaggagtcaaggtgtctccaaggcaatgcccttccaccccgagcacctctgtgctggcctgagaacatgttccaggaggcagagcctcacttcatggtggggtctggggcacagccaacacatctgggggcttagattatgaagaagtgaaggtatcccttaaagcaactttcctagtttcttggattggcttatgactctagtttcttcttaattcttgcagaaatcataacccctctattaacagtattaagactatgccatgctggccaggcacggtggctcacacctgtaatcctagcactttgggaggccgaggcaggcagatcatgaggtcaggagatcgagaccatcctggctaacacggtgaaagcccgtctctactaaacatacaaaaaaaaaattagctgggcgtggtggcgggcgcctgtagtcccagctactcgggaggctgaggcaggagaatggcatgaacctaggaggcggagcttgcagtgagccgagatcgcgccactgcactccagcctgggcaacagagcaagactccatctcaaaaacaaaaacaaacaacaacaacaacaaactgatcttaagtagaggaaaagaagattgaagattggaagaaaatgacagatcatcaaatcacaaagaaatgggggaatgtggaatctgtccttgatgactgccactgaatattcacactaacatcacagtgaggtccctgttcatttgtgcaggagaacatgtacaaacatttaggcagaacatacgcagagtagagtatacagacctctccctcctgttcaggcttttagctggcattaggggtttgagaccttggaatgttgtcaaagaaaaacacactttaaaagcccgtttccaaaagggtgacaaacgggactggatgatgtgtttaacctcatgaaatattgaactcttggatgtaaatctgcccatatcactagagatgaaagagttattcctgtttttatgtctaattgtggaactggtgaaatttgcatttccctagaatcactgcccctgttgatagttgaaacacacagttttgaagaacagcaaatcatactctaagaggcagtagtcccctatgtcctgtcgttttccctgtttctgccttctatagacacccttgccaccactcagaaatgtttgagactttgtggagaaagtagactggtgagaatttcctcgtacttggaagggttaagcactgagtcgatctacagcaagtggcacacccagtttgaggtccacgagggtgaagtaatttatctgtgagtcatatcactgaatacactgttctatagaatgttggttagcaactcacttccaaacatcgtggccaatggttctgttagacataacatttgaaagtgagatgagttgctcatgtgggcttagcaataggcaatgaaacgaatctggcattgaaacagacgtgggtttttacaatgggtttagactgaaaagaagtgctgtgttgcatgagtccatcttcacactaagcatgaaagccagagaaggaccatccggtgctcctggtggagacagtgtctcgggacactgcctgtgaggttttcaggataggaaaaagaagagaaaaggaaacccagccccttggttttcttgttttataatgtggccatttcagaggctgtgactataggattaaatgcttagcaattggcaggactttatattgactggtgtttaaaacttaaaattcagttattccaaccacagatactattaaaagaactctggagtcaagaggaatgagcaggcaagagggtgaggctgtgtctatggctggaggaaaggtgtgatgagttgctgttttgttgctaggcaataggttttatgtgacaacaattcctttcctttaaagaactagagtgctctttttgtttaatgaaagcattagattttcttggtacaagaggtacccattgagtttacgtgaatatgtggtattatagtaaacagtgcttatgaaagggaatgctattctatttttgaattcttttgttttacattgccacctctagaaatcatttgcctgaggagatgtggttttttccttttctcaaatgatttctgttgtttggcttgtctgactgtaaacctctaaattacccccagctgttatgaatgtgcttctgaatttctcaacagatagcatagcatgtttgtgtttggggatgttagaagatttgcttttataattccaaactagttaacaaatcctgatgtaaatatgttatggtatcttctatatttcttcttttattgatcctattataatgtaaaatgttgtagactgcttatggtcacattaagacagggccatatatctcttgcatccttatagccttaataccaatctaacataaaacttggcatatagtttatatcaataaatgaacggttgttgaataagtgaatgaatggatgcacaaatcattgatatactgttgcattttccagtgacgtggatttatttatttatttatttatttattattttgtttttgagatggagtctcgctcagtctcccaggctggagggtagtagtacgatctcagcttacagcaacctctgcctcccctgcctctccggttcaagcgattctcctgcctcagcctcctgagtagctggtattacaggcatctgccaccatgccctgctaatttttgtatttttagtagaagatgaggtttcaccatgttggccaggctgatgtaaaactcctgacctcaagtgattcacctgcctcggcctccccaagtgctgggattacaggcgtgagccactgcgcctggcctgataatattcttctatattttagagaccatggagttaattctaaaaatggaaaatacttaggcctgaataccagcccataggtttactatttttccctaaggtaatgtcttctccttaagcagcattagagctttgctaacatgccatctaaaaatgtaccccccaagctgggctcagtggctcacgcctgtaatcccagcactttgggaggccgaggcaggcagatcacctgaggttgggagtttgaaaccagcctgaccaacatggagaaaccccgtctctactaaaaatacaaaattagctgggcatggtggcgcatgcctgtaattccagctactcgggaggctgaggcaggagaattgtttgaacccgggaggcagaggttgtggtgagctgagatcgcgccattgcactccagcctgggcaacaagagcaaaactccgtctcaaacaaacaaacaaacaaacaaacaaaaaaatgtatccccccaagaacaggaagaagtgtcatggaggtcttttattttcaacaatatagaaacatttttggatgaactttgtctctcaggttttggagaattaaaatgcctcccttatcccatccctgccacactctaggacattgattcatgttcccaaagaataatggttagcttactgtatgccagctactattcttagctccttacatgaactaatccttttaatcctcacaactacactatgaagcggatgctactattgtccactttatgggggaagaaactgaggcacagagaggttagcttgcctcgggactctgtctctgctgagattggaagcagaagactagttccagaattcacactcctaaccctactacaacacctgctctcaaacagagaagggaaaggaagtcctggcgtttgcactctccttgatcttgtgctggtctggtctggacatggaccaaggcttgggggccttgcacacgtaagtgagtgcagatgcccggcccagccccagggctcccttgtccttgagctggggccacgctgaggctgaggctggcctccatggcttgacttgaggccacctccagatccacaccctgaaagcttgggactggccttctcagagaatggggcaaaacactctgacgccaactacaaccatcacaaggaggtacattctctgtaagggcaagcctggggctgcacccaagtagactagcagacactcattacagagagaatgttctggcactctggccctgccaaaggctaccagaacacagaaggccctttcttccaaggggccgaaggaggagcaggcacacaccatatgcctcactcaccacacgaaaccacacaccacatagcacacacgcgtgcaccctcataccacactgacccttcaccacacacacacccatacaccttcatgtcacacataccacacacacagatataccacatgcaccccatacaccccaccacacacatacaaacaccacaccatatacacacacacacagtacaacatacacactcacacaccatatgccacacacatatactttacacatatacatacctccaaacacacaccatgcacacacacggtacaccatacacacaccacacactatgcacacaccatgtaccacacacatacccctccaacatcacatgaacactacgcaccctcccccataccacacacatacacgcacacgtaccatgcacgcacacacaccacaatgtgctgttacttaacaggtttgccttcccacaactctatcagcaaacccttctggaggcgcagcccacacctgcattccaaagaacgcaaatcccttccctgcccgatgaaaggcccctcccacagtgagtcacagaaactgcagccgagcaggcagtggtgggccccacccttctcacaggaagtgagaaagagtaaatatgtagtttttctttgagggccaatgcacatgttaaatgggtgattaagaagacagagagctgcttaaaaggtcatgggagaagtacaatgtctggggacttggcagtagcctggcagagaccgcaggaatcctatagagtcttttatggacagggctctgaaattccagagcctgcaggaggtaccttcccctttgactcggcggggctgtaccactaagaatgcactgagcattgggtgcacttgggatacctgagctgtggggccagagaggcagccctaggggagaattccggagttggggctgggttctttcagcataaaaaatcaaagtgtcgcttctttaatgaacctcccggcaaggtcttccctgaagaccttgaacaagtgttcttaaacaagtgttcctttatgcaattaaaggccagggaagctggggtctgagaggccatggagccattgggataatagtgacagttcggctaccattcaactgggcttctgatgaatcatgctgggggcaaggactccaaatcaccagctctactctatactcgaatcagtaggcagttcagacagtcttgggggatttgggcaaacgaacgctccacttagaatctctccagaaagacaaagggggtgcctaacaaacaattcaaggactgtgggaaaccaatgatcatcaagggctcagttgtacagtgtaaaccaaaaagtatctgagacaggtctcaatcaactgagaagtttattttgccaaggttaaggacaggccagggaggaagaaacacggaatcacagaaacagtctatggtctgtgtcgttcttccaagatgatgttgagggcctcgatgtttaaaagggaaaagtgggctggagaggaaagaggaagggcatgggaatctacttgttgcaagggaaaaggagcaggaagaggaacaatcagttacgtttcctctagcagtctgtaaattggtgctttacataagatgagcatagagtttagctgcctgtggtggggatatctagccttttatctgtagctatctgcttaggcacaaacagaaaggcagcttcttgcatgactcagcttctagtttaattttttcctgttgccaagaaaaaactggggtcctgagagtttttcttttcctttcacaacaggaagaaacaaactacagagcccctaggtatactggggccacctggggtcttgttaaaaatgtgcatttgggggaggggcggagagtctgcgttccccccatgcagtgcccaggctgctgctctgtaggccacactttgaatactgagagtaccagagaggacttggtggtagggggtggtgggtggattctggtacagttggagggaggaggcttcctggggtgagggcactgagatgggtcctggtggtaagattgtgtggggaggagaataaaggtaccccagatcaaccttgtggggcaacaagtgacctgacaaactcccatcatgtatggccactgtcccccattcaaggccagggaccgttggaggagttggaaagttaagagcttgaaaactggattctgcctcactgggaggttcactgacatttagtcttctctgaaagatgggcatagttataccaatcctacaggagtagtgtgaagattaaatgagatgacatataaagtgcttagggcctggggcagcataagtggtagaatatttgttcatattattattgttattattattagctgaagcaatttttttttttttgagatggagttttgctcttcttgcccaagctggagtgcagtggcacgatcttggctcactgcaacctctgcctcccaggttcaagcaattctcctgtctcagcctcccaagtagctgggattacaggtatgcgccaccatgcctggctaattttttgtatttagtagagacggggtttcaccacgttaggcaggtctggaactcctgacctcaggtgatccacctgcttcagcctcccaaagtgctgggattacaggcctgcaccaccgcgcccggccctcctgttgacttcttttttttctttttttgagacggcgtctcactctgttgcccagactggagtgcagtggcacgatctcagctcactgcaacctctgccttctgggctaaagcaattctcctgcctcaacctcccgaacagctggtattacaggcatgtgccaccacgcccagctaattttttttatttttagtagagacggggtttcaccatgttggccaggctgctcttgaactcctgatctcaggtgatccacccgcctcggcctcccagagtgctgggattacaggcctgaaccaccatgcccggccttcctgtttacttctgagccctgggccaacatacttcagaacagaaggcccctggtggctggaggggctctcttctccctcttcatggccctgaaggggcggggcagtggtgacactgagagggacaggagaattggacctgccttgacaagacggcagcaaggcctcattccctggggcctagaagaaggtgactgcgctgggcatacacaggggagaggattcagagtattcaagacgaatatattgggtagaaaaagttatttaaaatatttgaaacaagtctcatttttacactgaaatgtcacagtccttcaggctctctgttttagccaaaggacatcaggacatggtcttacccgagatatagccagattcagtataggtacttcttagtgttaggtgttctaatgcctgtgtcctgccccagccctccatgagagccaagagctgtgctgaatagaattgctgagcccttgcagaagagggtgtcatattttccaaatattccctttgcaagataaactagccagaaggtaggaggtgtcaggcagcgccgagcaccggctgggccagacctctggaagagcaactgggaatgttgattacagggcaagaatctaaacagcagtgatttattttccaaagttgctggcactttttaatccctttttctctcttcctcttccctttaacagggcagagcaaacaatcttcaggccaatgcaatgctttgtgggttttttgcattgatttgtacatgaaaccatgttttttttttttttttgagatggagtcttgctctgtcgcccaagctggagtgcagtggcacgatttcagctcactgcaacatccacctcccgggttcaagcgattctcttgcctcagcctcctgagtagttgggattacaggtatccaccaccatgtctggctaattcttgtatttttaatagagatgagatttcaccatgttggccaggctggtctcgaactcctggcctcaggtgatcctcctgtcttggcctcccaaagtgttcggattacagatgtaagcctctgctcctggcctgaaaccatgaattttttatgtggccattattattttataaatgctgctttctttctctatctgttcttttcagtacttagccagcgtgcagagaagcttcccagttaggaggtgaagaaacacaaggctgcactggatgcggaggctcccacctggaatcccagcactttgggaggccaaggctggaggattgcttgagcccaggagttcaaaaccagcctgggcaacatagtgagaacctgtctctacaaaaaataaaaattacctgggtgtgatggtgcacgcctgtagtctcagctacctgaaggacagaggtgggagaatggcttgagaccaggagattgaggctgcagtgagtagagatcacgctactgcattccagcctgggagacagagcaagaccttgtcacaaaacaaaacaaaacaaaacaaaacaaaacaaaacaaaacaaaaaaaacacaaggccacccttcctcacgatgccgcaggtcccctccccttctctcagcatggctggagagcccctcaactgtggcctgctgtccttgatccagtgccccacgctgccccacccttctggggagcccacctcaaagagaactccctggaggctcctacagtggcctccggctgaccaaagtgtgctgtgggcagaagcccctgcctccctcaccatgtacttcctcatcccagatctcagtccctcaagggccaggcaggtgtcatccaagacgacaagccatctcagtctcatgtactgtggggagaagacctcccagagccctctaccctctccttgagtcatacatgcttttttttttttttttttttttgagacggagtctcatttgtttgcccaggctgtagtgaagtggcaggatctcagctcactgcaacctccaccctctggattcatgtgattttcctgcctcagcctcttgagtagctgggactacaggaatccgccaccatgcccggctatttttttttttttttttgtatttttagtagagacagggttttgccatggtggccaggctggtctcgaactcctgacctcaggtgatccacccgccttgtcctcccaaagtgctagaattacaggtgtgggccactgcgcctggcccatacatgcattttaacagctacattcatggatgcatttagcaagcaacctggcttcacatgcaaggcacagtgctaggaattaggtctacagggatgagcaagatgtggaccccgcctctgctgtctccaggccactagggacgatggtcggggaatagaccactgagattgaagtgatgaaagtctcaaggaaagaacagggaggcagaggttgcagtgagccaagattgcgccactgcactccagcctgggcgacagagcgagactctgtctcaaaacaaaacaaacaaacaaaaaaagaactctggcattccactgaacacgttctccttcaaaactgggtccaatcattctgctgacaccaagagagtgcctaaagggacagcccaactcaggccttagatttatcttgagagaaaagtcctagaagcattttgattctcatagatgaaaggacaccagcacggaggacatgattggtcttctcgcctctcaagctgcggtggtgctgtccgatttgtgcatagccagaggaagatttcctgagaagccagtcaagcatgagctccagggtccttgcctgtgtgcccctcttccaaggtcctgtaccgattttttaaaaattcataattgtataatacttttcttaaatggtgtggggcacaaaacatagacctgcatcgtaagacctggctctacccctggaatatgtttctgatctgaagatgacaacctggagcagtaagcccttcagtccttggcaacaattaatcatgttttgattgaacatggctcctaattgtaaggaggcttcaatgttaagaagtggtttgtcttcactgtactgtagattctgacttcaatacacatgtgacctcaaaaagtaaattaatgccgccagatccaattcttcacatcctttctgtcagtagcgcaggttcaagaaggcagctggacacactgcctggcacaaagtgggtgcctgcctccaggttagtgaatgcatgctagcaattgtggcaaaaacttgttagcctcagtgtgtttgaagtccttggtttaaaaaaataataaaaaatatagaaaagttgcaagaataattcaaagaactttttagttcttgaataatttgaaagtaagggcttggtgtggtggctcacacctgtaatcccagcaatttgggaggccaaggtgagcagatcacctgaggtcaggagtttgagatctgcctggccaacatggagaaaccctatctctactaaaaatataaaaatgagccaggtgtggtggcgcatatctgtagtctcagctactcaggaggctgaggcaggagaatcacttgaacccaggaggcggaggttgcagtgagctgaaatcatgctattgcactccagcctgggcgacagagtgagactctgtctcaaaaaaaaaaaaaaaaaaaaaaaaagtaaggccgggcggctcacacttgtaatcccagcactttggaaggctgaagtgggaggattgcttgagcccaggagtttgagaccagcctgggcagcatgaagagacctcatctctacaaaacaatttaaaaaattaaccaggtgtgatggtgcacacctgcagtcccagctctttgggaggctgaggtgggaggatcacatgaacccagaatgtggagtctacagtgagccatgatcacaccactgcactccagcctggactacagagtgagaccctgtctcaaaaaaaagaaaaagttgcaggcatgatttccttgtacctctaaaaacattagtatatatggcccacaaacaaagacactcttccatacaccctcagtataaccatcaagatcaggacaccctgttcaatgttaaccagttgtccaaatgatcttattttttaataattaaattaaatttcagattcaaggggtatacgtgcaggtttgttacatgggtatattgcataatggtgacgtttgggcttctagtgtacctgtcccccaaagagtgaacactgtacccaataggtgatttttgaaccctcacccctcccaccctctgaatgatgttctttgtagccaaatgatccagtccaggatcaggcacttcatttagttgtcgtgtttctttagtctctgtcagtctggaacgtttcctcagtctctccttgtctctcagaacagtgacattttgaagattacaggcattattttggaaaatgttcctcaatttgggtttgtgtgatgttttctcagagattcagattatgcattttggaggaatttcgcagaaatgattcatgttcttattgtatcttatcagggggcacgtggttctgtttgtcccattatcgatgacgttaacttttattttttggcagctcctgcctgaggtttatctacaaatgacacagaaaggacaccaggcccattcagatggcaacccaggaagacaccagtccttctgtcctcacattaacagaaggaggcctctgctcgagagccttcatgggggctgaggaacctttgggagcctgagctgatggagactgggcctaagcctttggcctacagagtctgagaccctggtgatgtgggcgccccaggcaatgtgggcaccagtacacttcctgaacttgggctgagcaatgaggacaagtcaattgagcctgtggctttggggatctgccttgggatttctgagggccctgatggcctctgcaagtacactcccagccttggcattgttgacctgcttcttctccaggccctattttttttctttttttgagacagtgtttccctcttgttgcccaggctggagtgcaatggcacgatctcggctcaccgcaacctccgcctcctaggttcaagcaattctcctacctcagcctcctgagtagctgggattacaggcatgtgccaccatgcccagctaattttttgtatttttagtagagacggggtttctccatattagtcaggctggtgtcgaactcccaacctcaggtgatctccccgcctcagcctcccaaagtgctgggactgtatacaggcgtgagccactgcgcctgccctgtccagatcctttttgtgcttctttgcaaactatatgtttctcaggaacatcttcatggtttattgatgccatgtgtgtgtcattttgaggactggttgtgtgcgacgtagttgttagacttatccatgtttgcactctagtcggccaatgatttaactttgatcgcttgattcaggtggtatccgtcaggtttttccaccatcagttacttattttctctttgtttttaataagtacttatttgagactatataaatgtcctattcctcatcaaactttcagtcactagttttagcatccattgaagtttcttccttaattattactatgatggttagcaaaagctgattttctaattctgtcattctatctacacttactggttgcacgctactataacattgagctttcccttttaatatctatctatctatctatctatctatctatctatctatctacctcagtatggacttgtggattcctattttattcgatgaatttatcatctcttattaccattatatatcttgatactttaattgttccagacttggctagtgagagcacattcaagttggcttctgtgtcctttggacttatttccattatactttgagtgcttcctgactttctggccaaacaagatgttctaggctccttctgtactttctctgactcagccgtggaaccaggaagccctgctccttttaatagagaatgatttttagaaaccaagattttggtgataggtgtgcttgctgctattgggatctcactgctttagtatcttttaatagtcagaactagaaaatatatgcgtgtacacgcacacacacacacacagatactgaaaacctacagtgcatattgatgcctccaattccaaagcaatgctacatggtttattcagcttctcccctttcatacttgtaactccccctttcaacagtaagaaacccgacactcattatcctgaatatatttacttatttgctcaatctctctgtatgaaactagtctactgactctgccaggccactgccctgcttagcaaactctctttgtgtgggccactgatctcaagggctttagaactgaattattaaggaaagaagacaggaaagccttggtttgcttttagaat

SEQ ID NO: 183 - DNA, 19808 bp, Homo sapiens
cctcgttttagttatctctaagccacaaaaacaatatattaaattatttccatattatcataaaaatactgcttacttggcagtaacaaactgcaagagaagtaccttgcccagcctatttattctttaaaattagatttatagtgtgagtccaactatttttctaactatacagtaaaaagactaaaaaaaataagcaaaatgttaattgtatgtatctctgaatagtgggatcacttaacattaaggattttaattttcttctattttctccattttccaaattttctacaatgattaaacactacttttaaaataaaaaacacagtttttaaaaattataggccaggcacggtggctcacacctgtaatcctagcactttgggaggccgaggcgggtggatcacctgaggtcaggagttcaagaccagcttggccacgatggtgaaacctcatctctactaaaaaaaaaaaaatacaaaaattagctggacgtggtggcaggcacctgtactcccaactacttgggaggctgaggcaggagaatcacttgaacccagggggcggaggttgcagatcgagccactgcactccagcctgggggacagagtgagactctctctcaaaaaaaaaaaaaaaaaaaaaaaaagaaaatttgggggaggagccaagatggccaaataggaacagctccggtctacagctcccagcgtgagccacgcaaaagatggtgatttctgcatttccatctgaggtaccgggttcatctcattagggagtggcagacagtgggcgcaggtcagtgggtgtgcgcaccgtgcgcgagccgaagcagggcgaggcattgcctcacttgggaagcgcaaggggtcagggagttccctttctgagtcaaagaaaggggtgacagacggcacctagaaaatcgggtcactcccacccgaatactgcgcttttccgatgggcttaaaaaacggcgcaccacgagattatatcctgcacctggctcggagggtcctaccccacggagtctcgctgattgctagcacagcagtctgagaccaaactgcaaggcagcagcgaggctgggggaggggcgcccgccattttccaggcttgattaggtaaacaaagcagcggggaagcccgaactgggtggagcccaccacagctcaaggaggcctgcctgcctctgtaggctccacctctgggggcagggcacagacaaacaaaaagacagcagtaacctctgcagacttaaatgtccctgtctcacagctttgaggagagcagtggttctcccatcacgcagctggagatctgagaacgggcagactgcctcaagtgggtccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccataagtagataaaaccacaaagatggggaaaaaacagaacagaaaaaccggaaactctaaaaagcagagtgcctctcctcctccaaaggaacgcagttcctcaccagcaacggaacaaagctggatggagaatgactttgatgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagctgatgtgatcaacaggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctatgtctgattggtggacctgaaagtgatggggagaatggaaccaagttggaaaacactctgcaggatattatccaggagaacttccccagtctagcaaggcaggccaacgttcagattcaggaaatacagagaatgccacaaagatactcctcgagaagagcaactccaagacacataactgtcagattcaccaaagctgaaatgaaggaaaaaatgttaagggcagccagagagaaaggtcgggttaccctcaaagggaagcccatcagactaacagcggatctctcggcagaaaccctacaagccagaaaagagtgggggccaatattcaacattcttaaagaaaagaattttcaacccagaatttcatatccagccaaactaagcttcataagcgaaggagaaataaaatactttacagacaagcaaatgctgagagattttgtcaccaccaggcctgccctaaaagagcctgaaggaagcgctaaacatggaaaggaacaactggtaccagccactgcaaaatcatgccaaaatgtaaagaccatcaagactaggaagaaactatatcaactaacgaacaaaataaccagctaacatcatactgacaggatcaaattcacacataacaatattaaccataaatgtaaatggactaaatgctccaattaaaagacacagactggcaaattggataaagaggcaagacccatcagtgtgctgtattcaggaaacccatctcacgtgcagagacacacataggctcaaaataaaaggatggaggatgatctaccaagcaaatggaaaacaaaaaaaggcaggggttgcaatcctagtctctgataaaacagactttaaaccaacaaagatcaaaagagacaaagaaggccattacataatgataaagggatcaattcaacaagaagagctaactatcctaaatatatatgcacccaatacaggaacaccaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacactacacctattccaaaattgaccacatacttggaagtaaagctctcctcagcaaatgtaaaagaacagaaattataacaaactatctctcagaccacagtgcaatcaaactagaactcaggattaagaaactcactcaaaaccactcaactacatggaaactgaacaagctgctcctgaatgactactgggtacataatgaaatgaaggcagaaataaagatgttctttgaaaccaatgagaacaacgacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggaggtggttttttgaaaggatcaacaaaattgatagaccgctagcaagactaaaaaagagagaagaatcaaatagatgcactaaaaaatgataaaggggatatcaccattaatgctacagaaatacaaactaccatcagagaatactacaaacacctctatgcaaataaactagaaaatctagaagaaatggataaattcctcgacacatacactctcccaagactaaactaggaagaagttgaatctctgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcacataaacagaaccaaagacaaaaaccacatgattatctcaatagatgcagaaaaggcctttgacaaaattcaacaaccttcatgctaaaaactcccaataaattaggtattgatgggatgtatctcaaaataataagagttatctatgacaaacccacagccaatatcatactgaatgggcaaaaactggaagcattccctttgaaaactggcacaagacagggacgccctctctcaccactcctattcaacatagtgttggaagttctggccagggcaattaggcaggagaaggatataaagggtattcaattaggaaaagaggaagtcaaattgtccctgtttgcagatgacatgattgtatatttagaaaaccccattgtatcagccccaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcattatcgtgaaaatggccatactgcccaaggtaatttacagattcaatgccatccccatcaagctaccaatgactttcttcacagaactggaaaaaactactttaaagttcatatggaaccaaaaaagagcccacatcaccaagtcaatcttaagccaaaagaacaaagctggaggcatcacactacctgacttcaaactatacgacaaggctacagtaaccaaaacagcatggtactgggaccaaaacagaaatatagatcaatggaacagaacagagccctcagaaataacgccacgtatctacaactatctgatctttgacaaacctgagaaaaacaagcaatggggaaaggattccctatttaataaatggtgctgggaaaactggctagccatatgtagaaagctgaaactggatctcttccttacaccttatacaaaaatcaattcaagatggattaaagacttaaacgttagacctaaaaccataaaaacactagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctagaatgaactcaaacaaatttacaagaaaaaaacaaacaaccccatcaaaaagtgggcaaaggacaggaacagacacttctcaaaagaagacatttatgcagccaaaaaacacatgaaacaatgctcatcatcactggccatcagagaaatgcaaatcaaaaccacaatgagataccgtctcacaccagttagaatggcgatcattaaaaagtcaggaaacaacaggtgctggagaggatgtggagaaacaggaacacttttacactgttggtgggactgtaaactagttcaaccattgtggaagtcagtgtggcgattcctcagggatctagaactggaaataccatttgacccagccatcccattactgggtatatacccaaaggactataaattatgctgctataaagacacatgcacacatatgtttattgcggcattattcacaatagcaaagacttggaaccaacccaaatgtccaacaatgatagactggattaagaaaatgtggcacataaacaccatggaatactatgcagccataaaaaatgatgagttcatgttcttcgtagggacatggatgaaattggaaatcatcgttctcagtaaactatcgcaagaacaaaaaaccaaacaccgcgtattctcattcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaaaaaaattatatatatgtattttatgtagatatatattcactattatgctttttaaatatgcagaaaaaacatagaagaaaatatattaaattgtttatagtggttatggctgatgggctatggtttttcttattctaattttctattttctaactttcctaggagaaatatgtacatttataatgaaaaaaaccaaactacattttcataaatagaagataaaattctgttatccaaaatgaaaatcagactttttttacatctttcagaaatacaagctaaaagatggttaaatcatctagttttctaatatctattatatttaactggttccaaaagtgaacttttcagagaagtgtagtaccacaaattattttttaggccatgaatcttgacactttaaagtttactttgaattacagaaaaactgttgtgtatgggtaatacagagttaaccaggataaactgaattgccttactattaaaccaaaccagcaatatacaaatattaaaatattaaaataatatacaaatattaaaaatttggctactatcattgacctacctgcagagcaaaaagatttccaaattataaagtacaatatactgataatcctaactggagatgctttttaatatattaagtaaacatgattgctcactactataaatgtcttatctttaataccaaaataaatctttctttaatacctaaaacagtggaaagggtggtaagttactgacaattcagagtaataattccttattttagttatctctaagccattaaaagcagaatacattaaattatttccatattatcataaaaatactgcttacctgcccgtaacaaactgtaagagaagaactctctcctcttgagtaatgtcttctacaacttcccagaaccactaacaacaagaacaaaaaacttagctcatatttcagagcaattgtagacttctcaataccagagaaatatgcaatattcataaagcacattttattctacaaaactcgtttaccaaaaatgatttcatgcaaagctttcatatgcactattcccacaagaataatttgggtaaacactttactttgttaattaatgtaagttttcatccaatagtgctgaaaagcttacaaaattaaacggcaaaacttaacttcattctaagctctagagaaattttacctgaataactggatcttctctttcatagccacttgtgtattctgtattttttatccaatcactcacatcaatttctggcatgccagaaagcagtagctccttgggggaagaagaaaaatatttcaataattttctttagggaaaaaagttattatatttaagtggtaaatttgccataattagaaactaatcccatgtaaaactgatatatttttgtgacagttcctgcatgtcatcaacaacaagcattacatgagagagaatccttgacgctgataatctcaaatattataagatgtggagatgtttccacattgatacaatttcattaaaacataagagattatagtttatatgtttatgtgtgaacatatgcaacaacagtttatatgtgcaaaagttttatgaacattatctttggtttactttatatttttacaattctttgcaattttgttaacttctgtaaggagacagtattctcaacatgaaagtgacaacaaagacccgaataaatacttgactaaacaaggggaaagtcatcaagaaatcattatcatgaggaaaaaggaggtaatataaaaatagttacgatttttaaaaaagatttaggccttttaggaattcaattctggaataatttggatcctgtaaagtcaattttctccaaagtcaaaaaaaatgcaattttcctaatgacttgataggtttattttatccaggaagatcatcaaagacacaaaatctcaatcgtataagtaaaaatgaaattaagaatggcaaagtatttacctttttgttttccaagggaaaagaggacatgaaaagagcttgtccacttctctgaatcagtccatatatcacagttagagatgcttacatagtcaggggaggcaatgattggcctacactttacactgatgattcagaatatcaggatttcctttttttttgagaccgagtctggctctgtcacccaggctggagtgcagtggcgcggctcactgcaagctccacctcccgggttcacgccattctcccacctcagcctcccaagtagctaggactacaggcgcctgccaccatgcccggctaatttttttgtagttttagtagagatgaggtttcaccgtgttagccaggatggtctcaatctcctgaccttgtgatccacccacctcagcctccaaaagtgctgggattacaggcgtgaaccaccgtgcccggccaggatttcttattacagggatgtagatgccctgtgattcaaaatcatgtctcctatagtaaactactcataacatatacctgaccttgtaccttaaataagattgatataaggcaacatctgagaactcttgagggtttccgagatctactcagtgggtccatgaggttctcccttttccaacttatctgtatgaggttgagttttcttcatatatttcaaccaaacaacataccaaaacagattatacacaaaagcagttgtaagggcccatttgtcttctactaagctagacattaaagaaatttgcaaaactgttaaacagtaccagtcttcccactgtttctgttttgttctggaaaatgcaattttagtttttcaaatgttctctatgttaatataataatggattattttatgtgaataaaatattttacatttctgttttaatttcaagtaaatatccattgacataacccacataaacaaaaactcttttgttttaaggggtcctaagaccaaaaagttttagaactgctagtatagggtgtgttttagtcctagtcacagtgttatagaatccttttcctagatgaagacagtctagtctacattgaccacccccaaatacattctctagcttcctttgcactgcagactggctgctttgcctgctggctgtcttgccagctggctttggtttgggtttggagcctgggaaacataggcagttagtctggaggtgagggtactctctgctcccccactgcttcagcatctctttgcagtagctatggctcctcaagtatggctaccatcaggtggcccctccttggtggttcaggctcccacggggctcttcacagtaattcctctacctgtctcttcagtcctagggatgataaaggctttccctgttgccagtctgtggatgtctcactagacattgtttattcttaacactgcccatacctctgtcatagtccctttgttaaagtttcgatatttgaaccatctggagaaattctgttccctgacaggactctgatataggtttgctaaaagggagtgggacaggctttacgcatgtcttacaattcatgagtttaatccttttcccttctaggctgaagataagctttcaataatattaagtatgctttcattattcataattatgaataaaaatgactaacattatattctctcaagaaatttgaagcacttcatgaatatcacattaattgttacgattttttttcaagaagaagaaaaagaaaggatctttattatcccatctggttactaaactgaccaaaaacaaacagatgaaatgagaattccagaataaaatgtacatattaagaaaaatattttaagccccaatcaatttttttaatacaacaaaataattgaattcatctgttggaactatgtgtaaggtatataactcatactaatagttagaaactgaatcatgaaagtattcataggcatcagcttacctagcatcacacgattcagtgtttttatattctggttctatcatggataaattcacaagcagcacagtatggaagaacagtccacagtcatctcttgatgccttctgtctacaatggatgactacacctccagttcagtacactggagctactcgataccttctcctcactaaaactctagaatttaacctgaatcctttaactcagatgcacatctagtttagacgtttgtaccaaattttttaaaagtttcctttctcagtgcagcatagccctcccctatgaaagacacaaagtcacacaaaaagttctaaagccaagtccctctgattactcatgccaccaagcagcagactggcaacagtgatggtatctggggtcagggaacatgagttcatagcctatcactaacacatgctctatgaccatgaacaagttccatatcttctttggcctagttttctcatctgtaaaatggggacaatagtactcacctcaagagattttttgtgagcgtttttaaagttaatacatataaaatacctggcaaatactaaatgcttaataattattattatcactgtataaatcaagaccatgcctacaatgttgctcttcccaaatgtgaatcagctcaacttagtaaagtcagagtccaagacaaactaggaacctgatctaaattttaatgtaagagccacaattaaaaacttaccagtaacagacctaaatgtgaaagataaaggaataaagcttttaaaagaaaacacagaaaaatatcttcacagccttggagtaagaaacagtttctaaaacaggacacaaaaagcttcttccatcaaaaaaaacaaaacaaaacaaaaaaaactgataaactgaactatgttaaaccccaaaatttttattcactgaaaagacctgagtagaaaatattcataatacatatatctgataaaagactcttataaaagaattcataaagagtcctacaaatcagtaaaaagaaaaaaaaacacaatagaaaagtgggcaaattacttaaatagacactttgaaaacagtacacaaatggctataatcataaaaggtgtgtaacttcattagctatcaggtaaatacaaattaaaatctcaaggaaagaccactactgaattaccagaatggaaatgaaaaagatggaaaattatcaaatgctagtgagaatgcagaacacccagaactctcacacctcctaatgggagtgtaaactgatgcatcacttgagaaactatctgctcctatctactgaaatggggtacatgcacagcctatgtcccagcaattccactccaaggcatataacctacagaatgcaaacttatgttttcctaaaggcatgtttatagcagcagtacttgaaagagcctgaaactgaaaagtacccactaaatgttcatcaagagtagaaaagactaaaggaaactgaaatgctatacagcaattaaaatgaacaaattaccaactgcatgcaacaatatgtatgattcccacaaacaaaaacttgagctaagaaagccagatacattctatttacataattctaaaataggcgaatctcgtctatgattttagaagtcaggagaatggttacccttaaggtgggagaatgactggagggagatgacagagtgacatatggggtgctagaatttctgtttcttcatctgggtgttagtttcatgggtatgttcagtttgttaaaacttatcaagctatacatttatgatgtgtgtccttttctgcatgtatatcataacccaaagttttataaacttattgatatcagtaaattacaaggcaaagttttcatcaattatttttgttgttgctatttgttttttacatacatataggtccagcaaataactaatgctctgttttgaatttcaaaaggctaatttaatccaagcacagtacaggaaaagccatattgcagtcaggtctaataatataatagctcaaatagtcctccatttttaaatgctgaaaatcacttctattgttacataaaaactagacaaatctatgctaactgaagccattaactgtacagcttaaaaacaatcaaaaaaacctcaaaacttacatttaatgaaactaaatcacaatggacttcaaaattaattagcaaattttattcactattatactaagatatactatgaatgataaattaaaaatactgatacatatgtaaaattaaaggtatatatccgtatctgtatccatatactaaaatgaaaggcatggggtaaaactaattttctgagacagaataaaaactaaataaaacatttccactgatctggaacttactattccaaattatatacttttaggtaagaaagcagctatatgctatttaaaatactgtgctttattaagatttagacaactcaaagagtttaaaaataattctccaaattaccaaaactaaagagaaaaagaaaatagagaaaaatgcagacataaatcatataaaattagaaatcctgttggatcacagtacaataaaggcaaattaaagtagcaaaaccaaacattcattagggactagaggatggcaaagacgatggactccataggtttgaaataaagaattataaaattatatatatggcaatataagaaactggagaagacaatactatacaataagaaaaaccttcttaattctttttagaagtttaagaagttagtatcagcgccctttacatcatgtggtcaaataaaaaattcagaaataatgtagaatactgtgtatataggaagactggccttcaacatctcccatatagaagaaacaggaatatattccattttagtttgtcaccacctcacctcacttcacattaaggagctgcttatctggttattaagcttaagagatgctcatccataaattttatatcaaatctctaaaaatggacattaaaccattttgtctcatttatacattatttcattcatcataatactccacaattatttctgaattacatcaactagagttttttgttgttgtgttacaacataagaactgatgtttttccttaccaattcatattcatcaaaaagctgtatgagggagggtggaatgaacatatgaaagccctgtaaaaaagcattgatctgaggctgaatggctcttgtcattcgaagttcagtaacaagctggacgtactccgcctgttgaaaaagaagttttcatgatgacttttcaaaaaccttttacatacttaatgttaatataattatttcttatttaagaggtaaaggtttaaaataaaattgacaccaacactcatacatctcagcaaatcagcaagccactattcactaagctgttgaggaaaaaattccagggactcaatcatccatgacttctctcacaccctatttcagctgatactatcagatctacctttaaaaaaatattctcaatcttaccttgtctcactacctccatttcagcaccccagtccaagctatcatcacttctcatctggattactgcaacatctggtgtccctgtttccatttttgcccctgtactgatgcttctccacatcttagccagagtgatttaaaaatatatatatgtgtatatacacatagatatacatgtgtgtgtatgtacatgtaaataactcagatccggcagctctcttgctcaaaaccctataatgacttctcatgacatctggagtaacatccaaattcctttcctggtctctaaggccctaaatgatctggcctctgccttgctctctgatctcacttctttccattctccccctagttcattcattcactcaattctagtttcactggctttctggctattcccaaaacacaagcttgtccgggccccaatgtgtttatacttctagatcattctcactgaaatgtctcattagaatgtaatctctctgcagacaggaactttgttttaccaggatatataccaacttctaaaaagtggctgccactttgaaagtattcaaaaaatatgtgaagaatgaatgcataccatcatcaaattcacttaacacatacttagaacttggtaaaatcattctttgtagcatagtcaattcaattctgagttaaggtaatctacatattcacccattttattttaaaatacgtgataatcatagaaaatattgttacttaaaatttaactggtaataagcagagggcatggtggcacatgcctgtactcctagttactaggggaggctgaggtggaagcattgcttgagcccaggagttcgagtctgcagtgaactatgaccgtgccaccacactccaacccgggcaacagggcaagatcctgtctcttaaagaaaaaaataataataataactggtaatttaaaaatgtattttggcttagaacaaaatgaattatatacagagagagaaagagtatgtgcctgtatacacatataaactattaggttatcatttatatattttttaattagttataagtgaaactttgtgagttaaaaacaatatgctatagcaggtatatagctcctacctactaggaattaatactctaacagggaagaaactctgttttagccctcttcctttatttttctttttttggcactaatctgatgctctgttcaaaaacaaacaaacaaaaaaaaccaaacaaaaaaaaaaaacaggggaaaaaaagaccaaaaaaaggcactgagccagcaagttctatatgactgctagctatgaattcttcacagctctcagagctacagaagtgtcacagtagattccatacagctctcccgaaaccctgtgtggctccttttataatttaacacaaggaaagctaccatctctgctattcaatctagtctcaccccaaattccacttcccaccaaccaaaggtgcaagtttttctctactatataggaattaatcagctacaagtcacatacaggtacttattatagagagggagacagaaatgtgtacccaacagtcaaacagaaacatacactaaatttctggagtccaacccgggaaataacatatataaaatatttcatagtgattacagcagtgatacctgcattagcacatgactatatttcagtttatgtctactctcactaaaattgttcactggatgtactaaaagttttctgccccattcatataattaattaattatatattatattttttaagatgccaggaaagaccctattcttccctaaagagactttttcccaagaggttttggctttaccatcttaaagtgtgactcaataatctctgtggaagaccttaacaagtcatgaagcatgaaaataaaagatttatgacttgctcatgtgaacgttacctattttaattgcattccatatctatcagaatagtatatactctattttttaccaattaattcctattatttcctcctacattttattttttaattaatttttacaaatataatactctttatcacacttttccttccatttattttaatatttattattttccacatgtatttcagtaacccagttcatagttattgataccaatttttgaaaatcagctccttcacatcccagtcttcatgccaattaagtaattcaaatgtggatggcagttgaactaaattatttttcaataaaataatgaaatcctagctatcataaacacttaatttttcagtaatataagagtttttcaaatacttgaaagagctgtgtttaatggaaaaatctaagtcgaactgcttctaaaatgtttccctgcctcgctaaacagtacaccttcaaacataataaaacaaattaatattatcttgacaatacaaattttactatgaacacccactactgttgcccagtaacatttcaagtgttcatgttgtgtagaaatacactggctaagggttctaaggacagcgctttggtatctcactgggaccgagctccggggacaaggggtgactgccatgtctggggttcagtcaactcagctgctcccacctgctggctttggagaatacaggcggtccagaaaaggtagggtccccttcaacacagcacatgtgctctaccaaaaagcagccagactgcttctttaggcaagtccctgatcccattccttgtgacttgttaagatctcccagcaggggtctccagccacctcttataggtgcatgcaggccaacaacaggtaagtacctaccccctgggacagagcttccagaggaaggacctgcctgccatctttgctgcttcatggccttctctgctgatacctccaggtatgggagaaaccaaggcaactggggtctggagaggacccctggcaaaccacagcagccctatatacagtaaagtggccagattactaaaagaaaaacaaatcaacagaaaacaacaacaatatcaacaaaaagaccccacaaaaacctcagtcaaaggtcagcaacctcaaagaacaaaggtagattaaggccaaaaagatgagaaagaatcaacacaaaaatgctgaaaactcaaaaagccagagtgcctcttctcctccaaatgaccgcaacacctctccagcaaaagcacagaactggtctgaggctgagatggctgaattgacagaaatagtcttcagaaggtgggtaataataaacttcactgagataaaggagcatgttttaacccaatgcaaagaagctaagaatcacaataaaacaatacaggagctgacagccacaacagtcagtttagagaggaacataacagatctaatggagctgaaaaacacaacatgagaacttcacaatgcaatcacaagtatcaatagcagaatagaccaagcagaggaaagaacctcagagcttgaagactgtccaaaataagacaggcagacaataatagagaaaaaggaacaaaaaggaatgaataaaacctccaagagatatggggttatgtaaagagaccaaacctatgactgactgaggtacctgaaagagacgaggagaatggaaccaagttggaaaacatacttcaggatatcatataggagaactcccccagattatcaggacaggccaacattcaaattcaggaaatgcagagaaccccagtaatacactccacaaaaagatcaaccccaagacatataatcagatgtgtcttcacatcagattccccaaagccatcagattccccaaggtccaaatgaaagaaaagctgttaagggcagccagagataaaggccaggtcacctacaaagggaaacccttcagactaatagcaaacctctcagtaaaaaccctgcaagccagaagagactggtggccaatattcaacattcttaaagaaaagaatttccaactgagaatttcatatctggacaaactaagctttataagcaaaggagaaataagatccttttcagaaaagcaaatgctgagggaatttgttactaccagtcctgccttaccagagctcctgaagaaagaactaaatatggaaagaaaaaattgttaccagccactacaaaaatacactgaagtacactgaccagtgacactatgaagcaaccacataaaccaagcctgcaaaataaccagctagcatcgtcatgacaggatcaaattcatacataacaatactaacattaaatgtaaatgggttaaatgccccaattaaaagaccaagaatggcaagctggatgaagagccaagacccatcagtatgctgtcctcaagagacccatctcacatgcaaagacacacacaggctctaaataaagggatggaggaaattttaccaagcaaatggaaaacagaaaaaagcaggagttgcaaccctagattctgacaaaagagactttaaaccaacaaagattaaaaaaagacaagggcattacataatggtaaaaggttcaattcaacaagaagtgctatcataaatatatatacaaccaacataggagcaccaaattcaaaaaacaagtgcttagagaactgcaaagagactgagactcccacacaataatagtgagaggctttaacagcccactaacaatattagacagatcatcaagacagaaatttaacaaagatattctggacctgaactcagctctgtatcaagtggacctgatagatatctacagaacttcccaccgaaattcaacagaatatacattcttctcatcaccacatgacacttattctgaaattgatcacataatcagaagtaaaactttccttggcaaatgcaaaagaaatgaaatcataacaaacagtctctcagaccacagcacaatcaaattagaactcaagattaagaaattcactcaaaaccacacaactacatagaaattgaacaacctgctcctgaatgactcttgggtaaacaacaaaattatgggagaaatcaagaatttatctgaaactaatgagaacaaagagacaatgtaccagaatctctgggatgcagctaaagcagtgttaagagggaaatttatagcactaaatgcccacatcaaaaagctagaaagatctcaagttaacaatctgacatctcaactaaaataactagagagccaagagcgaacaaactccaatgctggcagaagacaagaaataaccaagatcagaggtgaattgaagaagacagagacacaaaacaacccttcaaaaaattcaatgaatccaggagctgattttttgaaaatattaataaaatagatagacctctagctagactaatgaagaaaagtgagaagaatgaagtaaacacaatcagaaatgataaggtagatatcaccactgaccccaaagaaatataaacaacctgccaggcacggtggctcatgcctgtaatcccagcactttgagaggctgaggtgggtggatcacaaggtcaggagttctagaccagctgggccagcatggtgaaacgtcatctttactaaaaacacaaaaaattagccaggcatggtggtgcatgcctgtagtctcagctactcaggaggctgaggcaggagaatttcttgaacccagtaggcagaggttgcagtgagctgagatcacaccactgcaccccagcctgagtgacagagccagattccatctcaaaaaaaaaaaaaaaatatatatatatatatatatacacacacacacacacttat

SEQ ID NO: 184 - DNA, 50574 bp, Homo sapiens
atatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattattt

SEQ ID NO: 185 - DNA, 60859 bp, Homo sapiens
tgatagttgaaacacacagttttgaagaacagcaaatcatactctaagaggcagtagtcccctatgtcctgtcgttttccctgtttctgccttctatagacacccttgccaccactcagaaatgtttgagactttgtggagaaagtagactggtgagaatttcctcgtacttggaagggttaagcactgagtcgatctacagcaagtggcacacccagtttgaggtccacgagggtgaagtaatttatctgtgagtcatatcactgaatacactgttctatagaatgttggttagcaactcacttccaaacatcgtggccaatggttctgttagacataacatttgaaagtgagatgagttgctcatgtgggcttagcaataggcaatgaaacgaatctggcattgaaacagacgtgggtttttacaatgggtttagactgaaaagaagtgctgtgttgcatgagtccatcttcacactaagcatgaaagccagagaaggaccatccggtgctcctggtggagacagtgtctcgggacactgcctgtgaggttttcaggataggaaaaagaagagaaaaggaaacccagccccttggttttcttgttttataatgtggccatttcagaggctgtgactataggattaaatgcttagcaattggcaggactttatattgactggtgtttaaaacttaaaattcagttattccaaccacagatactattaaaagaactctggagtcaagaggaatgagcaggcaagagggtgaggctgtgtctatggctggaggaaaggtgtgatgagttgctgttttgttgctaggcaataggttttatgtgacaacaattcctttcctttaaagaactagagtgctctttttgtttaatgaaagcattagattttcttggtacaagaggtacccattgagtttacgtgaatatgtggtattatagtaaacagtgcttatgaaagggaatgctattctatttttgaattcttttgttttacattgccacctctagaaatcatttgcctgaggagatgtggttttttccttttctcaaatgatttctgttgtttggcttgtctgactgtaaacctctaaattacccccagctgttatgaatgtgcttctgaatttctcaacagatagcatagcatgtttgtgtttggggatgttagaagatttgcttttataattccaaactagttaacaaatcctgatgtaaatatgttatggtatcttctatatttcttcttttattgatcctattataatgtaaaatgttgtagactgcttatggtcacattaagacagggccatatatctcttgcatccttatagccttaataccaatctaacataaaacttggcatatagtttatatcaataaatgaacggttgttgaataagtgaatgaatggatgcacaaatcattgatatactgttgcattttccagtgacgtggatttatttatttatttatttatttattattttgtttttgagatggagtctcgctcagtctcccaggctggagggtagtagtacgatctcagcttacagcaacctctgcctcccctgcctctccggttcaagcgattctcctgcctcagcctcctgagtagctggtattacaggcatctgccaccatgccctgctaatttttgtatttttagtagaagatgaggtttcaccatgttggccaggctgatgtaaaactcctgacctcaagtgattcacctgcctcggcctccccaagtgctgggattacaggcgtgagccactgcgcctggcctgataatattcttctatattttagagaccatggagttaattctaaaaatggaaaatacttaggcctgaataccagcccataggtttactatttttccctaaggtaatgtcttctccttaagcagcattagagctttgctaacatgccatctaaaaatgtaccccccaagctgggctcagtggctcacgcctgtaatcccagcactttgggaggccgaggcaggcagatcacctgaggttgggagtttgaaaccagcctgaccaacatggagaaaccccgtctctactaaaaatacaaaattagctgggcatggtggcgcatgcctgtaattccagctactcgggaggctgaggcaggagaattgtttgaacccgggaggcagaggttgtggtgagctgagatcgcgccattgcactccagcctgggcaacaagagcaaaactccgtctcaaacaaacaaacaaacaaacaaacaaaaaaatgtatccccccaagaacaggaagaagtgtcatggaggtcttttattttcaacaatatagaaacatttttggatgaactttgtctctcaggttttggagaattaaaatgcctcccttatcccatccctgccacactctaggacattgattcatgttcccaaagaataatggttagcttactgtatgccagctactattcttagctccttacatgaactaatccttttaatcctcacaactacactatgaagcggatgctactattgtccactttatgggggaagaaactgaggcacagagaggttagcttgcctcgggactctgtctctgctgagattggaagcagaagactagttccagaattcacactcctaaccctactacaacacctgctctcaaacagagaagggaaaggaagtcctggcgtttgcactctccttgatcttgtgctggtctggtctggacatggaccaaggcttgggggccttgcacacgtaagtgagtgcagatgcccggcccagccccagggctcccttgtccttgagctggggccacgctgaggctgaggctggcctccatggcttgacttgaggccacctccagatccacaccctgaaagcttgggactggccttctcagagaatggggcaaaacactctgacgccaactacaaccatcacaaggaggtacattctctgtaagggcaagcctggggctgcacccaagtagactagcagacactcattacagagagaatgttctggcactctggccctgccaaaggctaccagaacacagaaggccctttcttccaaggggccgaaggaggagcaggcacacaccatatgcctcactcaccacacgaaaccacacaccacatagcacacacgcgtgcaccctcataccacactgacccttcaccacacacacacccatacaccttcatgtcacacataccacacacacagatataccacatgcaccccatacaccccaccacacacatacaaacaccacaccatatacacacacacacagtacaacatacacactcacacaccatatgccacacacatatactttacacatatacatacctccaaacacacaccatgcacacacacggtacaccatacacacaccacacactatgcacacaccatgtaccacacacatacccctccaacatcacatgaacactacgcaccctcccccataccacacacatacacgcacacgtaccatgcacgcacacacaccacaatgtgctgttacttaacaggtttgccttcccacaactctatcagcaaacccttctggaggcgcagcccacacctgcattccaaagaacgcaaatcccttccctgcccgatgaaaggcccctcccacagtgagtcacagaaactgcagccgagcaggcagtggtgggccccacccttctcacaggaagtgagaaagagtaaatatgtagtttttctttgagggccaatgcacatgttaaatgggtgattaagaagacagagagctgcttaaaaggtcatgggagaagtacaatgtctggggacttggcagtagcctggcagagaccgcaggaatcctatagagtcttttatggacagggctctgaaattccagagcctgcaggaggtaccttcccctttgactcggcggggctgtaccactaagaatgcactgagcattgggtgcacttgggatacctgagctgtggggccagagaggcagccctaggggagaattccggagttggggctgggttctttcagcataaaaaatcaaagtgtcgcttctttaatgaacctcccggcaaggtcttccctgaagaccttgaacaagtgttcttaaacaagtgttcctttatgcaattaaaggccagggaagctggggtctgagaggccatggagccattgggataatagtgacagttcggctaccattcaactgggcttctgatgaatcatgctgggggcaaggactccaaatcaccagctctactctatactcgaatcagtaggcagttcagacagtcttgggggatttgggcaaacgaacgctccacttagaatctctccagaaagacaaagggggtgcctaacaaacaattcaaggactgtgggaaaccaatgatcatcaagggctcagttgtacagtgtaaaccaaaaagtatctgagacaggtctcaatcaactgagaagtttattttgccaaggttaaggacaggccagggaggaagaaacacggaatcacagaaacagtctatggtctgtgtcgttcttccaagatgatgttgagggcctcgatgtttaaaagggaaaagtgggctggagaggaaagaggaagggcatgggaatctacttgttgcaagggaaaaggagcaggaagaggaacaatcagttacgtttcctctagcagtctgtaaattggtgctttacataagatgagcatagagtttagctgcctgtggtggggatatctagccttttatctgtagctatctgcttaggcacaaacagaaaggcagcttcttgcatgactcagcttctagtttaattttttcctgttgccaagaaaaaactggggtcctgagagtttttcttttcctttcacaacaggaagaaacaaactacagagcccctaggtatactggggccacctggggtcttgttaaaaatgtgcatttgggggaggggcggagagtctgcgttccccccatgcagtgcccaggctgctgctctgtaggccacactttgaatactgagagtaccagagaggacttggtggtagggggtggtgggtggattctggtacagttggagggaggaggcttcctggggtgagggcactgagatgggtcctggtggtaagattgtgtggggaggagaataaaggtaccccagatcaaccttgtggggcaacaagtgacctgacaaactcccatcatgtatggccactgtcccccattcaaggccagggaccgttggaggagttggaaagttaagagcttgaaaactggattctgcctcactgggaggttcactgacatttagtcttctctgaaagatgggcatagttataccaatcctacaggagtagtgtgaagattaaatgagatgacatataaagtgcttagggcctggggcagcataagtggtagaatatttgttcatattattattgttattattattagctgaagcaatttttttttttttgagatggagttttgctcttcttgcccaagctggagtgcagtggcacgatcttggctcactgcaacctctgcctcccaggttcaagcaattctcctgtctcagcctcccaagtagctgggattacaggtatgcgccaccatgcctggctaattttttgtatttagtagagacggggtttcaccacgttaggcaggtctggaactcctgacctcaggtgatccacctgcttcagcctcccaaagtgctgggattacaggcctgcaccaccgcgcccggccctcctgttgacttcttttttttctttttttgagacggcgtctcactctgttgcccagactggagtgcagtggcacgatctcagctcactgcaacctctgccttctgggctaaagcaattctcctgcctcaacctcccgaacagctggtattacaggcatgtgccaccacgcccagctaattttttttatttttagtagagacggggtttcaccatgttggccaggctgctcttgaactcctgatctcaggtgatccacccgcctcggcctcccagagtgctgggattacaggcctgaaccaccatgcccggccttcctgtttacttctgagccctgggccaacatacttcagaacagaaggcccctggtggctggaggggctctcttctccctcttcatggccctgaaggggcggggcagtggtgacactgagagggacaggagaattggacctgccttgacaagacggcagcaaggcctcattccctggggcctagaagaaggtgactgcgctgggcatacacaggggagaggattcagagtattcaagacgaatatattgggtagaaaaagttatttaaaatatttgaaacaagtctcatttttacactgaaatgtcacagtccttcaggctctctgttttagccaaaggacatcaggacatggtcttacccgagatatagccagattcagtataggtacttcttagtgttaggtgttctaatgcctgtgtcctgccccagccctccatgagagccaagagctgtgctgaatagaattgctgagcccttgcagaagagggtgtcatattttccaaatattccctttgcaagataaactagccagaaggtaggaggtgtcaggcagcgccgagcaccggctgggccagacctctggaagagcaactgggaatgttgattacagggcaagaatctaaacagcagtgatttattttccaaagttgctggcactttttaatccctttttctctcttcctcttccctttaacagggcagagcaaacaatcttcaggccaatgcaatgctttgtgggttttttgcattgatttgtacatgaaaccatgttttttttttttttttgagatggagtcttgctctgtcgcccaagctggagtgcagtggcacgatttcagctcactgcaacatccacctcccgggttcaagcgattctcttgcctcagcctcctgagtagttgggattacaggtatccaccaccatgtctggctaattcttgtatttttaatagagatgagatttcaccatgttggccaggctggtctcgaactcctggcctcaggtgatcctcctgtcttggcctcccaaagtgttcggattacagatgtaagcctctgctcctggcctgaaaccatgaattttttatgtggccattattattttataaatgctgctttctttctctatctgttcttttcagtacttagccagcgtgcagagaagcttcccagttaggaggtgaagaaacacaaggctgcactggatgcggaggctcccacctggaatcccagcactttgggaggccaaggctggaggattgcttgagcccaggagttcaaaaccagcctgggcaacatagtgagaacctgtctctacaaaaaataaaaattacctgggtgtgatggtgcacgcctgtagtctcagctacctgaaggacagaggtgggagaatggcttgagaccaggagattgaggctgcagtgagtagagatcacgctactgcattccagcctgggagacagagcaagaccttgtcacaaaacaaaacaaaacaaaacaaaacaaaacaaaacaaaacaaaaaaaacacaaggccacccttcctcacgatgccgcaggtcccctccccttctctcagcatggctggagagcccctcaactgtggcctgctgtccttgatccagtgccccacgctgccccacccttctggggagcccacctcaaagagaactccctggaggctcctacagtggcctccggctgaccaaagtgtgctgtgggcagaagcccctgcctccctcaccatgtacttcctcatcccagatctcagtccctcaagggccaggcaggtgtcatccaagacgacaagccatctcagtctcatgtactgtggggagaagacctcccagagccctctaccctctccttgagtcatacatgcttttttttttttttttttttttgagacggagtctcatttgtttgcccaggctgtagtgaagtggcaggatctcagctcactgcaacctccaccctctggattcatgtgattttcctgcctcagcctcttgagtagctgggactacaggaatccgccaccatgcccggctatttttttttttttttttgtatttttagtagagacagggttttgccatggtggccaggctggtctcgaactcctgacctcaggtgatccacccgccttgtcctcccaaagtgctagaattacaggtgtgggccactgcgcctggcccatacatgcattttaacagctacattcatggatgcatttagcaagcaacctggcttcacatgcaaggcacagtgctaggaattaggtctacagggatgagcaagatgtggaccccgcctctgctgtctccaggccactagggacgatggtcggggaatagaccactgagattgaagtgatgaaagtctcaaggaaagaacagggaggcagaggttgcagtgagccaagattgcgccactgcactccagcctgggcgacagagcgagactctgtctcaaaacaaaacaaacaaacaaaaaaagaactctggcattccactgaacacgttctccttcaaaactgggtccaatcattctgctgacaccaagagagtgcctaaagggacagcccaactcaggccttagatttatcttgagagaaaagtcctagaagcattttgattctcatagatgaaaggacaccagcacggaggacatgattggtcttctcgcctctcaagctgcggtggtgctgtccgatttgtgcatagccagaggaagatttcctgagaagccagtcaagcatgagctccagggtccttgcctgtgtgcccctcttccaaggtcctgtaccgattttttaaaaattcataattgtataatacttttcttaaatggtgtggggcacaaaacatagacctgcatcgtaagacctggctctacccctggaatatgtttctgatctgaagatgacaacctggagcagtaagcccttcagtccttggcaacaattaatcatgttttgattgaacatggctcctaattgtaaggaggcttcaatgttaagaagtggtttgtcttcactgtactgtagattctgacttcaatacacatgtgacctcaaaaagtaaattaatgccgccagatccaattcttcacatcctttctgtcagtagcgcaggttcaagaaggcagctggacacactgcctggcacaaagtgggtgcctgcctccaggttagtgaatgcatgctagcaattgtggcaaaaacttgttagcctcagtgtgtttgaagtccttggtttaaaaaaataataaaaaatatagaaaagttgcaagaataattcaaagaactttttagttcttgaataatttgaaagtaagggcttggtgtggtggctcacacctgtaatcccagcaatttgggaggccaaggtgagcagatcacctgaggtcaggagtttgagatctgcctggccaacatggagaaaccctatctctactaaaaatataaaaatgagccaggtgtggtggcgcatatctgtagtctcagctactcaggaggctgaggcaggagaatcacttgaacccaggaggcggaggttgcagtgagctgaaatcatgctattgcactccagcctgggcgacagagtgagactctgtctcaaaaaaaaaaaaaaaaaaaaaaaaagtaaggccgggcggctcacacttgtaatcccagcactttggaaggctgaagtgggaggattgcttgagcccaggagtttgagaccagcctgggcagcatgaagagacctcatctctacaaaacaatttaaaaaattaaccaggtgtgatggtgcacacctgcagtcccagctctttgggaggctgaggtgggaggatcacatgaacccagaatgtggagtctacagtgagccatgatcacaccactgcactccagcctggactacagagtgagaccctgtctcaaaaaaaagaaaaagttgcaggcatgatttccttgtacctctaaaaacattagtatatatggcccacaaacaaagacactcttccatacaccctcagtataaccatcaagatcaggacaccctgttcaatgttaaccagttgtccaaatgatcttattttttaataattaaattaaatttcagattcaaggggtatacgtgcaggtttgttacatgggtatattgcataatggtgacgtttgggcttctagtgtacctgtcccccaaagagtgaacactgtacccaataggtgatttttgaaccctcacccctcccaccctctgaatgatgttctttgtagccaaatgatccagtccaggatcaggcacttcatttagttgtcgtgtttctttagtctctgtcagtctggaacgtttcctcagtctctccttgtctctcagaacagtgacattttgaagattacaggcattattttggaaaatgttcctcaatttgggtttgtgtgatgttttctcagagattcagattatgcattttggaggaatttcgcagaaatgattcatgttcttattgtatcttatcagggggcacgtggttctgtttgtcccattatcgatgacgttaacttttattttttggcagctcctgcctgaggtttatctacaaatgacacagaaaggacaccaggcccattcagatggcaacccaggaagacaccagtccttctgtcctcacattaacagaaggaggcctctgctcgagagccttcatgggggctgaggaacctttgggagcctgagctgatggagactgggcctaagcctttggcctacagagtctgagaccctggtgatgtgggcgccccaggcaatgtgggcaccagtacacttcctgaacttgggctgagcaatgaggacaagtcaattgagcctgtggctttggggatctgccttgggatttctgagggccctgatggcctctgcaagtacactcccagccttggcattgttgacctgcttcttctccaggccctattttttttctttttttgagacagtgtttccctcttgttgcccaggctggagtgcaatggcacgatctcggctcaccgcaacctccgcctcctaggttcaagcaattctcctacctcagcctcctgagtagctgggattacaggcatgtgccaccatgcccagctaattttttgtatttttagtagagacggggtttctccatattagtcaggctggtgtcgaactcccaacctcaggtgatctccccgcctcagcctcccaaagtgctgggactgtatacaggcgtgagccactgcgcctgccctgtccagatcctttttgtgcttctttgcaaactatatgtttctcaggaacatcttcatggtttattgatgccatgtgtgtgtcattttgaggactggttgtgtgcgacgtagttgttagacttatccatgtttgcactctagtcggccaatgatttaactttgatcgcttgattcaggtggtatccgtcaggtttttccaccatcagttacttattttctctttgtttttaataagtacttatttgagactatataaatgtcctattcctcatcaaactttcagtcactagttttagcatccattgaagtttcttccttaattattactatgatggttagcaaaagctgattttctaattctgtcattctatctacacttactggttgcacgctactataacattgagctttcccttttaatatctatctatctatctatctatctatctatctatctatctacctcagtatggacttgtggattcctattttattcgatgaatttatcatctcttattaccattatatatcttgatactttaattgttccagacttggctagtgagagcacattcaagttggcttctgtgtcctttggacttatttccattatactttgagtgcttcctgactttctggccaaacaagatgttctaggctccttctgtactttctctgactcagccgtggaaccaggaagccctgctccttttaatagagaatgatttttagaaaccaagattttggtgataggtgtgcttgctgctattgggatctcactgctttagtatcttttaatagtcagaactagaaaatatatgcgtgtacacgcacacacacacacacagatactgaaaacctacagtgcatattgatgcctccaattccaaagcaatgctacatggtttattcagcttctcccctttcatacttgtaactccccctttcaacagtaagaaacccgacactcattatcctgaatatatttacttatttgctcaatctctctgtatgaaactagtctactgactctgccaggccactgccctgcttagcaaactctctttgtgtgggccactgatctcaagggctttagaactgaattattaaggaaagaagacaggaaagccttggtttgcttttagaatgggaatattatagattgtaaagaccttatatgtgtggatcagcaacactagcaacatggatcagcttaggaaggtgacttggtcaggcgcggtggctcacgcctataatcccagcactttgagaggctgacgagggcagatcatgaggtcaagagattgagaccatcctggccaacatggtgaaaccctgtctctattaaaaacacaaaaattagctgggtgtggtggtgttcgcctgcagtcccagctactccgggaggctaaggcaggagaatcgcttgaacctggaaggtggaggttgcagtgagccaagattgcgccactgcactccagcctggtgacagagcaagactccatctcaaaaaaaaaaaaaaaaaaagaaggtgacttcagaagttctgattttatgtccttttttcactaacaatctgtgacacactttatgtacagagatgaagtagggcttctggatatcctgaagtccctaggttactgagactgtcaggtattgctattttggatattgcatttaaagagaagtttgctatattttatgcatgtttaggtgttttcatagtgaatgtgttttcaaattagattggcctcttttcaaaatatataaggctgggcgcagtggctcacgcctgtaatcccagcactttgggaggctgaggtgggtggatcacgagatcaggagatcgagaccatcctggctaacacggtgaaaccccgtctctactaaaaatacaaaaaaattagccgggcatggtggtatgcgcctgtagtcccaactactcgggaggctgaggcaggagaatggcgggaacccaggaggcggagcttgcgagccgagatctcgccactgcactctagcctggccacagagcgagactcagtctcaaaaaatatatgtgtgtgtgtgtgtgtgtgtgtgtgtgtgtgtgtgtgtgtgtgtgtgtgcgtgtatacacatacatacagagagagagagagagggagagagacaagatctcactatgttacccaagctggtttcaaacctctgagctcaagtgatcctcccgtctcagcctcccaaagtggtaggattacaggcatgagccactatgcccagccagattgttccctttattaccagaaattttggtcttgaacacgagtttgaaagtatcttagttgagtaattcctctgaaaagtctgcctgtacttctactggcaagtaaactgttaatgtggccaggtctagaatgaaggccactggctaccccctggaaacttccagtccttggagaatgcctgggaaacctctggaaaacatccagacatcaggcctttccaaggtctgcccatcttgactcctatgcctggtggagtgaaccagctcattctaagaggctttcgggcacctctgtgaagctgctcactcaagagtccatgcaatcaccacacagagtttcagccactgacccatcatccaaagtgagcagctttggagaaggggctcatgccccaggactaggtgaatgtgtctcatgattcctccccgcagccataaaagactttattttgcattccgtgcatttttaggattgctgctgtaaaatgctactctggtgagccatcctgcccagatccacctaaatgtggtacaattccttagtttcactgtggaggaaataatcaagactcctcaaagcaaggcacagcgaatggcttgaacacttctgaatttcattctgatggattttgatcccatattctttgagacagctgtttctgtagaatcggtgacttctttccagactcagatgtacctctgaactgatttttagctgttcattctgtactatgcatttcttgtgctctgatttttttttttttttttttgcaggaatgctgccttcatatcaccagtagtgtttatgttagaatgtgccccttcagtgactgtggcagtctgcaatgtattaatccactcaatggctagggcctttaacgagtattatatacttccaagaaggtgctagcagagagcctcaccatgcattttacagcaaagaagtgagcaatgtcattaagacaccctccaacttgcagtttttagacagaaggccaattctgtatgtataagaacactgtatgtattaaacgtggtaatgatctcccaggctgctggaaccatttgttcactatcacagaaccatgactgatgacatctggtaaaatgctttccctaaaaatcctgcaaattcacctgacgttctggttctgggtaaaacagagacagtaaaatatcttgaggcaaatattaaggacaataccacagcccaggagaactggacactagagccgagtcttccctttttcttccttctgtacagcatggaaagccagtcagcaggctccaggaagcagcctttctgatattctctttgcttttttttttgagacagagtctcgctctgtcacccaggctggagtgcagtggcacaatctcggctcactgcaacctctgcctcccgggttcaagcaattctcctgcctcagcctcctgagtagctgggactacaggcacgcaccatcatgcctggctaattgctgtatttttagttgagacggggtttcgctgtgttggccaggctggtctcgaactcctgacctcaagcgagctaccagcttcggcctcccaaagtgctgggattacaggcgtgagccactggggctccccactctgatattctctcaactgcctgtaagctccacactgccctcaggatggtggtctaatgccttagcgtggctgtcaagccatctgtgttttgactgaccttatcccccgacactcccagatcgtgagccttgtgcttggtgttgcctacaatctccatagccttccccatccttccacctttgcacacctacttaaattcctccatggttgcaattagctctcagctgccttatttgcttattcatctctcactccactagactgcaagcccttccatagcaggaaacatgaactactcctatttattcctatgtacatgcttgggacatagaaagcaagaattatttgttgaacgactggatggatgaatgaatgcttcaaaagagccatttaaaatgtagattctcattgaatgctcaggtttcagggtgatggctgtgttcacttgtttagcaatagtagaggacattttcactacctgctagcgtttggctcctcagttttgtttaatagaagatgtagtattggggcaacagtaatgagttagagaacaggcaggttttcaacagcagccctttattgcagcaaaaatttattgcagcaaaagataatctgagccaaccacaacctaaatcactgttgctggcaatgacaggagttaaaaggagaatcaaaatgattatgttgaaccactctggcatccggcatctattacagtgcatcctcagttcatgttactatttttgtagctaataacatcagttttttcaataattgatcttacatatttaatatatatgttaatttcacattacttagatacaagtgctatgaaagattgctaagtctaaaagcagaagtgaatgtggtctaaaaaagtgagtttgatgaatttcttttctattgagctggctgctcatttgactaaatcaactaatccacacaggtgtttgggtgtcaagtacgtgttgcctaagtcatattcttttgagctagaaaagttgttccacttaatttcaaaccattttgttaatactttccaaatttctggaaatctgctcatttaaaacttacttggatgtctaatggtttgcaaattttgtattttagcagtagtatccaccactaccctgatgtgcaacacacactgcacattttacaactttatacttgaagacttaaaagtctccctttgactgattagcggtgttgaaaatgatgggtcatgtctatgatgcaaaatcaattgacaaaaaatactgaatggctttaaaagggaaaagcatctctgaattatgtttgtaaaggaacatctttaatttttcttaaattctactttctgttcttagttttttgtctttttttctttttcttttttatttagagatggggtctcactgcattgctcaggctggtctgaaactcctggcttcaagtaatcctcccaccttggcctcccaaagtactggcattacaggcatgagctactgtgcccagcccaatgttttgcttttcaataaactttgttttcttttttatttatttagtcttaccagaccaaattattttcattaagagttatggtcagagttggagcttgggagcagtaagaaggaacaggttataataataaaaatactatttccctaatacttgtttgtaaaccatgctttttgtttttgtttttcaacatacccatttttctcaataggctatattgctgaaaagttttcagaaagttctattaaaaaataaccaaagtcttacacttaatagatttttagtaactttgttaaatgaatgtcagacacaaagctaatgctagtatttggaagtgatgtcgttgaagttttgataaggacatttaaagttatggatgataattaagtcttactgtaaattactacctgactatgaaacttagtacagtcaatgtagctctgtaagagaaataataaagatagaatagtcatgactaggtgcttttcttcttaatcattcacgggaaggagcaaaaaagataatgaacatttttttgaatacctatttgtgccactcaataattcaggaacttcagagatctcagttaatcctttcagccaaacaggttacaaataaagaatctgaggttcataaaagtttggaaattcatacaacttcagagagacgggttgggggatggtgggactggggattaaacccaagcctgcctggctccaaggcagtttccactgcagggtctactgtatttggaatttctatcaggtagttctggtagctttttggaagaaagtgtagaagaaagtttgaaagtcattcttatgatcggtttgcttcctggttcctaaccaaccaagtggatctaagtgaggccactttgtaaacaggtcgttctccaaattgatgaacacagcagaatctgagacattttcagaaactttgtactgcagatttaatatggtctgttgctcaggggaagcggagattgttgagactgtaggcacccttattttccctctcacatagcaatctttttttttttcttaagacaaggtctcgctctgtcacccaggatggagtgctgcggtgtgatcacagctcactgcagcctgaacctcctgggctaaagtgatctttccacctcagcctcccaaatagtggggattacaggtgtgagcaaccacgccccacagtagcaatccttttcttaaaccagcagcaggacaaatgtcttcctgaagatttgtaacacctggtagtgatcccaactccttctgggcccgcttaagactaagtttctggttaggaaagaagaaactgcagagcttagtagttaagggcacacaggagtcagacaaccttgggtgtgaatcccggcactgccatggtactaatgtgttgcatgagtcatgttgagaggtgaggccagctggacttcctgggtccagtggggacttggggaactttcctgtcttacaagaggattgtaaaacgcaccaatcagcaggattctaaaagtagccagtcacgggaaggattgaaaaagagggcactctgataggatagaaatggaacatgggtggggacaataagggaataaaagctggccaccccagccagcagcggcatcccacttgggtcctcctccatgctgtggaagctttttcgctcttcacaataaaccttgctactgctcactctttgggtcccggccatctttaagagctgtaacactcaccgcgaaggtctgtggcttcattcttgaagtcactgagaccacgaacccactggcaggaaccaagtccagacacaatgttatgcaagctttctagaccctttctgtaaaatgggtataataatagtatctaagtcatggggattttgtgaggattaaatgaaatgcctgttaagcatttaaaatgcctggcacattgaaagttctttttggagacaagtcttgctctgccgcccaggctggagtgcagtgacatgatctctgctcactgcagcctctgcctcctgggttcaagcaattcggtgcctcagccctgagtagctgggattacaggcatgcgccaacacgcccacccaatttttgtatttttagtagagatggggtttcaccatgttggccagggtggtctggaactcctgacctcaggttatcctcctgcctcgacctcccaaagtgctaggattacaggtgtgaaccactgcctttgggccaaaagtacttaattcttattgatgtccacattcaacaattactaggtttgttttttctgcatccagctgcaaatgatcttcaaagttgtgaactcaggaaatctcagaggcgtttataggctttccaaccagagatgatatttgtaattcaaagaagtaaatagaaatccttaagagaacccctttcaagctaagttcccatctaatatggagtggtggcttcgaatgatccttttggcttatctttttaagtgtaagaatttttgatgaatcacacttcgtacctatttggtcactttcaccaaagtacaaaaccagtctgccaccagaagaaatttaataaccttgagactcagagaagcaatgctgcctgattggtggacagccagaccagtgagggtcagacgtggctcttcggctccggacacgggaatgtggtggaaatgagatcctccagcgattctaaggagtgttttgttcttctggcttaagagaagggcagaggacagaaccaaggggaaagagagacaggcccagccattgtctgacgtgaggcacgataacacattagagggctggtttagcaaagggcaaggtagagttggcattagacgcgcttgcaaagggaggcgggcaagagcttcaagacgcgaatgacacttgagcagcctgggctcacgtctggtaaggtttacgccgcctgttcccgccatctggcaactccctcccagaagggtgagtttggttcttggcaaatccccttcggacacacaagctcttttattaaaatataaccccactaacagattgcagactaggcacagaagccccaaagcacccccagagaccgcagcagtcccgccccgccgcccccggatccgcgcggctgccagaagctcccctcccccagatcttggcccctccctgaggcgcgcgagcgtgtcgtcgcccgctcccggccaatcagggcgcgcgaccaaaatagcgccatataaaagctggatggcgggcgcggccggtgcagagcctcgcgctggggtggggttgcgcgcgcaggtgaggggggcggggccggcgcgaccggcggggcggggcggacactcccaccgcgcacctgcttctgcctgacgtgtacccggaaggtcgtcagctcaggctccaaatatgtaacagtgagtttctaagtgagtcacacggacgcggttggtttccagtgaggcataactcatcgcttcactcttctcaacggttccctcttcggaaggaagcgcagtccgcagcgtcgtccgagggcgtgatcgcctgcgtcgcacccgcgtctccagtggccaccccttgtcctacaggaacgcgcatctgcttagcaggcgctgagcccttgaggaggcctaaaatgaatgaacgcggctgtgcctcctgagcaggctcacagttgtgggtgggggacagaagggtgtccatgcctaaggtcgacggcgataagacagacgttcttcccaggaggagatcagttccaggtgggaggcatttctaggagtcacctttctccgaggaagtgacctgagctgtaggaggtggaatcacaaaggctttggtgccctacacacctgggttttagcctcagcttgagtcactcacccagtctgtgacgctgaacacatcaggaaacctcaaactttccccatctttaagatgcagataatagccggtcaccatggcgtgtgcttgtaatggcagctactcgggaggctgaggcaggaggatctcttgaacctgggaggtggaggttgcagtaagccgagatcgtgccactcactccagcctgggcaacagagcgagactccatctcaataaataaataaataacactacatgactgatagcatatttttgaggagcatctctccccctccgtgcttgggtttaatccccccttcctctctccctccctcccttcctcccttctttcttccttcgttacgtttctcttcatttctttttttctccatcattccttcatttttcttattttttcctaactgatataatttacacacaataaatcgcacagaaattaagaggacagctgggtgaagttttacatatgtatacacatgtcattagcccctaggtcaagatctagaacatttccatcaccccaggtttccaactgctccttccggtcagtagtacttccccagaggtaaccactattcatttggacttaaattaccaagtatgagttgtgtctactcttaaacttcatgtaattgcaatcaagcattatgctttattccaaacttgtccaacccgcacaggccacggttttgaatgtggcccaacacaaatttgtaaactttcttaaaacattgcgagattttttgtgactttatttatttatttatttttttgagacagagtctctgttgcccaggctggagtgcagtggtgtgatctcggcttactgtaaccaccgcttcccaggttcaagcgattctcatgcctcaacctcccgagtagctgagattacaggctggtgccaccacacctggctaatttttgtatttttagtagagatggggtttcaccatattgggcaggccggtctcaaactcccgacctcaggtgatctgaccacctcggcctcccaaagtgctgggattacaggcatcagccaccgcgccccgccatgtgattttttttttttttttttagcccatcagctattgttaattttagtgtattttatgtgtggcccaaggcaattcttccagtgtggcccagggaagccaaaagattggacacctttgcatttctgttttttttcacccaccgtagtgtctgtaagattcctccatgttatcacacgtatcagtagtttgaagtttgtttattactgaatagtattctattgcatgaatatacttaagttaacttatcctttttaccattgatgtgtatgtgggttgttttcagtttttggctattatgcataaagctgctctgaacattcatgtagtatgatgaataattgattttagtaggatatatacctataaaaggaatttttgtgtcataggatgataggtgtatatttagttttagtagacactgctggcagtttcccaaaaggattgaatcaatttttgaaaattggctggccgcagcagctcacgcctgtaatcccagcactttgggaggccgaggcaggtggatcacgaggtcaggagttcgagaccagcctggccaatatggtgattctccatctctactaaaaaaaaaaaaaaaaaaaaaaaattagctgggcatggtggcgtacgcctgtagtcccagctacttgggaggcgtaggcagaagactctcctgagctcaggaggcagaggttgcagtgagctgggatcatgccaatgcactccagcctgggtgacagagcgagactacatctcaaaaaaaaaaaaaaaaaaaaaaaaaaggactggtcgaggtggctcacgcctgtgatcccagcactttgggagtccaaggcagacagatcacctgaggttggaagttcgagaccagtctgaccaacatggagaaaccgcgtctctactaaaaatacaaaattagctggccatggtggcgcatgcctgtaatcccagctagctactcgggaggctggggcaggagaatcgcttgaacctgggaagtggaggttgcggtaagccgagatcatgccattgcactccatccagcctgggcaacaagagtgaaactccatctcaaaaaaaaaaaaaaagaaaagaagaaaagaaaattatagttacttcacatccttgccaacaattggtgttaacagtcttaaatttttgatggttatgcagcagtatttcctagtggttttttttttttttttttttgagacagaattctgtcacccaggctggagtgcaatggcacgatattggctcactgcaacctctgcctcccgggttcaagcaattctcctgtctcagcctcctgagaagctgggattaccggcatgcgccaccatacccggctaatttttgtatttttagtagagacggggtttcaccgtgttggcaaagctggttttgaactcctaacctcaggtgatctgctcacctcggcctcccaaagtgctgggattacagacgtgagccaccgcacacggccaaaatcaggttgttttcttaccattgaattttgagagttctttaaatattctggatacaagttctttattaaaaagactcccttccattgactttgcacctgccactttgtgaaacgtcagttggccatatttgtgtgaatttatttctggaccatttgttctgtttcattgatctgtgtctatcccttcaccaacacgacactgtcttgattgctgtagctttaaagtaagtcttagcgccctccaactttgttctttttcctgattacttgggtattttacttcatttgactttccatatgtattttaggcttgtctatatgttttaacaatcctgctgggaattttgttctttttttgtttgttttgttttgtttttcagacagagtctcagtctgtagccccgatggagtgcagtggtgccatcatagctcactgtaacctcaaactcctgggctcaggggatctttctgcctcagcctcctgagtagctaggatcacaggtgtgcatcaccacacctggctaattaaaaaaaaattttttttttttttggtagagacggaggtctcgctatgttgcccatactggtctcaaaattcctggcctcgagtgatcctcctgtctcagtccctgaaatgctgggattacaggtgagccactgtgccccaccacgtgggggattttggttgtatttgtgttaaatctatagatcaattggaggagaattgacaactgtattgagtcttccagtctgtgaatatagtatgtctttacatttatttagattgttttatttctttcatcagcattttgtggtgttcatatatagatcctttacgtggtttgttagatttatgcagactatttttcaaagccactgtgatttaaaaaatttggtttccggatattcattactattataaagaaatatagttggttttcatgtgttaaccttgtatcctgcaatctcactaaactgacattggttttagaaggtttttatggaatccatgagattttttacacaggcaatcatgtttgtgaataggtactagggacagttgcgttttctcctttccaatctgtatgactttcattaaattttatttccctgtttgacaagataggtcttcccgtgcaatgttgagtaggaggggtgaggtggagttccttgccttgttcctgatcttagagggaaagaagcattacgtctttcacagtgtgtttagttataggcttttttgtaggtgtgctttatcggtttagagagctctgttcgattcctcatttgccgactgcttgtaccgtgaattgatgttgaatattgtcggttgatgtggtcttgttgcagattacattttcattgattttcaaatattgcatctcgggaataaaccccggatcatggtgtgtaatttttttttatgtattactgtttcaatttgttagtattttgcatctgtgttgatgagggatattgattcatgaggatctttttttttttttttgtattttctttatctggttttagtatcatgatgatgctcatctcataaaatgagttaggaagcattccttccacttctgttttctggaagaaactatgtagagctcatgttatatctttctaaaatctttggtactatttgctgatgaaaccatttggggctgcagatttctgttaaggaagattttcaactagaaattcaatttttttaatagataaaggatttatttaggtttttaatttattcttggatgagttttggtagctcgtggccatcaaagaattgatccactttatgtaagttgtcaaatttatgtgtgcacagttgtttgtgtaatttattacccttttagagtctgtggggtgctcagtgatagcctatccttcattcctaattattggttttgattttttaaaattaatttcctattttcaattccaatgatttctgttctaatttttattattattttcctcttattctgcttgctttaggcttatattcttttctttttatagttttctaaggtggaagcttggattattgatactaaatctttcttcttttttttgagacagagccttgctcttgtcgctcagactggagtgcaatggcacaatcttggctcactgcaacctccacctcccaggttcaagtgattctcctgcctcagcctcctaagcagctgggattacaggtgcctgccaccactcctggctaattttttatttttagtagagacggggttttgccatgttggccaggctggtctctaactcctgacctcatgatccacccgccttggcctcccaaagtgctgggattataggcatgagccaccgcgcctggcctcttcttttctaatatatgcattaagtgctaaaaatgtccatcgaagcattgcttttactatatcccacaagatttggtaagttgtattttcatttttatttggttcaaaacaattaaaaatttctcttgagactttttattttacacaggtgttatttagaaatacgctgtttattctctaaatattttcagcatttttagctctctgttactacctttcaaaaattatttatgtagttttaatttttcactttttagttttaattccactgttgtctaacagcaactttgtattatttctgttcttttaaatttgttgaggtatgttttctggctaggatatgatctaggttggtgaatgttccacgtgatcttgggaagagtgtgtattctgatgttgatggatgaagtagtctacagatgtcagttcgatccagttgattgattgatgctgtttggtttaactatatctggactgcctactgaatctgtcagttactgacagaggagtgttgaagtctccaaccataatatttgatttgtctatttctccctggattttttttttttttttttgagatggagtctcgctctgtctccagggtagagtgcagtggcacgatcttggctcactgcaacctccacctcccgggttcaagcagttctcctgcttcagcctcctgagcagctgggactacaggctaccacacctggctaatttttgtacttttagtagagacggggtttcaccatgttggccagaatggtctcaatctcttgacctcgtgatccgcccgcctcagcctcccaaagtgctgggattacaggcgtgagccaccacgcctggcctttttttttatatgtatattttaagatggagtcttgctctgtctgtgcacccaggctggagtacaaatgatgtgatctcggctcactgcaacctctgcctcccaggttcaagcagttcctctgcctcagcctcccaagtagctgggattacaggcacccaccatcacaccttgctaatttttgtatttttagtagagacggggtttcaccatgttggccaggctggtcttgaactcctgacctcaagtgatcctcctgccctggtctcccaaaatgttgggattacgggcatgagccactgctcctggtccttttttttttttttttttttttttttttaacaagagtcttgctctgccacccaggctggagtgcagtggcatgatcttggctcactgcaacctccgtctcccatgctcaagcgattctgctgccttagcctcctgagtagctgggactataggcatgcgccatcaggcctgggtaatgtttgtatttttagtacagatgggatttcactatgctggccaagctggtctcgaacgcctgacctcaggtgatccacctgcctcagcctcccaaagcgctgggactacaggcatgagccaccatgcctggccatttttttcttcctttgatgtaaattttcctttctttatgtagatctgagtttctgacctatatagtttcccttttttcgaaaaacgtaccttagcataccttgtaaggcagtctcctggcaacaaattcccccagtttttgtttatctgagaaagtctttatttcccctttttttgaaggataatttcactggatacagaattctaggttggtgagtttttgcttttttcttttcaaaatatttcattccactgtcatcttgcttacattgtttctgatgagaagtctaatataattcttatctctcttctgcacaaacaaggtatttttattctgctttctttctagatatcctcttagtctttggttttctgcagtttgaatgtgatgtgcctagctagagattttttggtgtttatcctgcttggtgttctctgatcttcctggagccatgtttagatgtctgtcattaattttggaaaattcctagtgattattactttgaatatttcttttgcttatttctctttcttcttctgctattcccattaaatgcatattagaccttttataattgtcccacagtaagtgataactctgtttgagcatttccttccttccttccttctctcgctccctctctcccttcctccctccctccctccttccttcctttttctttctttctttttttaatttttgagacagattcccgctctgtcgcccaggctggagtgcagtggtgcgatctcagctcactggctcactgcaacctccgcctgccaggttcaagcgattctcctgcctcagcctcctgggtagctgggattacaggtgcctgccaccacgcccggctaatttttgtatctttagtagacatggggtttcaccatgttggccaaactggtctcgaactcctgaactcagttgatctgcctgcctcagcctcccaaagtgctgggattataggtgtgagccatggcccctggccctgtttgaacactttcattctcttttttgtttttctcatgtttcagtttgggaagtttctgttgacgtatctcacagcccactgaatctttcttcaggcacatataacctactgatgataccataaaggcatttttcatttctctcacaatgtttttaatttctaggattttcttttgattcattcttttagtttccatctttctcattatttcccttctattcttgcatgtcatctgccttttcccttatatcctcattattttaaattccctacctgataattccaaagtttgtgccacatctaagtcagagtctaatgcatagtttgttcttcagactgtttttcttgtatgttagcatccttgtaattttttgttcaaagtcagacatgatgtatcaggcaataggaactgagatgattaggctttcaatgtgaggatttacgttaatttggccaggagcagacctgtgtttaacgtttgctgtacctgtagtgccagatgcttcctctactttcctttttcttttttttgagacagagtctcgctctgtcacccaggctagagtgcagtggcgcgatcttggctcactgcaagctccgcctcctgggttcacgccattctcctgtctcagcctcccaagtagctgggactacaggcgctcgccaccacgccctgctaattttttgtattttcagtagagacggggtttcaccatgttagccaggatggtttctaactcctgacctcatgatctgcccgccttggccttccaaagtgctgggattacaggcgtgagccaccgcgccaggcctagtttcctttttcttgtctttgggttaccctaaaacctccttcttcaatggagtctgtgctttacacctctctcagttgcaatcctgtttcctgttgttacgcaggaaccctgttgatgtgataatttgagggagaggaggtgctctctaaccatctgattaaatctcagctttttaatggctctgaaacctctaaaggtggactgtgaccttcagaagctgttcttagccttttttttctctttctttacctgatacaggaaggctagaggggctggagttggttaattgccattcctccaaatgagataagactcaggtaaaatagtttcccttagaaggcaggcctttgttatagagaactgagtgtttttcaaaatgtttactttccccctggatgtatttttaaatggttacttttccttttcccctgcctgaaaccctggtgaggctcctggaaataaagcccatgaaagtgtggggcccctctaagactaggccctcaggacagcttaaccagaagttctgttgtttacgtttaaatattagctagttatctttctcttatgattttgattttgtaaccgcccaaggggttcacattgcctgctgcctagacagagccgattgatcaagacaggggaattgcaatagagaatgagtaattcatgcagagccgactgtgcggtacaccagagttttattgttactcaaatcagtctcccccagcattctgggagcagagtttctaaggacagcttggtggatgggggaagccagtgagccgggggtgctgattggtcaggggtaaaatcacagggagtcaaagctgtcttcttgctctgagtcagttccttggtgggaaccacaagatcagatgagccagttaatccatctgggtggtgtcagctgatccatcaagtgcagggtctgcaaatatctcaagcactgatcttaggagctgtttagggagggtcagaatcttgtagcctccagccacatgactcctaaaccataatttctaatcctgtggctaatgttagtcctacaaaggcagtctagtccccaggcaagaaggaggtctgctttgggaaagggctgttatagtctttgttttaaactataaactaaacttctccaaaagttggtttggcctatgcccaggaatgaacaaggacaacttggaggttagaagcaagatggagtcggttaaattagatctctttcactgtctcggtcataattttgcaaaggtggtttcaatctccactgtgattgtagaacttttttttttttttttttttttgagacggagtctcgctctgtcacccagcctggagtgcagtggcacaatctcggctcactgcaagctctgcctcccaggttcatgccattcttctgcctcagcctcccgagtagctgggactacaggcgcctgccaccatgcccggctaattttttgtatttttagtagagacggggtttcaccatgttagccaggatggtctcgatctcctgaccttgtgatctgcccgcctcagcctcccaaagtgctgggattacaggcgtgagccaccgcgcccagccagaacatattttgtatgatttcagttcatattctctatgacttcaattcagtatttgtgtgatttcagttcagtcatacaaacatattttgtatgatttcagtttgtattttcaaaatacaaaatcatattttgtttaatttcaatgcatcttttcaatgtatcaagggaggatcgcgtctcacacgtctgtgtgcgtgtgaagagaccaccaaacaggctttgtgtaagcaacaaggctgtttatttcacctgggtgcaggtgggctgagtccgaaaagagagttagcaaagggtggtgggattatcattggttcttataggttttgggataggtggtggagttaggagcaatgttttgcgggcaggggtggatttcacaaagtacattctcaagggtggggagaattacaaagaaccttcttaagggtgggggagattacaaagtacattgatcagttagggtggggcagaaacaaatcacaatggtggaatgtcatcagttaaggctattttcacctcttttgtggatcttcagttgcttcaggccatctggatgtacatatgcaggtcacaagggatatgatggcttagcttgggctcaggggcctgacattcctgtcttcttttattaataagaaaagcaaaacaaaatagtgaagtgttgaggcggtgaaaatttttgggggtggtatggagagataatgggcgatgtttctcagggctgcttcgagtgggattaggggtggcgtgggaacctactatgggagagattcaactgaagaaagattttggggtaaggggtgatattgtggggttgttaaaaggagcatttgtcgtatagaattattggtgatggcctggatgtggttttgtatgaaatgagaagctaaacgaaagacacaaggtccaaataaaagaaggtgaaaaacaggtattaaaggactaagaattgggagtacccaggacatccaattacagagtgtccaagagggttcagtgtaattatttgcttggttggcgagtttttgggctgtatccttgagtttttttttatgttgtcatataccaggccagactgatttaggtaaaaacaacactcttcatttaaaaatatacagagtcctcctttttcagcagtgagtaaatagaggccttggaggttctgaggacaactacagctaaaagagtcaatctgtgcttggagaacagatgaagtttgtgatatatctgtaatgctagcagagaagtcattagagaggctgtggaatgttgtggcagtggttgagatgcctgctattccagttccaagtgcaatagtggaggcagaaagtcctagacccacaagcaaagggattagtgggatgactctttcttgtcgtgttgatgtcatgagggggacaggcagtagtttgttcccatctgcaaactggattttgggggtaaggaagactagagtgcatgtgcctgtccagttgggaggtaggcacatgtaggtggaagagccacataaaaagaagagaccttgtgtcaggcagaactggaaatgtaaagtgaaaaggtgagagggtgtactgaaagaggaatcctgcaccccaaatcctagagatccagcaagggcagcagccgttagaggttgtaatgggggttgatggtgcgactgcgtaaagggaggggttcggttctcatggtgtatgagaaagcgcatagtgtctacaagtaacctttcactgctattcatggggctgggtataagcaagcaagaggaggggctaggaggagattcagacgagcagggggagggtagcccaggatggagtgagatgcagggtatgtgtcttcctaaacaatagtgactgccaatgtgttttagtttgtcagtaatgggcttatcagtaatgtgaagttggaatgctcccatctgtttggttatgtgtgtggctgggttctggagataaagagtaaaggaacatttggacagaagaaggttgcctaaagggattccagcaggctgttgtcgggagaagcataaaggagtggcaacagggatggttgtttgtgtggtcaggggtccaaatatggggtgggggtggaattgacataaggagaaaggtgccgtaagtagatgcggagaagtgtggcagcttgttggtgtgaaatgtctggggagttctcaccaaatctgtctagaaagtaaagaatttcctcaggcaggtatagatgagggctattaaaggaggttctgaggtgcagggagatggaacaggtagccaagttggcctgtagagcggggatggctgtgtaaaagcaggaagaggccgggcgcggtagctcacgcctggaatcccagcactttgggaggctgaggcgggtggatcatgaggtcaggagatcgagaccatcctggctaacacggtgaaaccccatctctactaaaaatacaaaaaattggccgggcgtggtagcaggcacctgcagtcccagctacttgggaggctgaggcaggagaatggcatgaacctgggaggcggagcttgcagtgagccaagattgctgccactgcactccagcctgggcgacagagcgagactccgcttcaaaaaaaaaaaaaaaaaagcaggaagaaagggaaatgcatagccaacaattctttgctagaggaggattggaggattgaaggcagtgagaagagagtgggtgagattgatagtgtgctggagatgctggaggtaactagggaggggtagagagtggcataagaatgggaatgagaataagagggagtataaaagcaaagaatagaacttcatcagggtggaagtattggagtgtgccctgccaccaaagatcatctacctgctccaagagggagtcaagagtggtggtttggggatagcaccaggagataacagctgtgatggcttggagaaacagtgtaaaccggcagtgtaaacaagagcaggtcatttatgagtagttgagaatacagtagggatgacaagtttttggggcacagtccaaatagtgggggtgactgcacaaagctctgttgcaaagggtagggtaaggatggataggcctaatagaatgaagggatgtattaggctcataagggttattattgttcttcagaaatgtgagtgagtttaagggaagtaggggagagtacttgcgacttccaggaggaagaggatatatcaggctgtctggctgacggacacagctttattctggaatggtgaacccaatggggagggtcctgcaggcggatcgtggttggggtactatagatgactaagtagggtccagtccatcgaggttgtagagtttgaggggtcagattcttaacaagaactgatcatccagctagggtgtcttcatatggctgggaatctggagtaggcaagagaagattagcagcctggtgaatttcctgtctagcctgttggaggactggaagatagtcacctagagggctggtgtctgggacgaggttggggccgagtaagaaagtgcgtccatataaaagttcaaatggactgtaccctgtagcatcttgaggacaggctctaattctgagaagggcaagagataaaagtactgtacagtcctttttaagttggaggctaagcttagtgaggcatgtctttaaaagaccattagtctgttctacctttcctgaagattggggatggtaaggggtatgaaggttccactgaataccaagagcctgagaaactgcttgggtgatttgactaataaaggccggtccgttatcgaactgtatagaggtgggaaggccaaaccgaggaattatgtctgacaaaagggaagaaatgaccgcggtggcctctcagatcctgtgggaaaggcctctacccatccagtgaaagtgtctacccagaccaagaggtattttagtttcctgacttggggcatgtgagtaaagtcaatttgccagtcctgggcagggcaaatcctcgagcttgatgtgtagggaagggaggggtctgaacaacccctgaggggtagttgagtagcagatggaacactgagaagtgatttccttgaggatagatttccacgatggaaaggaaatgagaggttctaagaggcaggctagtggcttgtaacctacatggaagaggttatgaaatgacgacagaatagaatgggcctgtgaggctggaaggagatatttttcttggtcgaagaaccattcgccttgtgtgggaagagattgataggtggaaacttcagtaggagagtaaataggagtgaccaatgagaaggagaaaaactggccatgagggacagaaattggaatgctagctgcttctttagctgccttatcagcataagcattgccctgagcaatgggatctgatgccttttgatggcccttgcagtgtatgactccagtttcctttggaagtaaagtggccttgagaagagtttttattaaagaggcattaatgatggaagacccttgcgtagtaaagaaacctctttcagcctgtataacagcatggtggtgcaggatctggaaggcatatttagagtcagtataaatattgtcacgtaattcctttgcaagagtgagggctcaagttaaggcaatgagttcggcttgctgagagatagtggaggggcagagcggtagcctcaacgatagatgtggaagatactatagcatagcctgcctttgctggtgagtggcaattaggcctggtggaactgccattaataaaccaaatgtgatcagggtgaggaacaggaaagaaggaaatatggggaaatggggtgaatgtcaggtggatcagagagatatagtcatgggggtcaggtgtggtatcaggaataacatgggaggccggattgaagtctgggctaggaacaatggtaactgtgggagactcgacaaagagtgagtacagctgaaggagccggggagcagaaagtatacgtgtcaggtgtgaggaagaaaatagattttggaagttatgagaactgtagagagtgagttgagcatagtttgtgattttgagggcctctaaaagtattagggtggcggcggccgctgcacggagacatgatggccagcctaaaacaataagatcaagttgtttgggcaaaaaggctacagggcgggtcccggctcttgtgtaagaattctggccacacagccctgtactttggctgtgtgtaatgaaagggttgggatgagttagggagagctagtgcgggagcagcttttagggctgttttttaaggaatggaaaggggagtggggaaaggatttaggatttatggggtcagccaggtttatctagaacagaaggtgttgtggagggaggtactgaggataggagagtatatgggtttggcaccatggggtggataggcaaggcaatttcattgataaggcgcagatcctgaactaacctgtaagacttgtctggtttttgaacaggtaaaatgggagaattgtaaagagagcttataggttgtagaagcccatgctgtagcaggcgagtgataacaggtttaatccccttaaagcctgctgtgggatgggatactggcattgagtggggtaagggtgattaggttttaatgggatagtaatgggcgtgtgatcagttgccagggagggagtggaggtatcccatacttgtgggttaaggttgggggatacgagaggaagacatgaaggaggctttgggttgggaagaagggtggcaatgagatgtggctgtagtccaggaataatcagggaagcagataatttggttaaaatgtcttggcctaataagggaactgggcaggtggggataactgaaaaaagagtgcataaaagaatgttgtccaagttggcaccagagtgggggaattttaagaggttttgaagcttcgccggcaatacccacaacagttatgggggcaagggaaacaggcccttgaaaagaagataatgtggagtgggtagcccccatattgattaaacaggggacggacgtactctcttctgtaagtgttaccgaggcttggcgtctgggatggtccagggggcttctgaggcgattgggcagcgtcagtcttcagctgctaagccgaggagatctgggaaggagtcggccaaggaacattgggtttgggctccaggggctttaggagtggcagtgatgtgagtcggacagtccgacctccagtgggggcccgcacagacagggcatggcttaggaggaatcccaggctgtgggcattctgaggcccagtggccaggcttttggcatttgaagcaaggtccacgaggatgttttgaagaacccctgggagctgtggcttggatgtcctgaagttcttgtatgctggagacgtggttgtgggttgtcttccagaggagtcaagtagctgtaactcagaaatgtgttgctgtctggctacctcctctctattattgtgcaccttgaaggcgaggttgattaattcctgttgtgggatttgagggccgggttccaatttttgaagcttttttctcatgtcaggagctgactgggtgataaaacgtatattgagaataaggcggccttctggcccctgtgggtctagggcggtaaagcgtctaagggtagctgccaagcgggccatgacctgggctgggttttcgtctttacctcgggtagtttccttaagttcgtcataattaccagctttgtaagctgcctttttaagcccttcaactaggcaggaaaccatgtaatcttgcccagctgtacctggggaatctgcctgatagttccactggggatcctctcggggaactgctctaatgccttccaggaggtctggctcatgaagccggcggttatcagcacgagactgggctagagaaaaactttcccgttcatctggggaggggtagaaattaggatgacacttcagtcactccaggttaacttgtaggacagagttagatatcggaattcctgtgcacatttagtggggtctgatgagaaagagcctaaacgctggctgatttgggaaaggtccgatagagaaaaaggcatatgtaccctgactatgccttcagctccagccacgtctctaagaggaaattgttgggcaggtgggggagagctggtcacagaacgaaaccgtaaactagaccgggtgtggggagggaggtaatagaagggttatagggtgggggagcagaggctgaagaagagttggaggctgattagcctggcggggagcgagctgaggaggagcagtctggggaggaggtgaggggtcagatggctcagtagaaaagaaagattcacaagactcagtgatgcttggggttgagacttaagggataggcgggagggaaagaaggaggatttgggactagtcgcactggaaacagacactagagagggaacgaagcgtgagaaatgcctggatgtaaggcacctcagatcatttgcccatttttcgacaaaaattaggtctcggatggagaaatcaaaagtgccattttctggccatttagaaccattatcgagtttgtattggggccaagcggtattgcagaagaaaataggacgcttagattttaggtcaggtgagagttgaagaggttttaagttcttgaaaacacaggctaagggagaagaaggaggaatggagggtggaaggttgcccatagtgaaggaggcaagtttaaagagaagtgtagaggccgggcgcggtggctcacacctgtagtcccagcactttgggaggctgaggcaggcggatcctgaggtcaggagattgagaccatcctggctaacacagtgaaaccccatctctactaaaaatacaaaataaaaattagtcaggcatggtggtgggtgcctgtagtcccagctactcgggaggctgaggcaggagaatggcgtgaacccgggaggcggagcttgcagtgagctgagatggagccactgcactccagcctgggccacagagtgagactgcgtctcaaaaaaaaaaaaaaaagagagagaagggtgggaagggtagagacacggagaagcggggtggggagcagccctgggctgcaatgtgggtgagcagccaaagcaggcatcccttcagttgacttgccaccaagggaatgtgggtgaatgaccaaggcaggcatccctgcagtgatcagacaccagtggaatgtgggtgaataatcaggcaggcgtccccacaatgattaaacaccaagggaaggctgtcttcccaagtccgtgactggcaccagagttttcggtccaccgataaaatgtgtctcctttgtctctactagaggagaaaaagaactggaattggaaggacagggggattgaagcgtagtgagagaggctggagaagagagtgaaaagaccgcttacccaatttgaaattggtgagatgttccttgggctggttggtctgaggacctgaggtcataggtggatctcttcacggagtgaaggtgaggacaagggactggtctcctgaaggagtccctctgacccaggtctttggcaccaaatgtctcacgcattcgtgtgaagagaccaccaaacaggctttgtgtgagcaacaaggctgtttatttcacctgggtgcaggcgggctgagtctgaaaagagagtctgcaaagggcggtgggattatcattggttcttagaggttttgggatgggcggtggagttaggagcaatgttttgtgggcagggggtggatctcacaaagaacattctcaagggtggggagaattacaaagaaccttcttaagggtcggggagattataaagaaccttcttaagggtgggggagattacaaagtacattgatcagttagggtggggcagaaacaaatcacaattttggaatgtcatcagttaaggctattttcacctcttttgtggatcttcagttgcttcaggccatctggatgtatacgtgcaggtggcaggggatatgatggcttagcttgggctcagaggcctgacaggtgggtgcagtggctcatgcctataatcccagcagtttgggaggctgaggcggtcagatcacctgaggtctggagttcgagaccagcctggtcaacgtggcaaaaccctgtctctactaaaaatgcaaaaaatagctgggtgtagtggcacgcacctgtagtcccagccagtcaggaggctgaggcaggagaattgcttgaacctgggaggcggaggttgtagtgagctgagatcgtgccactgcacaccagactgggtgacagagtgaaactccgtctcaaaaaagaaaaaaaaaaaaaaaaattggccgggcgcggtgactcaaaactgtaatcctagcactttgggaggccaaggcgagtggatcacaaggtcagaagatcgagaccatcctggccaacatggtgaaattccatctctacttaaaatacaaaaattagctgggcatggtggctatggtctcttttggtaaataccaaatttaggaagcatgtattaggtgaaatattctacaaatatcaatcagattaattggttatgatatttttagttctgtatctttgctgattttctgttctattgattactgagaggagggttaagctctccacttataattgtggatttatccatttctcatttcagttttatcagtttgtcttcagattttttatttttatttttatttaagtttttgctctgtcactcaggctggagtgcagtggtgtgatcacgactcactgtagccctgacctctggggctcaagccatcctcttacctcagcttcctgagtagctgggaccacaggtgtctgccaccatgcctggctaattttttttattatttgtagagacagagtctcactatgctgcccaggttggtctcgaactcctaggctcaagcaatcctcctgccttggcctcctaaattgctggattacagttgtgagccactgtccccggccttcttcagatgttttgaagctctgttaagtgcacacacatttaggatggctttgtcatcttggtgacccttttatcatttgcatgaacagtgaagggtgtggcattttaccctgcttgtaagctaataagtcagtctgccagtttcatagatgctaacaaaagacatagattgcgggaacaatgacacaggaccttatcacctacaagagcagtggccatggtagtcacgtctgcatcagctccttgagcttcattttcaaaaggatgatgtgaaagggaccagatggcacctgcacatgtcggaggatgcactgtgggaccgtgggagaggatctctgaggttaggaatccacatctttaagaatgggagatgggccgggtgcagtggctcacgcctgtaatcccagcactttgggagtccaaggtgggtggattacgaggtcaggagttcaagatcatcctggccaacagggtgaaaccccgtctctactaaaaaatacaaaaaattagccaggtgtggtggcgcatgcctgtagtcctagctactcaggaggctgaggcaggagaatcgcttgaacctgggaggcggaggttgcagtgacccgagatcatgccactactgtactccagcctagtgacagagcaagaccccgtctcaaaaaaaaaagggagctgagccttcctgagtttttccccaaagggagaagttgtctttattatgctggatggaaaacaaacccgcccttcgctccagagagaggcctatttctatttccagtgctgttgactatatagatatccttgaaaagatactctagatccaaggcagtcattgcctctgctcataaaacatttagaaatgtgagaacttttggagaatatctttcaacaataacatctctctttatcactggtcatttcttttgctctgaagtctcctttgtctgatattaacatagctactccactttctcttggttagtgtttgtatgacatgtctgtttccatcctattttatttatttatttatttatttatttatttatttattttgagacggagtctcgctctgtcgccaaggctggagtgcagtggcgcggtctcagctcactgcaacttccgcctcccaggttcatgccattctcctgcctcagcctcccgagtagctgggactacaggcgcccgccgccacatccggctaattttgtttttgtatttttagtagagacggggtttcaccgtgttagccaggatggtctggatctcctgacctcgtgatacgcccgcctcggccttccaaagtgctgggataccaggcgtgagccaccgcgcccagcctccatccttttatttttaaactccctgtataattatatttaaggtggattgtgtgtgtattgtttggttttgtagacagcatatagttcggtacttttttttttaattcactctgaaaatctctttcacttggtatgtttagatcagggtcagcaaactatgtgggtcgaatctggccagctgcctgtcttgtaaataaagttttattaaaacatagccatgctcatttatctattttcttttttgagacggagtctcactttgttgcccaggctggagtgcagtggctcgatctcggctcactacaccctccgcctcctggattcaggtgattctcctgcctcagcctcctaagtagctggaattacaggtgcccaccaccatgcctggctaatttttgtatttttagtagagatagggtttgaccatgttggccaggctggtcttggactactgacctcaagtgatcggcctgcctcggcctcccaaagtgttgggattacagacaccatgcccggctcatttatgtattttctgtggctacttttctgctccaaaagcagagttgtgtggttgcaacagagaccatatggctgacaagttcaaaaatatttactacctggacttttactgacccctggtttatatcatttacgttgaatgtagttattgataggtttggattcagatttttatttccttttcagatttttattttatttcttttcggtttatttcctctagtctttatttctttattatccctttcctgccgtggtttagattatttgaacatttttagttttccatctgaattgaactctagagttttagttatgtatgtatgttttagtggttgctctagagattacaatgtacatacttaacatttcccagtctaattagaattagtattttgtcatgtcaagtggaatgtagaaaccttatcaccacgtagatctttttattcttcctcctttgtgtttgaatatctctattcatttagggctttcatttctctcagaaatgttttgcaatgtttagcatagggattgggcacatttttttcttaggttttttttttttaaggtattataatttgttcctagatatttatatgtttgatattatacgtggtattaaaatttttttcatttaaaaaattttttgaggccaggcactatggatcatgcctgtaatcccggtactttgggaggccgaggcaggtggatcatctgaagtcaggagttcgagactagcctggccaacatggtgaaaccccttctctactgaaaatacaaaaattagccgggcgtggtggtgggcacctgtaatcccagctacttgggaggctgaggcaggagaatcgcttgaactcgggaggcggaggttgcagtgagctaagatcgtgccattgcactctagcctggatgacaagagcaaaactatgtctcaaaaaaaattttttttgttgatatatggtaatattattgatgtttgtgtactgaccttgtagcctatgactttgctgaatatatttattaattctcattgtggtttattttatattttctaagtttgtagtcacgttatttacaaataaatatacttcttcctgtccaatctttagacctttcttttgtacaggaggaaaaattgcttccttcttcatttctaggttctgtggctggtctaagaattaattattattattattattttttgagatggagtctcgctctgtcgcccaggctggagtgcagtggcagcaatctcggctcactgcaagctccgcctcccaggttcacgccattctccttcctcagcctcccgaatagctgggactacaggcgcctgccaccatgcccggctaatttttttttttgtatttttagtagagacagggtttcaccatgttggccaggatggtctcgatctcctgacctcgtgatctgcctgcctcggcctcccaaagtgctgggattacaggtgtgagccaccgtgcctggcctcctgtttttttgtttgtttgtttgtttgtttttgagacagagtttcactctcgttgcccaggctggagtgcaatggcgctatcccagctcaccgcaacctccacctcccgggttcaagcaattctcctgcctcagcctccccactagctgggattacaggcatgtgccaccatgcccggctaattttgtatttttagtagagacgaggtttctccatgttggtcaggctggcctcaaactcccgacctcaggtgatccgcctgcctcggcctcccaaagtgctgggattacaggtatgagccactgtgccccgcaattttttttttttcttaatggataagaggttttttttcccctattaacatcaatgtaattcctgtgtgtgtgtgagagatctcagaaagggagagagagtgccaaggtcttgctctgtcacccaggatggagtgcagtggcacgatctcagctcactgcaacctctgcctcctgggctcaagtgatcctcccaactcagccgcctgtgtagctgggactacaggcatatgcctaattaatttttatatttttagtagagacaaggttttgccatattgtccaggctggtctcgaactcctagactcaagtaatctgcccacctcggcctcccaaggtgctgggattacaggcatgagccaccacacccagcctggttcctccccttttaaaccatataaagtaacttctgggtttgccatggcatttgtaaactgtcatggtgccagtgagagtgtcttttagcatgctagtgcattataattaatgtataacaagcactgagagcaactagaggttttgcagtttctttacggcatcctcagaaaacaagtcctgctgacctcataccttaggaatgccatctctgcatttccaaaggcgtcagtgtagtcttttgtaggctgcagtcttttgtaggcaagggataggcagatgctcctaaactataaatgcctgtgcgcgtattaaaaacagatacttctttggtgagactactgaaaaaacagtgctctttgatctggactattgtagaccttctcttacctaatacactccacctggggagatacattccttcatctgttttttgttaaaggcttttaataacttttagtaaaactacccaatatatgcatggaagaaacctgcaatttcacccctaaatacataaaaataaattttttaaaaaagttattgaggccaggtgtggtagctcatgcctgtaattgtagcactttgggaggccaagacaggagaattgcttgagcccaggagcttgagagcagcttgggcaacatgatgagacccccgtctctacaaaaaaaaaaaaaaaaaaaaaattagccaggcatggtggcacgtgtctgtggtcctagctactcaggaggctaaggtgggaggatcacttgagcccaggaggtcaaggctgcagtgagctgtgatcatgtcactgcattccagcttgagtgaaagagcaagacccccatctcaaaaacaaaacaaaaaacttttggtaatgaactataaacgaccctaataggaaaaacacattaagtcattaccagcttgtaacaccattctgtgacttcattgacacgttattatgtatttgtcacttagctttctaatgaccctgcacaattttgttggcagaacaggtggagaggtatgaagaacgaggaacactgcccggggagtttcttcctctgcaaaataagggagtgtgtactgaattaccgtttccagctccaacatccaggatttcagcactacctgcagagtagtgggaggagagataggtaagaagttaaaaagagacctgatggaatacgtggcatcctggtactgctggggtccatccccacacctcatgctcatgagagggagacaagcttcttggagctcctcctcatctacagggctctcctcacagggcctggaagttctgccccagccctgtggggattttctagagtcatttgcctctctttaaagccttggcagagggagccggtgtggggaaggggtggtaacgtagatggcaatgcttgtcagaacatattagagccctcttccacgctctgcagcccctgggcctagggctagcattattctccccttttatagccatctgttgatttcaccttatctcgcactaagcaatgggcttcttgtgggcaggtgctctctctcacccatcttatttctctctggctctttcacggggcctgctgcatggtaagcgctcagtgttcagtgagtgaatggacaggaaggggcagggaagtgaatcaaatctcctcaggttgagacatcagcaccatctgtgatcctttcctcatttggaccttcacatgcaattaggctctaaaatccagtgagtttttttttttttctttttgacggagtcttgctgttgcccaggttggagtgcagtggcgtgatcccagctcactgcaacttccacctcccaagttcaagtgattctcctgcctcagcctcccgaggagctgtgattacaggcgcccaccaccatgcctggctcctttttatagttttagtagagatggggtttcgtcatgttgcccaggatggtctcgatctcctgacctcaggtgatctgcctgcctcagcctcccaaagtgctgggattacaggcgtgagccactgcgcccggtcctaaaatctggtgatttttatttccctgtgtctgtttctacggctgcctccctaagttctttctctgttgggtagtgggcttcggcctagctttctcatcaccgccacacccttccttacccatcctgtacagacagatagatttttctaatgtacattttcagcatatctctgggctgctcagaccatttcctcaactcgacacccaaattaatcagctcactcttccatgttttaccatcctatccgtccttctaataaatacatcctgagcttctggggaggaggtctcatctcagattctctgcccaagccagatggtttcaacatagtcctgcctctgagcccttatgcaagccatctccctgcctgtcccaactacttgcttctatccagagcttggtaagcccacttctcccagagaagcctcctggggtcatcccaggccacttcgaattttctctttggtagcacttggtcacagcaaccttgggcaccaagctgagtatagaatggagtccaatcaatgttgatatgatttttaaatggtggcgacagtcatgtgccatctgaagcaggaatagggaaagagaagcagtgactagcctatacaaattagccaggcgtggtggcaggcgcctgtaatcccagctactcaggaggctgaggcaggagaatcgcttgaacctgggaggtggcggttgcagtgaggcgagattgagccactgcactccagcctgggtgacacagcaagactccatctcagaaaaaaaaaccactctgggaggccaaggcaggtggatcacgaggtcagtagttcaagaccaacctggccaacatggtgaaaccccgtcgctactaaaaatacaaaaattagccgggcacggtggcgggcgcctgtaatcccagctactcgggaagctgaggcagagaattgcatgaacccgggaggcggaggccgcaatgagctgagatcacgtcactgcactctagcctaggcagcagagccagactccgactgaaaaaaaaagagtctacagagcctttcttggaaactagtgtggaaagagaagagcagcatgaaaagccgaggccctgacagcctgatgtcccgctccctccttcacagctctgtgcccagggcctgcctgatgtgcagtgctgcagagaatccagcacactctgctcatgtatgtgcccgggcatgttttctttcttggctacctctttagtcatttgttatgtgttatgaagaaataaactcccagcaaaataatgtcttttgcacagtcttaaagtgatccattacctaagatcatcatagatgattgtgaattgggttgacctgaaatcacctaagaccagggcaggttgaccagagatgaagatggaacatggtatgttgggaactgttgagtactgtgcccttcttactagggcatgtagtttaagtactgtgaaactcaaaacattttatttttcttattgcaaaagtgatacagaattgttctaaagcgtttagaaaatacagacaagcaaaaataaaaatctgccataattccaccatattctagagtatatcttttattcttatttatttatttatttatttgagatggagtttcatttttgtcacccaggctggagtgcaatggcatgatctcggctcactgcaacctccacctcctgggctcaagcgattctcctgcctcagcctcctgagtagctgggattacaggcacctgccaccatgcccggctaattttttgtattttttttaagtagagatgggggtttcgccatgttggccaggctggtctccaactcctgacctcaggtaatccaaccgcctcaaaaaaaaaaaaaattcaatattattattgataagtagggatttactcctaccattttgttatttgttttctggttgttttgccatcttctcttccttctttccttcctgtctttcttttagtgcaggtgattttctctggtgatgtgcttcatttttttgctttttactttttgtatatccattgtatgttttttgatttgaagttaccatgaggcttgcaaatactatcttatagcccattattttaaactgatgacaacacttactgcataaacaaacatgcaaataaatactaatataaactctacagtttaggctgggcacggtggctcacgcctgtaatcccatcactttgggaggctgaggtgggtggatcacgaggtcaggagttcaagaccatcctggccaacatggtgaaacttcgtctctactaaaaatacaaaaattagccaggtgtggtggcatgtgcctgtaatcccagctactcaggaggctgaggctggagaatcgcttgaacctgggaggtggaggttgcagtgagccgagatcatgccactgcattccagcctgggtgacagagcgagactccatctcaaaaaaaaaaaaagaaaaactctacagtttaacttcatccccctgctttttttttttttttttttttgagacagagtcttgcacggttgcccaggctggtgtgcggtgctgcgatcttggcttgctgcaacttctgccttctgggttcaaatgattctcctgcctcagcctcctgagtaactaggattacaggtgcccgccaccatacctggctactttttgtatttttagtagagatggggtttcactgtgttgtccaggctggtctcgacctcctgacatcgagatctgcctgcctcggcctcccaaagtgctgggattacaggtgtgagcccccatgcctggccatccccctgctttttaactttttgttattttcctttatggcttattgtactgtctatgccttgaaaagttgtagttatttttgattggttcatcatttggtctttctacttaagatgagtagtttatgcatcacaatttcagcgttatattattctgtttttctatgtgcctactattcccagtgagttttgtaccttcagatgattccttttgctcattaatgtcttttttgattgaagaaatccctttagcatttgttacaggacaagtatggtgttgatgtaatccctcagcttttgtttgtctgtgaatgtctttacttctccttcatgctcgaaggatattttcactggatatactattataaaaaatttttcctggccaggtgcagtggctcatgcctgtaatcccagcactttgggaggccgaggtgggcagatcacgaggtcaggagattgagaccatcctggctaacatggcgaaaccccgtctctactaaaaaaaaatacaaaaaaaaaattagccgggcgtggtggcgggtgtctgtagtctcagctactcgggaggctgaggcaggagaatggcgtgaacctgggaggtggagctggcagtgagccgagatcgcaccactgcactccagcctgggcaacacagtgagactccatctcaaaaaaaaaaatttttttttcctttagcactttaaatatgtcatgccattctcccctgacctgtaatgtttccactgaaaagtctgctgccagactggagctccactgtatgttactgtttttttttttgtagttgttgtttgtttgtttttcttgcttcttttaggatcctttctttatccttgatctttgggagttagattattaaataccttgaagtagtcttcttttggttaaatctgcttggtgttctgtaaccttcttgtatttgaatgttctttctgtaggtttgggaagttctctgatactatccctttgaataaacattctaccactagctcttcctctacctcctcttcaaggcctataacagatttgcccttttgaggctattttctagatctggtaggcatgcctcattgtttttattcttttttttttttttgagacagagtctcactctgtcacccaggctggagtgcagtggcacgatctcagctcactgcaacctccgcctcccaggttcaagcgatccccctgcctcagcctccggagtagctggaactacaggcatgtgccaccatgcccccggctaatttttgtatttttagtagagatggagtttcaccatgttggccaggctagtctcaaactcttgacctcatgatccgcccacctcggcctcccaaagtgctgggattacaggcaggagccactgcaactggccttttattctgttttcttttgtctctgtgttatctgactgtgtattttcaaatagcctgtcttcaagctcactaattcttctgcttgatcaattctgctattaagagacggacgcattcttcagcatgtcaattgcatttttcaactctagaatttctcgattcttttaaattatttcattctctttgttaaatttatctgatagaattctgaattccttctctgtgttattttgaatttctttgtttcctcaaaacagctattttgaattctgtctttaaggtcatatttctctgtttattcaggattggtccctgctgacttacatagttcatgtggggaggttgtgttttcctggatggtgcagatgcttgcagatgttcgttggtgtctgcattggagaattaggtatttattgtagtcttcacaatctgggcttgtttgtgcccatcctccttgggaaggcttcccagttatttgaagggacttaggccccaagcccaataatgtagttgtttttgcagactcagaaagatcccaccttggtggtcctggataaaatccagaaaaattctctggattaccaggcagagactcttcttcttttcccttattttttgccaaacacatgggtttctcactctgtgatgagccacttggaattgggagtgtggtgatgcaagcacccccgtggccatcaccactgggactgcactgggtcagacctgaagtcagcacagcaccgggccttcccaagacccttcccttcagggcagcgagttcccccaggccctgggcatgtccagagatgctgtctgggagccagggatagcaataaaaaaccttagcaatttacttgatgttctagtctactgtggctaagctggcactcaaaccacaatacaaagtccttctcacgtttccctgccctttccacagggagaggagcctctccatgtggccaccaccaccactggtccacagtgggttctgccaggcaaccgctgatgttcacctaaagcccaaggactcatctgtcagcttgtggtgaatgttaccaggcctgggactcacccttcagggcagtgggtacccctctggcccagggcaggtccagaaatgtccaagcgcctaggcttggacttggagactccaggagcctgcttgttgctctacctcactgtggcctaggtggtacctaggagcacagagcacttcagcccacggtggtggagcctgccgagaaactcaggttccagccgttgggatgggcagttcccccctggctagggctggtgcaaatgttccctccatgcacaggcactggctgagtccagcgcagctttattctcttctgtgacatggcagcactgagttcagtgtgaagtcccctagttgctgtgctctccctttcccaaagtgcacagatcatctctctgttccatatggctgctgccgggggtgggagaggggtggcgtcagtgattcaagactgtctctctgagcctcttcaatggcccttttagcgatatgaggttaaaaccaggtactgtgatcgcttacctgacttttggttcttgtgacggtgcttttttgcaagcagacagttgttaaaatttgatgttccagcaagggcatgaattgtgctctaccttctctactatagattttttaaagtctgcataattttgcattttatgcatgtgccatactgtatttgaccagccttcagctgttcaatgtgaggggctatggtttgaatgtttgtgtccctccaaagttgatacactaaaagctaatacccaatgggataggtttaagaggtggggcttttggggaagtgattaagtcatgagtgctctgctctcatgagtgggattagtgcccttatcaaagaagctcaagggcccctttgccctttttccctttacaccatatgaagatacagcctttgtcccttcaaccatgtgaggacgcagcagcaaggtgccatcttggcatctgctggtgccttgatcttagacttcccagacaccagaactatgagaagtcaacttatattattattttttcttttttctttttttgagacagagttttgctctttttgcccaggctggagtgcaatggcgcaatcttggctcactgcagtctctgcctcatgggttcaagtgattctcctgcctcagcctcctgagtagctgggattacaggcacgtgccactacacctggctaattttgtatttttagtagagatggagtttcatcatgttggtcaggctggtctcaaactcctgacctcaagtgatccgcctgccttggcctctcaaagtgctgggattacaggtgtgagccatcatgccctgccaatttatattatttataatgtaccctgcctgtgatattttgttataccagcaggcacaagtaagacatgagttaacttcattaaaaaaattatagacagtaattcactgaacattcttaccattaagtcttactacacacccttgattattcctttagaataaacttttgggaatagaatcactaggtcaaaggtcgtatgcctatttaaaactttgttattgagaaagcttgtgctaattttattgacagcagtggatgagagtgtctctgcttcctcaagtttttaccatcactggttattttatgtgtgtgtgtgtgtgtgtgtgtgtgtgtgtgtatacatatatatatatatatttttttgagatggattttcgctcctgttgcccaggctggagtgcgatgccatgatcttggctcactgaaacctccgcctccggggttcaagcaattctcctgcctcagcttcccaagtagctaggattacaggcacccaccaccacccctggctaatttttgtatttttagtagcgatgaggtttcaccatgttggtcaggctggtctcgaactcctgacctcaggtgatccgtccacctaggcctcccaaagtgctgggattacaggtgtgaaccagtgctcccggcctggttattatattttgaattttgcaaatgttataagtggaaatatctcttctaaaaataacagatggaaaaactttaaaaaaatcttgttgtaatttgtatttattccatgacaaatttggttaaaacctgtcatatttattaatcatttcttttgtctttagacttttgatgtctgtgtaaggcagggtttagttggaggtaacagaaaccactcttcttattttaaggagaaggagctttgtcaaaggaaattagctttttacaaaatcactgaaagggccggaggaacaggatctatgctgggcttccaagaatgactctgagaacaacaccctagaactagtggctcaggaaagctgctacttctgctccaggcagcttcattctagatattagactgttccttgctaggtctgctagagcttcacagcaaaaaccagtgctctgtgcctgctcccaagacacactaagctactaactgttatggaatctctgctaccatcacaacagacaaacaacaacaaaagtgaaaataaaccaaatgtaaaatacctcaaaatcctagcttaaatgtaacaaatacgtttttacatacttaaagcagatcagaagaataccaaggaaattcccagtggtcacaatggaacgaaactggagttgtaaactaatactgaagccactgctgtgcctaggatatttgtcagtcttgatgacctggatgcttaactggccatctgtgcctggtagataatgccttggcggcagtgaaggggttgcaaattagggatttgaaactgagaactccacatagtaccaagacactcaaaaagctacatcctcaggaaaagaatggattgaataaaagaaacaaaatctgacttttagcaaagagaaataacaaaaaaacttatctttgcctgtgccctgggtggagaaaaaaagcagcttccatggatgtgtaactccacatctttactcttaggggttttggatctgggatttgagtctacaccaagtggttttagaagttaattctatgatcccgagttggttgcaattctggacgtctgacagaagcaatgcagatccttcctggagggacatagtctcaacctaggccttatagaattcccacagataagccctagctgaacataaactttcactccaaattaaaaaagaatacatgaagaaacaagctaccataagagtcagcaagaactcctaagaacttaagataatggatttatcaaatgtgttatataaaacaaatatacctaaaatgtttgattacatttaaaaatacaagaaaagagcaagagatattatataatgtaatcatatacatgcaaaaaatatacaaattataagcatatagcttgatggattttcacaattggaacacatctaactagcacccataaaaaaacccaaaacattactagcatccccaagtcccctgcccccatgtttccttccagtcatgacccatacccttcacaagagtaagtactatcctaacctctaataatagcacagaccagttttaggcagattttaaaaagcactaaatagaacttctacgaaaaaaaaaattttaaaaccccaacaaaccaatgaatgaatagtagatttgacatagctaaagaaagaattgatatggaattaactggattaaagctgaaaaaattttctagaacacagcatggagagacaaaatgatgggaaaatagcaggagttaagagacatggaagatagaatgagggaatctaacctgcttctaataaaaatttcataaggagagaacagaaagaacaggtaaaaggtgattttcagcaagataatgtcagagagtttttcagaattgctgaaagttacatatccttagattcagaagtaatagcgaatcccaagctgaataagtaaaacaaatgaacaccttaacacattatagggataccgaggtcactgaagtaaaagagaactatgggcaatcacaaggaagagacaaatgacttatgaaggcacaacagtaagattaacagcagatttctcaacattaacaatggaagcaagaagtcagtggaagagtaacatctgcaaaatgctgagatgaagagattttcaggttgatttttgacaagtctacctgtatgctatttataagagataacaaaatgatgaaagaggatgaaaaaatatataccaggcaagtagataggaagacacaatttcataaagatatcagttctctaaatcaatctgaattcaattgcaattgaattgcaattctaattaaaattcaaacaggatttttcttggaccttgacaagctggttttacatttcagtagaaaaacataggcaagaatacctagtttcgaagaagcacaacgtttgggtttactctaccaggtgtaactacttattataaaggtctaataattcagagtggtactgatgaaggcacagaaaaatagataaaaggtttagagcagaaagcacagaaaagtgcccatgcctgtatagaaattgacaaacatcagagggtcatggaagatcagtggggaaagaatggtgtccagattattggtttttcatctgggaaaaaaaataaggctgaatgttcacattataaacaaaaatcaattccagggtcggctgaagatctaaacaggaaagagaaaagtttccaacttttagaagaaaatgcttatgaccttaggttagggaaagatttcttataagtcacaaaaagtataaataacaattagattgataacctcactgatattaaattttaaaactgtgctcaaaagacacaaagagtaaaaaaataagctatcgactccgagaaggtatcatatagtttgaatgtctttttcccaccaaatctcaggttgaaatgcgattcctatgttggaggtggggcctggtgggaggtgactggatcatgggggcggttctctcgtgaatggtttagcatcatcctcttggtgataagtgagttctcactctgagttcatgtgagatctggttgtttaagagtgttgaacccacccccaccatttttcttgctcctgctcttgccatgtgatattgcctgctcctccttcaccttccgccatgactgtaagcttcctgaggcctcaccagaagctgagcagatgttggtgccatgcatgtatagcctgcaaaaccattggcccagacacacttcttttctttataaatcacccagtctcaggtgttcttaaaagaacaaatggactaacacaagatatatgcaacatattttgcccattaaatattagtagtagattttataaagtatccaaaatatatggagacctactattaaaaagacaaacaacccgataggaaagacaggcaattcgctaaaggaaaaaccaaaatagtaaatcaacatagaaaaagttactagtaatcaggaaaatggacattaaaaccatagtgaaataccgtttcacacccttcagcttggctaaaattttaaatctgatgataataaatataatttacaagctgttggaatcccagaacactttaagcattgagagagatgtgactgtgatctgagtcatatatgattacaacgtctgtttctcagattatagattaacttactttcttatttttcttgttctgtacaataactagagagaattaaataacaccagggacaacaacctcctgtcttcctaattaatggcctttgttattgattaacatcccctttgttgtcctgccttgctgatcgcagatgacaaaacccatcgctattataccctttattttaaaaaatgctaaatgtagccttcccacaaacactgcctatcatcagtcaaattgctataactatgtaccaaccttgtatgaaaaatgttctaatcttgctaaaagctaccctgtctctccctgtataaatgaaaccttaacttccctactttgaactgccaactccattccttggagttggtttcctggtggactattctcaaactttgcatttgaatacactcctttaaaattagattctgacccttttgattatttcaggttgacagtaccaacaattgatgtggctatgaagcaatttacagtaatgataatataaattggtaatcacttggtagaataagttgaaaatatctaataaagttgacaatacacatacgataagatgcagtaattcccttttaggtacgcactgcagacaagcccttgcacatggcaggagatatgtcaaagaatatttaatgtatcattctgatacaggagctaaaaagaaattatttaggcagatagtgaggctaaaggagtccttggcaaggctgccttttaaacaaaaagcagcccccaaatcatttcttttctaacaaagagcagcctataaaatcaagctgcaaacatagataagcaagctggaagcttgcatgggtgaatgctggcagctgtgccaacaggaaaaggctacctggggaccaggtatattcaatatggagactccatcttcccttttctttgtcaccacgtgtgcagtaaagaagcaggcaacatggcaccggccaggtggagaccccacctgcatagtaaaagattagggtggggcggccagcttctttgcacgctatgcaaatggcacacccagtcctaaccagttcttcgtgctgtatgcaaatggcacaactggtttgaccaatctttcgtgccctagctaaatcagacactgcctcctcaagcttatctataaaacctcctgcgcttcactgtggacctgaagacccgctcaggaccccctctatctgcccgagagagcatttctctttctttcgcctattaaaccaccactgttaacttcactccttgtgtgtctgcatccttgatttccttggcgtgggacaacgaagcctcgggtattaccccagatgaatgacaccacgtgaattcttttatagtaggaaattggaaacaaaatgtccattatcaggagaatgaataaataaattgttgtctatataatggaatgctaaatagcaatgaaagtgaatgagctagagctgtggttgtcaacatggataattcacacaatgttgaatggtaaatgtgaacttcagaagtacacatgtggtatacttgtactggtcctagactggtgcaaatggggcccctgtcatgggtcccacatctcaggagctagggcagagcttggacagagacccagatgactagctttcctctccaccctttgcacagctcctgaggttgaccagatgcccctagcagctctgggctgcacctttgtgtccaagtcttggttccaggaagaactctgagcagattgctcctgttggctggtgcagttggctggtgttcctgttggcaggtggcatagcacaagattgggctgccagaatggtactaatatgctggtttgggcaactcaaattgtttatatagacagacgcccccacaaaaaatacttgcttatgattccacacacctttgggcatataaagcttaaaaatgtgcagtataggccaggcatggtggctcacacctgtactcccagcactttgggaggccgaggtgggcagattgtgaggtcaagagatcgagaccaggccaggtgtggtggctcacccctgtaatcccagccctttgggaggccaaaacgggcggatcacaaggtcaggagatcgagaccatcctggctaacacagtgaaacctgtctccactaaaaaaatacaaaaattagccaggtgtggtggtgggtgcctgtagtcccagctactcaggaggctgaggcaggagaagggcatgaacccaggaggcggagcttgcagtgagccgagatggagccactgtactccagcctgggcaacaaagcgagactccatctcaaaaaaaaaaaaaaaaaaaaaaaaagtccaggcgcggtggctcatgcctgtaatcccagcactttgggaggccgagacaggtggatcacaaggtcaggagttcaagaccagcctggctaagatggtgaaaccccatctctactaaaaatacaaaaattagccaggcatggcggcaggcgcctataatccagctactcaggaggcagagacaggagaattgcttgaacccgggcagcagaggtttcagtgagccgagattgcgccactgcactccagcctgggtgacagagtgagcctcccgagtagctgggactacaggcacccgccaccacaccgggctaatgtgtttttgtatttttagtagagacggggtttcaccgtgttagccaggatggtctcgatctcctgacctcctgatccgcccgccttggcatcccaaagtgctgggattccaggcgtgagccaccgcgcccggcctatcatgttttatttcttaagctgggtagtgggggagtaaaaggtgctgattgtgttattttttatgcctttgtgtattatttgatttttttttcttttttttttaagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacttaaatcttacaagtggaaagaaaattccgtggtaaatttaagtacaaaagtcaaccaaaattctgagtctcggacaagactggttaaaaatcgttctacaatgaaactaataaattaaatcatataaaacttttattgctttgcaaggaagctttagtattaaatgtaagcattttcatctggtgattcttcccagtctcctgtggtaataatacctggacagggaagaaatcttttgagataactaaactatactgggaaatgggccccttgctaagtttcctgtggcagtgacaccccctctgttgcaaatattttctccgatgcgtggtttcagttccaagccaaacccgttctacagcgtgctttgtacctttccagagactgatcggtatcagcttgccagggctttaaaccccattcattctttcattacttaaaagcctctttctttggaa

SEQ ID NO: 186 - DNA, 70309 bp, Homo sapiens
tgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccattt

SEQ ID NO: 187 - DNA, 156141 bp, Homo sapiens
tgcctctagatcttcttttcctcataacatattttctcctttctgtcattttgaaagtgttgtatattgatgcccctggtcatttaggaatgcccatttctctttgttctagtgctgttgtgtgggtgaaggttgacctagtttcagagaaggggtgaggaaaggcaggggcaaaaagaataaaggaaagagtttcttttgagtacaaataaaaactaccagggaaatctgatttaccaaaatgttctagggattagatttgcaactattaaatatgatttaactgaaggacccctccggccttttttattcccttcttttttactaaaattctttatcgaattgcagaatcctttttcatttgtctcagtaagtaaacttcaataaattataggtaaaatttagaaaactgaaaattctgttagagattagaatgcattaatatttcttgccttaggctgggtgcagtggctcacacctgtaaccccagcactttgggaggctgaggcgggcacatcacctgaggtcaggagttcaagaccagcctggccaacatggtgaaaccccgtctctactaaaaatacaaaaattagccaggcatggtggcaggcccagctacttggtaggctgaggcaggagaatcgcttgaaccagggaggtggaggttgcagtgagccgagatcgtgccacagccgagatctgtgagcctgggccacagagcgagactccatctcaaacaaacaaacaaacaaacaaaaaaaaaaacaaagaccatagaagcatatgaataatatgaatagggttttggagatttcacaggacatgcagtaaatgcaaggcatcgtagaaaaataaagtgtccagggtgagtcccccaaatcagcttgcttccttggagatgtgccactctttcctgaaagtttacaacaaaggaaatgtcagttatctgaggttttggcggggctcgggtggaatgttgtgatgaattattccttaaatgccctgagactgagcatgggttccaatctggatgtttccagctcagctgcaggaggagggagaatttagacagagacgttgtccgccaaagctaaataccttccgcctttgcctacttttcatttccaaacaccagtattgattccttccacgacgaatcgatcttgtggcttgaaagaagcctctacctggaagctgtgggggagggatgaagtgcaagagaaaacatctgttaatctggacagaggcagcgtggcctgaaatgaagacataccaagcccatcctgggaagaagtgtttctccaggtggcagcctgcaggaagcagagctccttctgaacaggcttcccactggctcctttctttttgatatttttttccagctttgttaacgtatgacaaataaaaattgtgtatatttagggtgagcgatatggtgttttgataaacacattgtgaaatgatcaccacgatcaagctaagggacatacccatcctaaccttgttgccactgtgtgtgtgtgtgcctgagtgtgtgtgcctgagtgtgcgtgcctgagtgtgcgtgtgtgcacgtgcgtgcgtgtgtgcctgtgtgtgcgcacgtgtgtgcctgtgtgtgtgtctgcgcacatgtgtgcctgtgtgtgtctgtgtgcatatgtgtttgcacgtgtgtgtgtgggcatgcctgtatgtgtgcctgtgtgtgcgtgtgtgcctgtgtgtgtgcctgtatgtgtgtctgtgtgtgtgactgtgtgtgtgcgtgtgtgtgtgtatgtgtgatgagaacatttaagatctgctctcagcaaattccaagtacacaatacagtgttatatacattagatctgcagagcttattcagcttctatctgaaaggttgtaacctttgaccaagatcacccgtcctcaactactgttctactctatttctatgagtccacctttttagatttcacaagtaagtaagatcatgcagtgtttatctttctgtgcctgggttatttcacttggtataatgttcgtattcttgtaaatagcaggatttcattctttttttaaagctgaataacatttcatttgatagttactacaatttcttcatctatcaatggattcttaagttgcatctgtatcttgattattgtgaataatagtgcagtgagcatgggagtgcagttatctctttgagataatgatttcattttattttttaacgtacacccagaagtggaattgctagatcatatggcagttctattttgatttttatttttttgtggaacctccatactactttccataatgactataacaatttgcagtcccaccaacagcatgcagtttttcccttttcttcacgtccccaccaacactcattatattttgatcttttaataataaacatcctaacgggtgaagtgatgtcacattgcagttttgatttgcgtttccctgatgattagtggtgctgagcaccttaatatacacctgttgcatctccgtatgtcttctttggaagaaatgtctattcaggccctttgcctattgttttacttgggttatttgattctttactattgagttgtaggagttccttcttctctttggatattaattctctgcttttcagtgccttaaagtttctgtgtccccacccctaccacgtgttagcctttgctcagttctacatcatgtctgctcatccctgtgacccagcgctgtgcctagcatggacagatgctcaaagcgggattgatgactgaatggatagacaaatgtggcttgatgttttcccgcaagcagttcgtagtcttgtgaatgctcagtggtaacacttccgtaattcctccccattctactcttcatctatgcttcctacctagaatgtttgagttggaggagcttgcagccctttccttggtgcagtgttggtggaactcaggaaattgtagttcctaaagataatgtgatcacctaaatataatgacttgctggtagagagcatggagcagcaccagaaagcctgtgttctaaccttggatctgtttcctgctgagggtatgtatgagctccacgaagttgcccaacatctctgagcctcactttctcacatctcccagttgggtgattattcctctgcactctcttctcagggttgttacaagggtcacatgagttaattgatgtgagaactttcaaataaagtgtagaaattattcatgtgttagggatcattatttttcagcctattctctcccaaggagtatctttgtatcttagcagaagtctccagtgccttaaagaagctaccattagaaggaatccaggcagagtcctgaagaacacgttttggatcctgatgagtcttcaggtcactgttttgacaacatcatgctgcagttttaggcaaagttcaccgacttgatgccataaaagcgagtttgcatgacataagctggacaagtaccatgcttctcatctcacagctgtgaagccttgtccacgtgttttttgtatttcagagaacaactgaaatatcaccatcatttcacagcagctcatttctggtgttgacacatgactcatagggttttagagttggaaaagaactgataggtggtaagacttacgatgtatgattaaccaacccctcagtgaaccatgaagtttttaataaaacatataaaatactagacaggaataaaccttcatcctttacagtattactgatacacagtgagaaaactcaaatacctggagcgaaaggaatgggatgacattggtgtaagaggcactgggaggaaatagtcaaatatgtatgttactacattaaataggaattagaggagggaagaatcatttgcctaactagtgtttcttccaaaatcaatggaaatttaaattgaatgatatttttctcagtttttcttttcttctacttgttttctctcctaaataatccaaatcgctccctctcctctctctctcctctctctctctctctctctctctctctctctctctctctctcagtaagcaccaggatacctattctatggcacatgcttgatagttcttgctaagatactcaagtcttaagtcctaatcaactttcatttttatttcatcaagagtttaaacattaatttagtgataatgatagaatggtaggaaattggtcccatagcctcagaacaaatcacaccatataaatgtgtctatcatattcaagattactttcttttgatgaactgttctattagtgcatagtttaaacacatggccagcctatgctttaaccagtactggaatttaacacacagcggcaaacaggaatcttgcttaacttgacttggactgttgctcagcgcctgctgctgaccctctggtgagaatgcaataacccagaatgacggatgagtcagggaggctggacagcagattgtccagaacagtatgtaattcccatgagagggaaggctgtggagaccagctcacccacctcactgactccctgcaaggcccgagttaaaggatgctccacaattccctctccattccagaatgacatttcattctgatcaatgtcctcttactaggttgacttttactctctcaaatgcgctgtttaaaatacaagttgctctggaatatggcccattaaatgaattactggggcagagcatttttccctgcattagagaaccaaggcagcccaatgagaattggtgcctaggaggatgcagagtgaggaggaatgagcagagaggggagggcaggacacatcaacatccaaaatttgagtcgtccacttcatgatctcctttttggggtttgcttgtcacttcttcagggaccctctgccagtcgaaggcattgtgtccaccctctctggaaggctgcctgtgaggaatgacaggagatgagaccacagaggcacaggacactagaagtcagagaaacttttgagaccatgagtctcaattcctcattttacagacccagatattacagctctgctcttaaagtcacaaaacttatgtaaacgttgtgtgttttgctgagctagatgaagaccattttgaggccttatgcacctgctgtgtttttggtgggactctctcctgtccccaggctaagattctttacatgaattctcaaattccacagatgatgagattttatagcatcttccagtgttgggtttggtttttgttattttgaatgagcgtgctgactgtaggaaatgatgaactcaagtggcagttgagatcagagggactgaaaacaaagtcaagtgtaacaggatgctgctttggtggtgtttttaccgcccaaatgcacagcccggatccacacaccttgacttcatctctgttccccatttattttccaccggatctccgtgggcacttttttctcctctttcatcttttcctctactcagaaaagtgcttataaaagagcaacggtgatattgcttctatttgtcttcttgaaggaaactggtttaccctgaccctctctcgtgcatttccagccaggtcgattcttcttaggcctgtgtttgtctacgctcaccttttaacatttgggccaggggagggacaggatccttaaaacatgatacctatttccacatctgaggaaatgtaaataggttgttgtagattttcttaatatcatttttgtaccaattcctcacccaggcaattcactacaaccttgaaactcagcatgtttctgggtattctgtctggtatctgaagactctccgaacccagttctgcatgtggctaaattacaaactcagaggagcagcttccaaatacgagaattttctgggtggtgatttagtcaacatgtaaatgctaagctctgattggaataggaaaagccccctcaaaaatttatttttcagaatgaatgagtcaaagctctacgacttcctgtctgctggacacaaaaccagaaagcctgattcaacagagaaagtggctgaggtcaaggctgcaaggactaatttaggattgggattcttgctcttgactcaggcattgaagtagcctcacagagaaataatacattccagaaatgccttggtttctgtgatctccatctagaccaacaaatcgccctatgtaatcagcctacagtgcatctcaagaaagtacaatataaatggaaatatacaacctactgagaccaaaacaaagatttattttaaaaaaagagacgtctttacatgcatcactagattttaacggtaatgaagatgggtcattgagggtataaaacgctggaatcctgcatcagagtgcctggtgaggaaatttttttttattattattatactttaagttttagggtacatgtgcacaatgtgcaggctagttacatatgtatacatgtgccatgctggtgtgctgcacccattaactcgtcatttagcattaggtatatctcctaaagctatccctcccccttcccccatccccccaccctgcaacagtccccagagtgtgatgttccccttcctgtgtccatgcgttctcattgttcagttcccacctatgagtgagaatatgcagtgtttggttttctgttcttgcgatagtttactgagaatgatgatttccaatttcatccatgtccctacaaaggacatgaactcatcatttttatggctgcatagtattccatggtatatatgtgccacattttcttaatccagtctatcattgttggacacttgggttggttccaagtctttgctattgtgaatagtgccgcaataaacatacgtgtgcatgtgtctttatagcagcatgatttatagtcgtctgggtatatacccagtaatgggatggctgggtcaaatggtatttctagttctagatccctgaggaatcgccacactgacttccacaagggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgagttcattgtagattctggatattagccctttgtcagatgagtaggttgagaaaattttctcccattctgtaggttgcctgttcactctgatggtagtttcttttgctgtgcagaagctgtttagtttaattagatcccatttgtcaattttggcttttgttgccattgcttttggtgttttagacatgaagtccttgcccatgcctatgtcctgaatggtaatgcctagggtttcttctagggtttttatggttttaggtctaatgtttaagtctttaatccaaggaccaacaaaattgatagaccactagcaagactaataaagaagaaaagagagaagaatcaaatagatgcaataaaaaatgataaaggggatatcaccacccatcccacagaaatacaaactaccatcagagaatactacaaacacctctatgcaaataaactacaaaatctagaagaaatggataaattcctcaacacatacaccctcccaagactctaaaccaggaagaagttgactctctgaatacaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaattcattttatgaggccagcatcatcctgataccaaagccgggcagagacacaaccaaaaaggagaattttagaccaatatccttgatgaacattgatgcaaaaatcctcaataaaatactggcaaaacgaatccagcagcacatcaaaaagcttatccaccatgatcaagtcggcttcatccctgggatgcaaggctggttcaatatacgcaaatcaataaatgtaatccagcatataaacagaaccaaagacagaaaccacatgattatctcaatagatgcagaaaaggcctttgacaaaattcaacaatgcttcatgctaaaaactctcaataaattaggtattgatgggacgtatctcaaaataataagagctatctatgacaaacccacagccagtatcatactgaatggacaaaaactggaagcattccctttgaaaactggcacaagacagggatggcctctctcaccactcctattcaacatagtgttggaagttctggccagggcaattaggcaggagaaggaaataaagggtattcaattaggaaaagaggaagtcaaattgttcctgtttgcaaatgacatgatcgtatatctagaaaaccccattgtttcagcccaaaatctccttaaactgataagcaacttcagcaaagtctcaggatacaaaatcaatgtacaaaaatcacaagcattcttatacaccagtaacagacaaacatataaacgctggaatcctgcatcagagtgcctggtgaggaaattttttttttattagtatactttaagttttagggtacatgtgcacaatgtgcaggttagttacatatgtatacatgtgccatgttggtgtgctgcacccattaactcgtcatttagcattaggtatatctcctaaagctatccctcccccgtccccccaccccacagcagtccccagagtgtggcgttccccttcctgtgtccatgtgttctcattgttagcctctctgacatgaaaatcctgaagcatcccagtggtacttcaacagaagaggtgacacaaactcccaagaagttagtcctttgtcagaaaaagataaccttgtacagcttccctaaaacaaattcagacagagatctggtcatcaacactcctgtttaaacttgcaaagccatcatctctgtattgtgagttatctgtgtttcattataaccgaagttcatctgcacaaattggcattctaaattgttacttgttattctgcacattttatgatgagatagttacagaaataaattaatataaattaagagaatatcacaaattagtagaataaggaatggccaatgtttgtcaagaagctagctaaggtttccaatgtcatttattatataaattaatattctcaccacatatcataccccaatctcagatgtatttaagtagctaaatagaaaaatagaaaaaagaaaatattgtgtgttatagaaactaagaaaaatagaaaaaagataatactgtataatagaagctaagaaaatggagataaataattattatctcaacaaaaatatcatcattagaataaaagcaataaaagccaaaaaataattagaaggaaaatatttatagttttactgtataataaacatacacttaaatataaagcagaaataaaaggaaaacaagatctggtaaaatatttgcaacaaatttcctatgttaatatatatatttagtatgttaggagatcaaacaaattaaaaaatcaggcaaaatacatagtgaagatgtcctaaaaaccaaaagcaagtttgaaatcagtattaattgttgctctcctatttgtaacagtgaaaaattggaagtaactgtttcccttatgattaaatattgacaacagcatgcaaattgataatttacataatatttaagaggaaggacaaagcagatataattaaatcccctctcttcctttaaaatgattgaaataagagtaaagaaacccaaaaggaactatgtttatatgacactgaaaagcaaaggaggaagccacagaccaagattttgacaaatttctgcaagacagaaggaagacaggatcacattaataaacatatcccagtagaggaatccatggctcagagcacaggtgagacccatttactaggaatgcactcactcccctaacacccctctgcatggagcagctacacagagaaatgagatttgacactaagagggtgatttgtggaacggatgcaaggcaactcttaccaagcctctctccccgtctcccaactgtagagctgagaacatagcctcaatctcagaaggtggcatcaagaccagcgggagagaaagaactagtcaacaagcgatgctaaataattcaggatgcatggcttacccatatggggaaacataaaattcttgccaaattccaggggttcagtctagcttccactgctcaccagggcgtggaaaaccaatccctgagatgagtattgccagggaggaaggtttcatttggatgacgccagccagagagattggagcaaaacctcaaatctgtttcttcttcctgcctccaactaaatttaggggtgtatatagcagggaaggaaaatggggctgggagggcaagaaagaagagttggtcaccaggcagcaggtgcatttcattgtacaaatcataagtttatcaagcttcagttctgtgggcatgtggcttgttagaaaatcaggctactttcaaaagtagtcatttttctcagtatacacatataaaatccacatgaattaaagatgtaaatgtggaaaacaaacctaaagctttttgcaaatatataaacaaatacctttataacctcattgggaagggaaggatttcacacacatgacacaaacatcacaaactgcacacagaaaagataaaagtcactgtattgcatttaaaaacgctagttcatccacatatgccatggaatactatgcagccatcaaaaggatgagttcatttcctttgtaggaacatggatgaagctggaaaccattattctgagcaaaatatcgcaaggacaaaaccaaacaccacatgttctcactcataggtgggaattgaacaatgagaacacttggacacagggtggggaacatcacacaccagggcctgtcgtggggtggggggaggggggagggatagcattaggagatatacctaatgctaaatgacaagttaatgggtgcagcacaccaacatggcacatgtatacatatgtaataaacctgcacattgtgcacacgaaccctagaacttaaagtataataataattaaaaaaaacactagtgcatcaaaagaaatcttttcaagtggaggtgggggagggtgagttacatatggggagaagatattctcagcccatagaacaaaagtttgtccatccagaatacctaaaatatactacaaatcagtgaggaaaagatgaacaaacaagtagaaaaataggcaaatgatgtaatccagcaattcaaagagagaaagtccaaatggccaatgcatatatatatatatattctcaaactttattcgtaaccaagaaagtgcatattaaaactgaagagagacatcgttttatgcccatcacggtggcaaaagtggcagcatgtgacactgtgatgggctggagacagcggcggtggcagctgtcacacatagctggattaagccctggaaatttgatgagggggcaatgccagcactagatatagaattcatttacatattaaaacatatataaaagaatgtttgctgcagcattgtttgtaaaagtaaacatttaggtaccatttataaatgcattagtggaaggatggataataaattgtaggatgatattatagactactacccagtggcagggaaaagctacagctatcagtgaattaacaacacaaaattaggttgcaagatatattgtatggtgccatttatgaattgtaaaaatgtaaaacaatgacacatttatctagccagatgtaggttaagatagccaaagccagtttttaaataagtgggcataataaacactgagtttaggctggtggtgagctctgggcagggagggaagaaaaagcaagtagattgaagtgggcaagatttgtgactttttctttttcccgagacagtgtcttgctctgtcgcccaggctggagtccagtggtgtgatcccagctcactgcaacctctgcctcccgggtgcaagcgattctcctgcctcagcctcccaagtagctgggattacaggtgcatgccaccacgcttggctaatttttgtatttttagtagagatggggtttcaccacgttggcaaggctggtctcgaactcctgacctcgtgatccgccctcatcagcctcccaaattgctgggattacaggcatgagccaccgcgcctggccttttttttttttttccccttttcttttcttttttttttttttttaacttttaagctcagaggtgcatgtgcaggtttgttatataggtaaagggtaaactcatgtcatgagggtttgttgtacagattattttattacccaggtatgaagcctagtacccattagctgttttccccattgtctccttcccattctccgccctctggcaggcttcagtgtgtgttgttcccctctatgtgtcctgtgttctcatcctttagctcccacttataagtgaggatatgcatttcttaaaagaatgttacactactgttgggatatttttctaagtctgcttttttttaatcatccagaaggtgtcaaccaaaaacttcctggtaataaccagtactcctattcctgcctgagtggctttcctgtgactggactgaaacgtcctgcagctgtggttgaacgagggtgacagccaagtttgcatggcacacacatcatgactgctgcctgacccacagacaccacacagtacaggcttgtttcagagatgccaaatgtggggaaaatgcatcttaaaagtcacagaagtaaatgtagtttattaataaatgtaataatgaataaatgattaattatttcatttataaggaggacggatgaaagaaagagaatataaatgcatttattaccactgaactgtatatgtaaaaatggtaaagatggtaaattatatatgcatattttatctctatttaaaaaatcactgaaataaatgtagtttgatcagtatttgtttcaggaatatttctgcagcttttttgtttgtttttgcttataatttttggcctctttttcttctttatattttgcttttattctcctgttgttggtataaaaagataattcatccaatcttaaagctaggaacatttttcttcaaatggcaaaagtttagtaatataaaattacatcttctttgtggctataatcacgttacttagttcttcagggaatgatattttcatatgcctaatattttaaatgtttttaattgattttcagtttcccaaggaaggagaatctcctttccaaagaggttcctttgtgattttggaacagaaagtcaatagtacaagcctcaacattacaagaggcatggtaggttttctgttggaaggtactggagacagatgtaggatacactgcatttttcattttacaaatgggtagcaagagatgctgtgtaaaattgatgggtacattacttaaggttcttccagctgctatagcaaataaaccctgtaatctcaatcttttaagaaaatagtagtttctttctcaattgctcaaaataaaatttattttattacaataaaatacatcagttatttagcagaggccttcagaatgctgaatcaagaacccaggtccctccaccttgaacatccatcatctctgaagattcaagaatagtttaattccaactttagaatgggagagaaccagagagttctcagaaggcatccccggatgttttgaaggccaggcctgaacctagcacatacttctgccatattccagtagctagaacgtagtcacatagcaaaggaggccaagaaatgtggaatagctgaagagcagccgaaaaaagaaaatcagtttggtggataatgagcaagtttcttccaaaatggattaaaaaacagtgttttaaattcattagtaaagtgataatgtcaatttgaaaagatgatacaggaaaaattggtaagaaaaggagaaaagaacaattgattgtggaagttagtggaactctttgtcttacagctgagaggtgatggattgtgtttgaactggggaaataaggaagtggatctgtgttcctgcttcctgggcatacagagctgtccaccacagaactagcattgacaccggcaaaattgcttttctctgagaacttggagagagaataggggtcatgttggatttggtgatgatagtgatggtggtgatgaggaataatttatatttttattgtaaattttcagtaatattttgaatttttattttaatatacatggataactttaataattacataattaatcacagtaaaagtggtaaaatacaagctgaaaattaaatccaaggacagagatccacttaataagcaactatagacatggaataagaatattttttcataacttttattattacattagcaaatattcatatttttaagaggaagtgcagagtagaaaactacaagtataatctcttttacataaatactatgcatagaaaagactagaagggaaccacaggtgttgttttagtatatttatttatgatgaattatagtctttatttttgcttatattttatctttgttgtcagctatataatgagttgtattaatgtctatacttttgtgtctaaaaaattgaaattgaatatttcattgtcaaaaactaagccatgacagaaagcacaataacttaatagtgaagtagagttcagggtgcttggaaccgtagctggctttgtctaatggtgagataatcattaggattagaactcaagagccctaggtttccatcccagatatgttgctaactaaatgtgtgaccctatgtaggtcactttatcagcacctcggtttttcacttgccgagtgatgttcgcattttcatttcctacaacctgagtattttaatgcagccacgaccctggtgctgcctgttgaaatgaggcagattaaagaccacaaggcctatggcaggaaagatgcttctttttccacctccagtgacaagctctgtgagatgaagtaaatcttctaattcagtcaaattctgctgctggtggcttttctccattggtcatatttatacagctggggacctacagcgcaagcctctccaggggagcccttcaggtcttctgtagctaaatattcccaactctccctctccatgtggctcacgggtttgccatttcctcatcaggttggcttatgcccaagttagcacccttatatattctatatcatttgatccccaaactccattttttccactcagttatttctgtaggtgagctgctcgcagtgaaaaataggaaagggggggaatcttttttttttttttttttttttttttgagatggagtctcgcactgtcccccaggctggagtgcagtggtgccatctcagctcactgcaagctccacctcccaacttcacgcaattctcctgcttcagcctcccgagtagctgggactacaggcgcacgccaccacgcccagctaattttttgtatttttagtagagacggggtttcactatgttaaccagactagtctcgaactcctgacctcaagtgatctgcccacctcggcctcccacagtgctgggattacaggcatgagccactgtgcccggttaatcattttgttttaaataagtttcagttagaatatagagcttcttccccaaacagagtaaccttcaattctccattttcatgtaaaagcaggtggcatttcttgtacactgtggagatggtatgattattaaacagctaataattagaaagcattccagaaataaaatcagcatataaatacctagtatgatggggatgattaaactaccggctgtggtggacaaaaaataatattattcaattgtttacatgcatttagctgatctaacaaaacatacatttgtaagatcccagccagaaatatttccaggtaataaaatataaattatagtgttcctttatggattgcatactttcttccttctttacgtttcaaataaattaccttctatgtatcacttaaataacatcaggctttctgaggtgcttaagacaatcttaacagtactgagttaaaatatatctttaacatgctattttttctagtctttaggaaagcttcactcaagtgcattttcaaaggtctttgaagatgaaatattctgagggcctcgtgcattgctgctgaatttaatagtccttagcaatcacactgaaatccattccctttgccctcagcttcccttcctaattctatcacgtaactaccttcttcctcaaaagccttcttaccaccttagcaaaaaatgacaacttggatttcagtgaaaatgtatggatttaatttgcaagctctccagtcttggctttgctctctgtgagtcttgacggaggggagaagctacaccggaagccctaagaagcctggcccaggctcacctgatctccttctcttccagaagcctcccaggttccagcccactctcaccttccacagggggcctcttgcctcccggcttctgcccagttcagccaatggaagtcaggggtgcgagctctaagcggggggatgaagagttggggttgcaggtgggtctggccgctgccctctgcctcaggttcccacagacagccctgtcctgaagctacgagatggctgaaagacaacacaattccccagtccccggcagccgcgcatttaatttccactcacagttttgccttttccagaatatcaggaaagggaatcatgacggatatactccccggggatcagggaagaggactcagggtgtgaggggttgtctgggagagctgggaagattccatgtcttgattgtcgtagccgttacatgactatttacagtcgttgaatctgcatgctgaaaagggtgaattttattgcatgtaaattatgtttgcaaaaagccaactaaagagtgagaaataattatgtctgttttcactgcagtcaattcccccacgacaatagggggattttcggaagatgctttgatatcataactctgttgtgcattgtgcattttcataagtcattaatatttataggccagctaacttcatccctcttgattttgattattcaaggagatgctaaacaaaatgtgtttcaggagaaactcacgtgtccacagctttccgtaccattggccaatctctgggtggtcctcccttttcaattttctaccctatcacatcagaaataggtattggggttgggcgcggtggcttacgcccataatcccggcactttgggaggcctaggcgggtggatcacttgaggacaggagttcgagaccagcctggccaacatggtgaaaccctgtctctactaaatacgcaaaaattagccagtgaggtgatgtgagctgtaatcctagctactggggaggctgaggcaaaagaatcacttgaacccgggaggtggaggttgctgtgagccaagatcacaccactgcactccagcctgggcaacagagggagagtctgtctcaaaaaaaaaaaaaaaaaaagccaggcgtagtggctcatgcctgtaatcccagcactttgggaggccgaggtgggtggatcacctgaggtcaggagttcgacactagcatggccaacgtgaggaaaccccacctctactaaaaatataaaaattaaccaggcatggtgggcgcctgtagtctcagccactcgggaggctaaggtaggaaaatagcttgaacctgggaggcagatgttgcagtgagctgagatcacaccattgcactctagtctgggtaacaagagtaaaactccatctcaaaaaaacataaaaataaaaaaaaaaagatgtaagtattggaatgtatgtcctccttggtggctgggaagctttcaagaccagattcatattcatgaaggttttctcttaagtcagctgagtatttctttggcaatacgattcctcaaacatttaacagatttctgatttatttgttttccctgaattctaaggactagtatctacacccaaagtttggcttcaccttctccagtgtgcctgagttcatcacccctttgccttctctcagtccacagcaactggcccgagacaacttagaacagtaagaggggaggcagcactctcatcagagctgtggcctcagtcacgctactcagctgagtagcttcgttaggctttgctgtgggaagcgttgtgacaccccatctgtttctgtttgggttcaagaagctgacaggttttctaaacctcaaggtcctaaatttcttgatactcctatcttcctttcattttctttgcatatatctctttcctgtgctcgtctgtgtcttctattaatttacactgttttgtaatgaaaaatggtcctgttctctcatcttggagagaccccctttaaggaggaccacttatgaatcacctccaaaggctctaccgtagatagacgtactgcttgctccttccattcctattcccaatcccctttgaagtctcctctgacttccccagagattctcaggctgctatggaggcacagctgatgaaattattcatatagaattggtacacagacatattatatttgatgacagtcggttatcttccctccattgtaccagacagtgccccttagggacatgcacatggcatcttgcccatttttttcttttgttttgttttcttttctttatttttgagacatctcactctgttgctcaagctgaagtgcagaggcatgatttcagctcactgcaacctctgcctcctgggttcaagtgattcttcggcctcagcctcctgagtagcagggattacaagtgcacaccacaacgcccggcaaattttttgtatttttagtagaaacgaggttttgccatgttgtccaggctggtcttaaactcctgagctcaggcagtctgcccgcctcaacctcccaaagtgctgggattacaggcaggagccaccactcctggccttttgctcatttttctaccttctgtgtctaacttactgtcaggttcataggaggcacccagtaaatattggccaaataaaattgtcttcatttacaaaagaaaaataaaccttgataatatgtgtaaattgttaagcatgcttgcctggtaccataaaataatacaaaatagccctgcacagtcttttatggagatgtcttcatataaaggcagcatagagaagacagcacattgactgcatggtgacccatcggaaagtgcttttaataccactgggaaactgaactgccagggccatctccaaggaagaacaaagcttcagagagtgtgtgggattggagtagatggggaaatggatgtagggtatttcaagctaaaggaaaaacagataaaagtcagctttgggaatgggcctcataggttggggaataacaagacaacctgcccaaccaaagtgaacacacatttgggatagaatttaggttgcctgaactgctttggatttttctagatatagaaaactaggctatcttttttgtccttctgtgtaatctcccaaccctagttgtcattgtatccattgaagaatggtctctctgtgtccttgggatgcttatatttgctccttttggtctgcgacatttttaaagagttgcaatttcctgttgtttgcatacatattctgaaaaactgtatttatgttaatgattagatacaaaaggtttctgctaatatcccccacctgctaggaaattaatttgggttctacatttgtctagaaagggtctaagtattatcaccctgattaaaaattcacctaaaaacttctgtgtctctgtgttgcatatagaaacatcaatatggcttccatatgcacttgttattggaggaaaaaatagattaagaatcccaatacattaatgatagccatgaaatttagctctctgctgatctttgcttaaaaattatattcagcaaatatatatatatatgcacacacacatatatatgcatacatatactaacacaaaaataattttggcatatagatgggtgtaaaagtgaaaatgtaactcatttattcaaatgtgtaagctaaacgtatttggaaaaataaatagaacagtgaaaatcattaaaattaacctttatgacattttctgggaaatttatgactaccaagtgttgaagaccatgtttgaaaagaaaaaaaaattagaaggcataaataaaaaagttaagtcattaaatgataaaatattctaaagaaatttaagataaggtgacagaatacaagcatggtaactttcttaacttttagaagaaaatgtaacactgaagtttaagttatgccaagctataattttaacaattttcagaagaatatataacagtgtataaaaatatccatgtagcagaaagaaacacagacaacaaaatgaatttaaagtttatgtcatatgttgtacttgtgcttctgggtagacggagtagacatccttttctccattcctcccactaagtgcagctaaagccactgggcattacacgtaaaacaaatgtaagatgactctgaaagaaggagggaagaaggcagaccacctggggagcttgcgactggaggaagaaaccaggggtgaattccttgggttttctttttgccttatatctccagactaggtagttgagaggctgacacaaaaccctagtgtgtgcaaacaaacatgccccaagaaatgctcatctcttgccaaagaccaaggaatgggcaatctaagacagcggccactctagtccaacaaggaccacataggacaccagagtccacttctggtgccacaaggagaagtcgactggagagctttgccaggctgcaatgtggccccaaactcccaccaggatggcatcagaggaggccaagtgagagacttcccacttctacccacacagtcaggggctgcgctccccgtggtgtcaatgcagaccctgtagacagctggacttttacctgcaccctgtgtaacaaggtgccccctaccctccactgggggttgtccaaggagcctagtagagtcgggatggtcactgatgctcggagataacgaggcccctgccctagagtgtcagtggggactccacaaggagcggtgatgagcttctttgcttctggccatggtgttttgttgtgggtagtggagggtctgaatcccacatcaccccacagcagcaagaagcccttcctccagtgccttccaagaccaagtgcagaacctgaagtgtccctccccactggcagtgtcatgagaggcccacttcctctgcagtgcagtgtccgagagggcctgcaaaacaggacgcttaagtaatatcttgggtacccaggggtagggcagtggagggagacagtgtgactgtggcatagcaggagagagggcttgtggtggggacgcagttccatgtcttgactgtgttggctgttaatggaatctacacgtgggattaatgacccaaaatgatacacgcacacatgtagcattggcagaagctgagggaagggtgggcacctgggacccctttgtactatgactgcaattctctgtgaatctatcattgttttaccaagaaattctttttgaaaagtatatgccatgtgtcagagatggcataatatgattgttattatatcaataaatgtgattaggataaaacttttaattaggaaagaaagtatatctgattaaagagtatattcctgcgcaaaatatggaaataggtatgcaaacatgtttgtatgtgcgtggggaattttgggatggatacacaaactctggatagtggggctgataattgagaagaagctaggaatttgcattttatttctgcctttctatactacttgcaaattttactatgggaactaatcactttcataattgaaatgagctacctgaaggctgtaaagaaagaaatgatcttgaaaacataatattttaaaaatctgcttataaataatactaaaaccaaattgaattaaaccacagaagtctggatggggaaataatttgaatgcaaggtacatagaatatttgaatatatttgttccaaaattgacatttttttgggtttctttccaatcatgcccagtgtgtggtacagttacacagatacatcatggttgtgcatttgtcttgcatctgcgtagctagttaagcacaaaggcaggcccaggagccagtgtagaaacaatattttgcaatttgggaggcaagaaccttcaagcaaattattataaaacactcaaagtctttcctggggccatgttttggctttcgaggtctgtgtaattgcttgtcctcctcccttttattttgagacagagactcgttctgtcccttaggctggagtgcagtggtgcgatctcggggctcactgcaaactccacttcccgggttcaagcaattctcctgcctcagcctcctgagtagctgggattacaggtgcatgccaccatgcctggctaatttttgtatttttaatagagacagggtttcaccatgttggtcaggctggtctccaacttctgacttcatgatctgcccacgttggcctcccaaagtgctgggattacaggcatgagccaccacgcccggcctgtcctcctcttttttgtctctctccttccctgatatttggcactttaagatttctgtcctcattcattctactgtgccttcattccacaaatcaattgttgagcatttactgtgtgacgggcagccttctgggcattgagaatacagctgtgaggaaaggaatgccacttctggaacgcagcgtgcataccagctttgggtggacctctgatggccacttttcattttaccacgcctcagtctcctagacaacagtgtggtgtccaacagggagccggaactgggtggatcagattgttgtcagattgaccgattgtttcgggtactctttacctgcaaccttaggcatagacagcggccaccccttcttataactgcaaggagctcgtgcccctcatccactgtcaccaaatgctactctgtgattctatgtgccttgccatcaggcagccacgaggagggaagctgagatttcatcggagaagctaattggggcatggaattgtattttgaaacttgtgctccattttattatgtgtttataggagactgaaacagaacaaggaaaaacaaatttgggctcaacaataatgtacttgtctcctggttacagctttaatcatgtattaaactgtataaatctttttcaattatattaatttaactcactatcaatggcagtggattgatggcagaacattttcagttttcattgttagccaaaaagccctcagcgaagtaaataacttaggaagaaatatgtaactcttctctgagatgagcttggaagggtttcaaagctttggtcattggattttcattatttaccatagcaaaacctgctgaaagagcacctaatgctaaataattccttcttatactctttgtgcacatttaaaaaaatgaaacagtgattggcatggcctaacacaggtctttgattaatggtcttaagaattttgcaagctttctcaactttccaagagcaatttgacctatgaagacagcctttggtagacccacaaaggggtccacagagatgaagaataagaagtgtctgattgagcatggacaggagctctcttttctctccctgttaatttcgaattggccactgtttaatcattcttgtgctcgtgcttggtaacagtggctgtggggctggggagtgtgctgtgttacacatggtccatcatgagtagaattttatctcataccgaatttaatattcttatgacttaagaaacagaatcgcaccagggataacaatagcttaagatatatttcacacattttgtctgaagagcttaggcaagagagaaaatacgtcattctattaaatactgactgcttcacttccaatgaaataacggattgattagcatttcctaagcaagctgttctgcatttatttgattcacttagcgtccatacatataactgatttaaacttaacattcttcctacacttttacagatcacatcagggaaaaaggaagattttcatggaataaattaacttacactaaaaacaatttgagcacagaaacattagcagaatgaatatttatgaatttgcaattaattttaccgattttattgtgtattacttactatgtaatatgtgactaatttaatgtactcatttatgtaatagatgtctacagaggaccaacaaggggcccagcactgtgtaagtgccaaaattacaacaataacagtggcaaacaaactccctattttcatagcgttaatattctagaggaggagctaacatttccaaaggcagctccacgttttctatgacctataaagaagaggtgagatgatgttgcctgcatgtggctgagtgaaaggcagccagcaaagacctctcagaggaaggaaattgacacctgacctgaagcccaagtgcatgaagaaactaagctacgaagagggacagagaggaggtcagtgaggctacagcagggggtggcaaacgttttctataaagggacacatagttgacgattttggatttatggcccagacagtctgtgtcacaatgacccccttttatttggcaagtaaaaagcagccacagtaatatgtaagctattatgccaataaaatttatagatggacaccgacatttacatttcatataattttttgtgtcacaaaataatgtttttttaattttgttatacccactgaaaagcataaataccattcttaggtcacaggctgtataacgcaggcagtgggctgggtttggcccatgaggcgattgtttgcagacctcgggccaaagaccagagagggaagaagatgagggggctgaggtgggctctaggtcactgtagaccttagagaaactagcattttgttctaagagaattgcaagccatggagggaatttaagcagaggagaagcggtctgatttatgatttcataaagttccctctggttgctgtcatgagcgcctcataataggcaagtgtggaagcaggaatgctgtttaggaggctattctaagaggctacaggtgacaggtgcagggtggtgggggtttcaacccaggtgagagaagcaagtgggtatgtgagtgtatgaacataccatattatatctgttcttcctctgcagcctccagcctggctctttaaataatcaaaacttatggttgtagcaataaaaactagcctactttagatttcagcttaattatattaccaaccacatacatgtttaatctcttcttctcgatttaaacgaaagcaaggacaaatcctctgttctctgctggtaaaagggatatgtcaaaatctccagccacgagggggctcctgtcatcatgcctcatgtgttcataactacaatttatgacgcctccttctgtacactgatttcagttgaatgcttctagagaatactgttgaactgagtctgatgatacagatgtttgcattttatgaaaaaacaacattctaatgcagttcatggatatcctccacttttcacaagttgcttttgtaggctagtggtgtgttcttccccaggcagtttgcctgatgccaaggacttagatacatcatttgccatcagtggaagtctgaataggatggagggatatataaataagtcaagaatgcgtgacccagagtgacatattatactggaatgatggtataccatgagaatatgtggcataaggtagttagaggttttgatgtcctatgtttagcagtgatttttttctgtaagcacacggttgttattccaaagataatatgtactttcaagcataagtgactttatttcaatctatagtctctttgagtaatttttattcttccatttccaagactcatgtcgtgttggggcaatagagatagtgtactgtagaactgttagaatcccaaatgcctccccttgcactcatggaagctcagatgtggggtggtattagaaggatatacttgcttatttctcaatgtgacacagctaaggtgcatatcattttcctttgccgtgtatggaaaacttagcactcatcttcaacatttgtttagagatttgggctacatggtatctctggttgaggcctggcagttttcatggcaatgcgaaaatgttgattgaatgacttcctaaagtattcatctcttgcctgtgcttcagtggaactgcatgcacgctgcaaaggggattttccagagttgtggatgcaactaatctcctaaatagatctccatctctagtcctccatcacccaactccactcatgtcatacgcaatctaaaacgtaatcctctttttgtataggcataagcatgatttacaaactctcaagatttaaactgaaatggaaacaataaaaagggagaagccagccgggcatggtggcccacacctgtaatcccagcactttgggaggctgaggcgggcggatcacttgaggtcaggagttcgagaccagcctggccaacatggcaaaaccccgtctctactaaaaacacaaaaattagccagcgtggtggcgtgcctgtaattccagctactcaggagcctgaggcaggtgaactgcttgaacccaggaggtggaggttgcagtgagctgaaattggagtgtcactgcactccagcctgggcaacagagcaagactctgtctcaaaaaaaaaaaaggtgggggtgtgtggggagaagtcaaattcacctatctggctttggaatctctctacactacatagttggcatgcactcatgtcttgctgtacaacatggtcctaagtaactctatcataggactgaaaaaccttggctcacgcatttcctaccagtgggaccaaggacaatgcattctgctttcatctctgcagcctttaagacacagctaaccctccagcataaggatttccatgcctcacattgtcttaaaatatctgttgtactttttgccttgtactttaaactcccaacttcttggttaatagtgtgagtatgggccaggtgcggtggctcatgcctgtaatctcagcattttgggaggccgagatgggtggatcaccttaagtcaggaattcaagaccagtgtggacaacatggcaaaacccggtttctactaaaaacacaaaacttagccgggtgtggcagtgggcgcctgtagtcccagctactctggaggctgaggcaggagaatggcttgaacccaggaggcagaggttgcagtgagctgagattgcaccactgaactccagcctgggtgactccatctaaaaaaaaaaaaaagtaagtacatcccatctcctcctaggaaagattaaaatatatttaggaatataatggtaaattaatttctttctatgctaatactgtcagccatggtgtagatctggagcaatgtgcttaaccctctgggcctcagttttctaagtcaaaatttcctgagtctcagttcatttatatgtaaaatgaggataagaacctccactttacttgcttcttctaaaggttaaattgtacaataaaatgaagagcccagcagcatgtcacgcatcagggattagcatagttgcatatcaccttttggtttacatagaatttcacaaatattatctcatttgattcttgaaacaatgagatggccagaacatgttgttttgcatcattttatagttgagtaaactgaagtcaggagggcctattagcaagctgcatttgctggaactgcctattcaataattatttaataaataaacaatttagggcaaggagaatgtgtcttttcatatagagaaacaacgtggcaaatgttaatccagttaagtaggtacatcttaatgctaaatgattattcgggtaaatatagctggagcatttgtattttcactcggcaataactattagcaagtactctgtacaatatctcagcaactcaatacagtgcaaggctcctcttgaggaatggtagtattaagagagaagtaagcaaaattgacaaggaagaacttgtttatcttggctaaagtaacatgtaggtgccccctcattcttgttatatatgcagataacagattataaataggtgtgatgttagtgaatccagaggggaactaatggaagaaaactgaatttatttctgtctaacatattgtttcttgtcagtttccttcctttgtaatataatttttaacaaaatgcctgacaagtaatttagtgacagatgtgattaatgctgacgtggcttttaagtagcagtgaacagttagaggaagcattgttgtaaaaataaaggctgtcttcctggtgtctttcaaatacctagaaaactaaaagactaagtttgccctctactggaattcagaattataccactggcggttttatgactgtgtggaaaaaaaaaaaaggatctgtgtatttttcgtttccaggttacaaattcaagcctccttttaccaccttggttaatccgctttagtattagttctatacatacataagattctgtgaaccaaatgctctcaagatagaatttccattcccatggaagccggctgtgagggcaggtgatcaggtgctctacacaaggattacagcaggaattttggctctcctactcattttgcaaaatatgaataatcacctaacacacagtctggggttttagtagtttttgattggtgttaggaacttaaaataaccccaagaataaaattgtgccagaacctagaacatcatccaacgattggttttgaggacagacctaagagcagccaaaagggaaagggggtgttacggaggcagaaagctgcttactggccttttctaaaaactgcacttccagttcactggctctgagcatgcctggtacaacagtccagggggtggaattattacggcagctgccctgggaccagtgccagtagaggtctggagactctagggaagataaaggtcaaaaagatggatcacaagacccgtcagcaggaagtaaagctggtttaggcaaagcaaagtgcagccctaatttgtcctctccttctggctaaacatcatttagtcttcctcttccttatctgatctccaaacaccaccagccaatgcctatattttgttgtaacatgaacatttatacgtgcacactcagtggtgcacagatttcagaaactggaaaataggacgtttgccacgctggaggccaatgcaaatcaacaaatcaaacccttgtgtgcctctttctggctcagatctttttcacaatttatcgcgtttggccaaaggttcagagagaaaatagatgcaatattatctatcaaagctagagtgagcatttgtacgtggggtgggggtacagggggaagaagagtgcatcccagaccctattttactctgatatttagactttagtatctaatatagcagtttgctctgattttaaaatagccagggaaaagtgggttcaaaagttacctatgcctccataaaggacattatataatttatctttgctggtcctctggaatagtagaaactggctcctattatctagatcaaggtgttttattgtaaaaagagaataatgacatttgttttctcagtttgtagaaacatagtcagtggattaaattttatacatgtttgagctttctctcaatatttttcataaaacgtaggtagcctgccagtacttatccctaccagaatgaagcttcttacagtctctgataaggcatgatgcatgttttgatgtaaatattttaagtttattgtagcatttcatgcccatgatatattaaaccaggtcatgaattccagggctctgccccatgaacaatattagactcactctgacttccagttaaaattactccccaggttcagataaattgtgaaaataaaagatacttggattaccctctatcttgtggctcataagagagtggctgctgcggaggctggtccagcagcatccttggtcagtcagggccatcggtgtgcctacatcccaggcggagggatgcaacgtgctcattgtaatcatcatgccacaccgccaagaaaatatttgacactgagatcagaagacagggattcatagagtttctttttagatcataatcacttctaaaccatggggggttaaataggattctccttcaaggaaagtgaaaacttttgaggtgttttctttctcaaagtatacaatttgtccattacaatgggatggtgcacaattttatatctactaaaaatgtgtttttttttgtttttaatccaggatattcacagcaatagctgccaatgtttggccctcaacaatgggtcacaagtattatgataactaactaatctagcatcgctacaattctgcaaggcagatgttcttgcctcaagctttagttaaagaaatagaagcccagacagcttaaataccttaaccaaattcacttagctaatcaatatgagacactggattcagactcaggtttttccaatactcacactcatctttgtgccatgctacctttccaggaaacctgttaattaaaaatcccttttctactcagaatatatacttttcaatgctaatacagaccgattttcctactgtcttattgaatgtatagagggtcactggtaacatcaaataacaatgcccttttccagatctttgtagttttttctttgtttttatttttgttttgagacggattcactctgctgcccaggctggagtgcagtggcaagatctgcaacctccacttcccaggttcaagcaattctcccctcctgagtagctgggactacaggcacctgccaccatgcctggttaatttttttttttttttttttttttttagtagagatggggtttgcccaggctggtcttgaactcctgacctcaggtgatccacctgccttggcctcccaaagtgccgggattacaggtgtgagccaccatacctctttgtagttcttataaaagtccactacctgtgtctcaggcaggtattattgaagctagttttgggaagagagctacttcagaaaagaaaggcaagtacaatcatgaacaggtgtcataatagggccagtataaaatttctcaagatggtaggaaaaaaatgtgtctacacgttaaaccacaaacttcatactgggcatccaagaagtggaccagaaccaggaatcccatgcataagggttccactggattccacactccaagcagcagttgactgttgagtcaaggttgcaagggaccagagtccacagccacaaacccagtggaagggtggggaattctgccaaagagagacaatttctctctcctccatgctaggctgtcctctgtgtttcagtggagatttcagtgaagaattcagtggaatttcttcaccctgatgttgaaattagcaggaagttacccctggataataactctgcccctgattgactcaggtagaaagaagtgagaattgtgttaccatgtaactattgttgaaacagcaaggtgaagacaaagggaaacatgaaaataagagaaagagaatgggatactgagtaacaaaggatgtctgtgagaatcattgagaggttccactgattaaaataacagaaaccaagttaagagtgaaatagcgtatagtaagtattttatgtcacctcattccatcttaatgccttggtgtaagaaatgagaaacgttttctgaaactgtaacaagcaaacagttaatggctaggtcaaagtactggaaatcacatttggcctgcagctgatttttccagcagatgacatttgctttagcttaaactaaaataaaggaacattattgctctgattgttccagcttataagtgaaattctttcccacttaaaattgaaaaattaggagcattcctggcacgtgaatgatattcagtacccaacaccagtggttctcaaatgtgccatttgagtcagtttctaaacgttgttgaaactgattgctggacccacctccaaagttcctgattcagtagatctagggtagagcctgagagtttgcacttctaagaagtttccagatgctgctgctgctgctgctcagaggaccacactggcaaccactgctctacactaatgtgaaccgtggcatgtgtctcgctatctgatgttactcttctgttttcccccattggaaacaacaaactatgaggaaaaaatatctgaattcttacactggtatcattgactggaaaaaacaaatagtcattaatttgacaattgtcatcttttaatttggtgggttaaaatctgacaggatgtgacgccaaggcatttcatccttagtggtcccttcgaggtttcacacattatttctttgctgagaccttgagagcacaattacttgccagaggttttgcaatgcaatggtgaggaatgcagaatgttgggttcagctgatggaccctgaacgctaaccagaaggcacacgtgtgcacacttaggcttagagtcctcttccaggctgactagtccaacctcagacagccacaacagtagggagaagtcccactgggcaggctcctttctgaagtcacagctgcatggacagatttctctcctacacctgaccctctggggtagaaaaacacacgttttcacagtagacatcaatagactctttcaagttaatttcatggaggaacctaaatcatcgcgtgctcatggatccagtggttctcaacctgtcctttgcatcacagtcacttggaggactcactggaaaacagcttgctgggaaccgcccccctgtttctgattcagaaaatctaggtctgattctaggatccaaaaatgtgtttctgattcccaagtgaggttgttgctactggtcttgaggtccacatttggagaactgtgggtctttatccaaaatacatagaagaattctacattgacaaagtgaagatgcttgttcccaaatgctggagatgtgtgattttggctttgtccaacaatgaaagctctacatagccactgtgtcctggagtccttatgagagatagacagttttattggttgtagaaatttgcaactttgtacaaggggcaacatttacacaagatgcacatttttatgaagatctcttctaaaattttgaataatattccatttcagtgtgcttcactaaacttgttgcaaacgtgatttcagtaatttccctactttcaattactaattgcattaaaatatcagagaaaaaaaacatactgtgcagcaactctcagtccaggaaagaatggatatgtagaaaggattttttatataattttaggtttataatagaaactatagaactgaattaaaatgtaatttctagtaaaaattcttactcttttctaaacgcaactcacacatattaccctgtaatttgattttggtacttgtatgaattctggtgttaaataggaattttctgagagcagaataaagaattaaaaaaaaaactgctctggatgctttaaccagtgcctcaaatgtaataattaatacttattcactaaatcaaagttttagctctacttcttcatgtagaaaagtgacttggaaataaacagtcagaactccaaatgtaagactttgagatgtaaagagactatctgaagctgaaatcacctgtcgggaaaccatctggatagagttctgcacttaggggattactgtaagaacttgaatatctacacccaaataattcatggaaaaagacagcggacatttctacctaggactcagtaactgttcatcaaaaggatcagggcatgggtaatatttgcctctagcaataatagacgtttccttccaccccggtccttacttaatataaaaagaagttcaaatgagggtttctcgtctgagctgagcctgagaaacaaagtgaaaggcaagcctgaggagcagtcaactctgtgtccagttcatttgtgaaatgagccccaatgaaataaccaattaaaagctccttcctgtgaagaaaaaccagcaaggtctggaaatagcagaagagccccaaccccagcacctgtcagcggcctgcggtttgagtctcaggcaagagtcacagtcattgcgtcaccaataccactcgtttcaccttaatggatattatgtgatgatggggattacttcaacatggtgcagaatattttggagaaatgaattcccaggcttcaaacacttaatatctcattgcttatacacaaagatgcattgtcgttttgaaagtcagaatatcagttatcactaaattatgtaagtaacctccaggaaatttcacaaggaaagtctcacctcacatgtgacaaatgatctggataattggagtgcccttcttcaagatccaagatttcgtcttgttgactgccctacctgctttttcatccccttccagatgccaagttcaggccgctcgaactcatttttcttgtgctgaatgaggcttgaattaaattctctaaacacaaattaaagggtatctcggcattaccaggaagatttgtgtcttgtgaaataatgggatggtttgagtcaaacgagtttgcaagaactactcaaaccaaattggttttgcccatattttaaaatcttttcacatttcacttatatttccacacaaatgcataaatcttaaagcaactagagtcagctggaaaaaagaagtgttctaagcatttaccgtgaagaacagatcgttaagaaagtaggctgaggaaaattgggaagaatgctgaaatgagtagcaataactgatgagctatgctgatctaacacactccaagaaaaagaagactagcagtcagttgacatggtgttgtttctttctatgcgttatattcgttttgcttaagaaatttcctaatacaaaataactgtgtcattcttcgtttctaactaaattcttctatatgattctctaatttaatgtgtgcccaggtttctcttgacgtttcattgatgatccagtggcaaagaagaagaaacgatactaagatggaaggagttattgtgaaaatgtacatagataaaagcaggaacttattgcataaacatgtcgttcctataaataaaaatcaaacatatatatgtaagtcttctgatcagtactgcaaatttgccctccagaaaggttatgcaagtgtgcagtccaagaagcattatttagaaatgctactaaacaggttggcattgctttgagaaataactcattattcgtttaaatagcatttttaatttagtttcattatatattgtttagttgtatttcttctttgtaatttaccattctttatttgcaaatcattttgactacaataatcaataattaatatatcaactgttataattcaatattcctgtagttaatattctcatttgccttataggtttttctttttttgtgtgagatacagggttttttttatttttctattttgcattcaatcttttcctttatggcttctgcctgtttaatcatgtttaaaactgcctgtctactgtaaaattatataaatgtttatcttaattacctcataatcattttatgacttcagtttttacatttaaatcttcaaaccatctgggttttactttaccgtggtaagaaggatgagatagagcttaatttttttccaaatgattagtaaattatcacaaaaccttttgaagtaatgatttcttcactgattgattggaaattcacttatataatacattattatttatagatgaagttattcagagacaaatttaagctcagaaatagatctaagtattggaagtaattttagaacacaggaggtgttctgataatattcaaatctcctctaaaaatttttcattgatatcacttgtttgagtatctccaagattttgatagaaagtattttttattggaagaaaatcgatgcccccactcacccacctgcgcatgtgtgcatgtgtgtgtgcacgcacatacacacatacacacaagcatgcacacacacacatgcatacacacatgagtgcatacacgagtgcatacacacgtgcgcacacacacgagtgcatacacacacgagtgcatacacatgcgcatacacacttgcatacagacacgtgcatgcacatatgtgcatacacacacgagtgcatacacacgcgtgcatacacacacgtgcacacacacaaatgcatacacgcacatacacacgcacatacatgtgcatacagacacacacgcatgcgcgcgcgcacacacacacacacacacttcttacttctctataccaaaagctaacaaagagtttctgtaaatgtttcaggctttgtggtcccagcctctctcacaactactgaactctgaggttgctattgtgggatctcgccagcaccccacaatgcaacggggctctctctttgttcccaggtggatcggcaggtcgagaaataatagacacacaagatagtgaaaactgggtccggggggtcaccacctcctggacctgagatgccaccaatgcactggatataccagcatttattattaagtttagtgagggtgggggtaggttagtgagggatttagggtcatttgattatgaggtgagatggtcacatggggatgaagtaattctttaacataacatctgtattcagaagtacagtatgcagagataagaacttacaatatagtgtgtgcattagcaatttctaacagagccttaaaacagaaacacagtctttccataacctatgattagcaagacattaatcagcaggaacagttgcagcaaaagctggttacaaacaatccatagaaacaggacgtgaagctagacaaccggtcagaccagaaattctcggaagggagtatgccttaaccctaaagaggcctagaagagctgcggcaagatgagggcgtttatagccctatcttatccatatggacaggtgccccccatgcatccgtttataggctctccacaagggtcgcattccattcccagagctatgaacatctgcttttctgggataggaatcttggtgatgtgaaacctccctgactgcacgtctgttcataggctctcttcagggggaagcacatcacccgctgttggctcattctggcagtccaacctggcattgtctttacacaatcctgcatgcaattttgtatttacaataatcaggagcatttcatcttttattctgtagcagtagtttcaggtctccctacaactccccctttactctgatttaaatgaaccatagcaatcatggcttggcgctgatcctgattggattgaagaatatttttttccaattttacacatgaacaataaaccaatagcacaaattatacacagaacaaaattaacaatagtggatcctcccaaagattttacccattgaatggggttgagattagataacccctcagagatacaaaactctgggtgacacccaatgaaccattctgttctaatcaaccttgatttttgtacattacaattagaaccattgatgattttaacatgtcaggaaaagccttttctttttctgatatttttttcaacaatttaaagatgtaaaaagcattcttagttcatgggtcatacaaaacaaatggtgggccagattcatccggtgggacatcgtttgcacttcaaatattggaagactcttatgatagactttctataatctgtagttggaaattaatgcactttttaaatataatgttttgaattggaatgggcacaaattatttgatgtgacttactatcaagttatataaacaactgaactctaaataaaaatataggctcttgagtgtggtagaagtaaacaaaaaatgtttgagtatttgtcacccatgtaaataaatttatgcatccttcaatgttgctgtgaaatatttggccatccaggcaccaggagcaatacaaggaggtatttagctttcatttttgaattaaaaagtaggacattcaccagaggaaacataatttagaaggaaaactttaagaagaattggctttaacagatggattctgttttgggaatgatcatcaatgtaatagacaatgtattgtgaatgattttattttacaactttttattaaaatgtactatattggaaatcttatattaagaatgcttataggtcaacctcgcttttactttagctataacctaatgtttaataattatagtagttttttcattaatatttcggtcaacatattttaagctagattattaggtttaaaggactgaattcatgttaccatatattgaagccctcgtttcataaataaagcttattgtcttaataactcttttgtctgacattaatatactgctataataactcttttgtctgacattaatatactgctaaacttttgatcagtttatcctattatttttattccatatcttcaatttttctcttatattttagatatgcctctcttaaacagcataaatctagattttttttacatttcatctaaaaatttcaatcttttaagtttatatttaaccatgactgtaattactgatacactggaattcttctatttttgtgcttttcatttatctgtcatactaggctaagtgtttcttcttttgctttactttataaaccaaatcattttcttttctccactagtataaggtgaaatattctatttctgttctcttgtggttacggtaggcattttgatatacatatttaatgtaataagttaaaatataatcaatttctttttcaaattaaccatgactttagactattttaactctaatcatattcatccctctctttgccctaaatatatttctgtaatgcccaggtttgaatgcaccttgatttaattatactttcattattttggattatttaattattttgattaaataatttcatctaatgatttactgttttctgtctctctgataaatacataaaagtagaaaccttgctcataagttagtgtatgtttaactttatgacataatacctaacatctttccaaattagttttatttgtacttttccccactagcacagcaatgtaggagagtgtcaggtgccccacatcttcgtcaacatttggtgttgtccattttaattttagccattctaatgagttttaattattttctctgataacttataatgtcaagcagcttctttttctcctgtactactggcttttcaaattaattattcccagaagtgtctgttcaagttctttaccatttccttattggttgatttatcttttggctattgatttgtagaaattatttatgtattctggatacaagtcctttgtcagatatatgcaatgtgttctcccagtctgctctttattcttctttctcttaatggtgtttttgatggacaaaggttttttacattgatgaattcaacttattaatttttttttgtatttccttctttatgtgtcctttctgggaaatgtatttaaacttattttatggcccggcacacattctaccttggtgaaatttcatgtatgtcatttttttttctgcctcatccaatctctattcttcttctgcaattccaattatatgtgtgttttacacttgacactgttctagagctcaaggtggcttggttctttttttttttttttttttttttgagacagagtctcgctctgttacccaggctggagtgcagtggcgcaatctccacttactgcaagctccgcctcctgggttcacgccattctcctgcctcagcctcccaagtagctgggactacaggcacctgccaccacgcctggctaatttctttgtatttttttttagtagagatggggtttcaccctgttagccaggatggctaccctcgtgatccgcccgcctcggcctcccaaagtgctggagttacaggcatgagccaccgtgcctggctggttcttttttaaaaatattttttcctctctatttttcagatttgacaatttgacttgttgctttatcttcaagtctatagactattgatttagccatctccaactgatgttaagaatatctgtgattttttaaaaaattcagatagtttctaatgttagaatttccattagtttgtttttatttttatttttttaagtgaaagcaggtttattaagaaagcaaaggaatgaaagaatggctactccataggcagagcagcctagtttatttttatactgtatatttccctgctgggattatccctctcttcactcacttatggctattttcccttttacatctttgaccatatttataatagtggtgtttgattctttgtctgctaattccaacatgttgatgatctcagtattggtttctattgatgtttgttctcttgactatgcataatattttacatttctttgcatatatagcatttttgtattgtatgctatactttggggatgatgcattctgaaaagagagtggattttgttatcttttgcagattattcatttttgttttagttaacagttacattcagggctgatcaccctgaatttatggagatttggttttgtactttattggggcaggctgtaagtatggaccttatagaattttagcagacactccaaagtgtctactaagcccctttaatttgaatggagttaaaatctaaattgtcttcctctgatgggcagcaattgaaatctatgtccagtttttttcatccatctatcgccttctatagggctgtttggtgttttttgcatgcgtctgcagttcagtttaactaaatatttatggggactttatatgcagacttttgtcccctcccatttctgggatttcccatctcaattcacagccacgttggcaatgtcacactctcttctctgttacctaaagccaacaggcctgtggttttctactttctcagtagctgcctgcctcacgtgtactgggaaccttgccaggcccaacccgcagacactggtcaagcgacggatgaaaaaatgtacgcagacacaggttttttgcctggtcgggcggataggggaccgggccactcagacatcaaggatgccataaagagtcacagcggctgaggccctgacaagctagcgctgagggcatttatttagtacagatttaataacaaaggctttgagtcaacacacttgtgggtaattaacatggtcgcccccccaccaatcccccaacccctacccccaccccagtcctcaccccgctccccgagagagcagtcctgcacgtggatgattaaaggccaggttctaaggcctaagtaaactaacttatctggatcaattcccttacacttccttgttatctgctcttagagaattcagctgccttttgccataattttcttctgaagttctgcaaacccctggccttctgagaaggtctgcattctctatctataatttttcccaccaccctgaccaatctcctacagaacactattgggaatctgtataaatatgggtctaacttagtgcatttctgtcttttcaagggttcagcttaactatacttttagcaattctctacaactgtcaaatggttttctttttaaaaaatttcccagagattataagtttagtttgatgtaggctactttatcattatgaaacccagaacgattcaaatcattattatagttcacaaaatctctcttaagctgtgttttatgtgttgttatatcaatcctttaaggtttaatttttgcttttgctttttatctttttatttctatgcattctactgggttactactaatttggctcaggagttttgatagtctcttgttctattgtcatactttccattatttcttttttctttaaatacattaaacagccattttattcaataatcccattgttttccatatcttaggtctaatacataaaagggttttttaactttaatttatgatggtttatgtctttatgtttatttgagatatttttattgtaagttccctacccctagggaaattaatctgtaggaattcattgagcatagaccttaaagtgcttgcctacagagaaaaacttattttcttctactgaaatatgggggacgtatccaaaattggattgccttgcattaatgtttgacttgatgttttataggccacacagttagtacaaatggagaccctaaacccagaggtggttagaaataattaccagagacatatatgttttctttttttttttttgaatactctgtagcttattgagactgaagcagacaattatacccacaactccctctgcagaggtgctttcctggttcacctgctgaagatgtcgtccttgctgggttctaacttgggcccttatcttccagccagccccccttattgcttggaaccaggatttgtctcatttcctgatgctccataaaaccctaggtaattctcccatattaactcccattaagccacctatttaagaaagaagaaccggttaatattttatccatcttttttttgaaatgccataaaaactaagttattccaaaagtctatttagcaatttttctggaaatggaagttttcctactggcttttgttccatgtgtttcaaggctgggtttttaagtacatacaaattttgacttttgaaaatgttctttgagaattcttacatcaccaacatgcagtattcttccttgtgcattacattgctatttacttgtattccactttgtttcatatacattttggcaaacctatcttctttttgttaacattttcttagtattttctttacaaacattttcattcctcctgtatcattttaagtgtcttttattgagttaaaaaatcaattaatttgtattctgtgcacaagaatccctctattatttaatagataaatttggacccattcataattattgagaatattaatattttgcatcatattcttgttccattattttgtgcctccttctcatgctttccagttactcatttttcacttttatattattacctgttgccgtataataatattgccaaacttattgccttacaacaacacacattagttttctcagtttctgtggtcgggagtccagacacagcttaggtggctttgctgcttcagggcctcacaaggctgcaatcaagatgccagccaggactgtggccttatcttaggcctggctggggagagatctgcttccacactcctatggctaatggtggcattcacttcctggtggtttgttgggctgaggggctccatctcttattggctggggggtcaccttctttcccatgtgggctctctgtatgacattacacaacatggtagcttgcttctgcagagccagcaagggagcgagtctactgccaagactaatgctacaacttcatgtaatgcaagcatacatacatctgtaacatcttccatattctattggttagaaggaaaccataggtcctattcattctcaaggagaaggtatattagtctgttctcatgctgctaataaagacataccctagattgtgtaatttataaaggaaagaggtttcattgactcacagttccacatggctggggagtcctcacaatcatggcagaaggtgaatgaggagcaaagttgtgtcttacatggtggcaggcaagagcttctgtaggggaactcccagttataataaaaccatcagatttagtgagacttattcactatcacaagaagagtatgggggaaactgcctccatgatttggttatttccacctggcccagcccttgacacatggggcttattagaattcaaggtgagatttgggtggagacacagccaaagcatatcagaagacatcacacaagtgcatatgtcccaggaggtaagaatcctggggctaccttcaagtccatctaccacatttcttatatcctttttaggacagatatcatttttttcctgtcacattctttaatggtttgaaggttatttacttgttaacatttctatttacacctatattttcccgacaatgtctagtgctgatcagattatatattcttcccttgaataaaccatataaccttagcaagcgtggagtttctttctcacctactcccactttcgccatttgccctttgactatttggtatttggaattctaagctgagaatttaaaaaatgtaaacataaacaatcagcaattatttgccttaaaactacattttactaaattacttgctgacttttcattaaacccactcattttctcttgggtttactttgtacatttcaaaatattgctgtcctcctctcattcctggatggtaccctgattaagtatagaattcttgattcaaggttattttttctttttgaatttttgaaatattactcccttcaccttttgtctgaaacattatgtctaacctactccatatgccaatctgatttttgttcctttgtacttaatcggatatttttcacttttgtaactttcaagcattttctttttatctttggctttctgaaatttgacaatttgatattttaagtttttgttttatattacttatatcttggtgtcctgtccatttataaagaataatttcaatataagtagatttattctccaagatctagagaagtttctttggttattctttgaatattctcctccatctttatttgctttttctagacattctttcatatagtactaatatcacaaatcccagatctatcttctatgtttttcatgctttctgaactttttcattgtttgactaagttcttgaggaattccaaagggtaatttcattgctctgtaatttacattttacgtatatcaaatggtatttggctgatacactaaggttttctctcaataaaatttttactctgcatgatttctatttgattttttacatctattattctccctcccatctctctgtgatgctacttatccttacactctgctttgttctttgattgtgtgttattcagcctttggagtttgttatttcatggtggcttctccctttcagtgctagatgaatcttggtaatgcattcagcagcattttctgttaggctcgatgtcagcacagcctggctgggaggagcagtgagatgtgctggagtggttcattctctcttccggcaatcatgctgtactagactgttgcgttgctctaaagaaacacctgagactgggtaatttataaagaaaagaggtttaattgtccccgagttctataggatgtgtggtgctggcatctgcttggcttctggggaggcctcagggaacttagtcatgatggaaggcaaagggggagcaggcatctcatatggccggagcaggagcaagagagtgggagctgccatacacttttaaaccaccagatctcatgagaactgactcactatcacgaggacagtaccaagggggaatggtgttaaaccattcatgagaaactaccctcatgattcaatcaactcccaccaggccccacctccaacactggggatcacaattcaacaggagattttggcagggacacagttccaaaccatatcagatgcacacgaaggacatacagtacacattgtgagccatgacaaacacaggtttatgtctgtgcttatttatgaaaaaaatagtttacttaccaaacacttatttatcctcttgtgaaagttagtattaatcctcttgtgaaatgaactctggtattttctattctgctcaatcgcattgcacttttttcacacacgagttaagtacttttttgattttcacacaccaaaatgcatctcgactgtggttgataaatactattttaggccattttcagtaaaattaaggaagagaacggacaagctatgaagtgaggagtatcaagagctaattttcaacatgtgggcacccctctatctcctggtcaaccccagccatttgtacacaatgccccatctctctgcataacacccaggctaattttacttaaaagagatacagctctgttgtttcagcctaggcacaaaaggaaaagaggaatcacagaggaatcaaatgcatggctataatgtcctcactaacatctttcaatttacccttgacccctcttctctgtctgtctcatcaggaagtgaagcatttcaggcttgctcccatgtctatagctgttctgcctgtgcacgtttgatatcattgcatcttcaacctgatctcgttcacttctgtttcagaagctactagtaatgtctgttctaccaagaattctcccttggattttacagtgttaaactgtatttatttatgtctgttatgtcatttctggggcttgaggcaggatgggtagctataatgtgtttggtttactcccttgaactagaaacctgggctatctttgccaagaaacattgttgtcaaccagaatttttgctgatttaaggagtatgctagtcttttatgatataactaatggaagcttctattaaggaaatacctctgtgacttgtactaggcctggatggaaggccatcccatcagagcttggaagtacgccgtgagacagtgctgatagacagagtgaaagtgctgctcaggaaaggaactcctggatctatgggtctcagtggacatggcagaatcatgcaattcaaattcaacttaacaagaaaacattgtttgctaactttaaaaaaatagttattcttttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtacaagtaccatgctgttttggttactgtagccttgtagtatagtttgaagtcaggtagtgtgatgcctccagctttgttcttttggcttaggattgacttggtgatcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcatccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaacatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtgggttggggggaggggggagggatagcattgggagatatacctaatgctagatgacaagttagtgggtgcagcgcaccagcatggcacatgtatacatatgtaactaacctgcacaatgtgcacatgtaccctaaaacttaaagtataataaaaaaaaagaaataataaaaataatacctataaaaaaaatattctttttcaatattattttgtttattaagttccttgcttttccatatggattttaggatccactcattaacttatacaaacaagggagcggggattctttcctgttcttatttatttgtgtgtctccattttctcccttgaaaattggacatttaaaataatccactgcgtgaactttggaaatcagatttccccctactttttactgtttgctgctgttgttgttctttgtttagaaacttcatgcattaattttggaaattctctattctttttcacatgtggtcatgaaggctttggttagcttagtgatcagctgatgattagacagagatttctagtcttattgatctggaaccaatagggctcccaaatctaccagtgtacttctgtgtgtgtttgggcacacctcaacactcagccagacattggacaactctgccttagctctcccttcctgcttaggaagtgcctcaaggtcagacagaggtgagagcttagagtcttcagtcattctttaccatacctacatctctgcatatgtacttggccttctagattcaaaaaaaaatatgatgtaacttttcaacattcctgtggaaactgcatttcccagtcttaccttttaagctttttggttagtctagggtttctcccaactattatgtagtgccataggtgactcagaagttaaacaattgcctcaatacatccaacagtgtcccccaagtcaaaggctttctgtactgggcaagcaccaaatcacatcatataagcacagctttgtgagcaggccctttcagagaactatcaggcaggtcagatcatgacaattctctggaaatgaggcacctcactgaaggtacctcaccctgttcctgccactccagtggcagctaggttggtggttttcactgtgtttgcagacaactggttacaaagactaccacagagctaggggtacggttgaggatgggaacaggaaaagttaaaacactacaaggtcactggtcttaccaaaatttggccattttcctggagtaaatgttctccagatttgtatgaggctttggttaaattccgtgtttctgaaaagttgattctcacaatttttgtcagtttttccatgacatttaagaggagaaaatattcagaggttcttcctctgccattttcattgacatcctatttacttttatttaattcataatattatgtacaaaaaatatttagtacacatctggggtattggctatgatcaagagaatagcttagtcctaaacataaccataagttaagaggaattctttactgtgggatttcatatctggtcctgccctatggggcagtttactgtgagtttacttacctctgagcctttctataaacacacctgccccatatcccattctcaagggatctgtttgctaacttaccaggtaattaatttagggtcaagtgctaatgactcataatggcataatatgtaatcatccaaatcacattttcaggatcgccaagggcttctgtatcttaatccaaaataataagcaatgtggggattattggctccttaagaagatcaatctctcttacatagaatgagctctgaaccagacacttagcctaagacaagtcagggtgatttgtggagttgaaatgtttttcactgaaaatgccagaatgttacttttttcaaaacgtctgaataatgttggatttcctatcgcctctaattcattgtctctgtttactttgcaagtatagaaaatattgatgaaaatgatcatcaatatgaaagtaaaatgctccaaattaataccttttttctatgacaaagaaacctttacaagtggaaataacttgtatcttcacaaggccacatttttaggtcacaatctggactaaagattttatctaaaatttttaagcatttatctttgcaaaatagttaagcacaatttttaatagttatttagaaaacattggccataaccctaatctatacttattaatatgtgtccttagaactcaaaggttttctctctctctctctctctctctctctctctctctctcagcatgtgtatataaaattgctggtgctagttgctatggtcaacatttaaagtgctaagcacaacacgaaatctaaaattctgtcagaaagaagctatttctaccacttgaaaaatttcctctctgcgcagacactgcttacagctttctggcatgtgacttaggaacaaagccatgattcttttaccggagaaggtttggggatatactttgaatgttaagttatttgggatgatgttttttgtcatttgatgccagctgccactgttcatgcagaattgagatatcagttaaactaaagcagatgcaaaatagatattatatctagactaagtatcatgcttagaatataaacacatatctacagtgcttttttataaagataaggctatgaatattttagtaatgtttggttttcctgatagaatttagatttgatctgcatagtgctaaaacctctttaagaacaccaccacatacttgggttttgtgattatttggatatgatcagggttaggttgtcctttccgtaaatgaagaacaggttgaagaaatcaattgtataaaaatgttataagtggagttctcagttgactccactttcctctagctctaaatttgtgatgatgtgatctttttgcaagcaccatttacatactgatgtacttgttacatttcattctaattagtcattaacatatgtcttctaaggacagttgaggaagcattctcttaccagaatttgttatgagttttttgctttttcttgtttctctttccccttctttcttcaaaatgacaagagagttttctttgcagtcatttgaaagtggctcagttgagttagagtgagctcattaattgtagatttgtggtaaccataactaatttttgaggaaggcatgacacagatgactgtatccaccagaaacaagtttcttattccctgattcaatcacccaggggattggttctgctggggcagggtgaagggaacagttttcagggtgtcaggtaaaaacagagacgctagtaacggtgtaaacacttgtttctccagggaaatatctggacctggctcaagacgggactcttgttcttgactttcctccttcctgtgtcttctcagattctcagcccagtgatgacgctgtcctcccactctgcattccctagatcacacacaaggctgtgaatgcttgtgtacctcatgtgctgggcatttccaagaaccagtggcttcctgtgaaagctgattcacaagtatgttttcagcttactgtgtgagcaattaaatccactgctgtcatccacagtaaaaactctccacatgctgcttcacagacctttttttccctttggctttaaacagagatgtttaatgaagatgagatttttatttccttttccatatataggagctactgaatgtaagggagaaagaacatggcttaatatggtgaaagtaatggaggcagtatataattatcattatctgctacaattaaggcagcatcacgctgtcttgtgacagtttattgtggtgtgtggggatgcagtaaagtgatatttatacccccatgactgccttgccattcagaaatccataactctataaatgcattctgtggctatagagcatatgtcttcagcacttccctattaggctgggtctttacattgagaatgtggcccatgaaatgagaataagctcatagaatagatcagaaagtaaaaagctgttcaacagcaatgatgaacaaaaccttcacctgtgcaataagggtgttgggatctattggtaaaaggcctggggcccgtctggtgataggccaggaccctgaggcagggctggataagatggagagggctgcattgcaccatgcattgcagaagaggcacactcatttcaagaaaggatacgggcttggctgagcgacacatgcaactaaaactcaagacacacattctaactttctctcaagctggagtcgggaggctggcatacaaagaggacaatgtaaggctagttatcacatgccaatgacggtggtgaagaaccacgtgttccatgagacgtggctgtctagaccatgttgtgcagaaaaaaacttgagtgagacatgggagctgaaatcagtgttctgagctggacaggacagaacctctaagacaaccaaggggcatttgagtgctggctttgccagagcaactagtgtgggcatcatcctgtttactgcctgttgcatggagacatgatggtacccactggatatggctgtggctaagtgtattattccgttcctacgctgctatgaagaaatacccagactgggtaatttataaagaaaagaggtttaattgactcacagttctgcatggctggagaggcctcaggaaacttatgatcatggcagaaggcacctcttcacagggtggcaggagagagaatgagtgtaggcagaggaaatgccagatgcttataaaaccatcagatctcgtgagaactcactcaatatcatgagaacagcgtggggaaaaccacccccatggttcaattacctccacctggtcctgcccttgacacagggggataattagaactcatggtgagatttgggtgggaacacggagccaaaccatatcactaaggttcgcttaactaatgtgtagaaagggttcagggcaatgtctataacatagctatcactcaatttaggttgctgttattattatcattttcatgatagagttattattattattccagaacagccaaagcctgcaccatctattccagcatatttcgagatttaaaagtacaccactatttcattctaaaggaatgacttgccaagatttaaatttcaagtactttgacacctaggggaatctccaccatgttggggctgcagggggtacaaggcccctcattgtacccttctggtgcctctccaccctgctcagtgccccaggaggctgactggcagaagctccattgccctttggtgtttgactgtgtttggccagtgggaggcactggaaggagttgcaggatggaagggaagtgaggccagagcgtttgcacccaactccctgcccacccattccctgaaccagagctagaacttccaccaggcagccttgccgttcggccacccttcccgggttgcagggcctgctctccttctgcatcttcctcaagcctagaagggggaatgccttcccaatgacaagccccaggtactgcactatccttgggtggtttccctaaatcttgcccatgccttcaaaaaaaaaaaaaaggggccctgtattaaactttccttcacttcccagtgtgagtgtgcttcctgcctcctgccgtgggtacttcctgttgtcctttaaatcacacctatataattgtttccatgacttcaaaactatttatagcatactttacctcatccctttctgttctcaccaactaaaatagcttatattttaacctttgtcatagagacacacaaatacacacctagtacctaaacaaagcagaggagaggcaagttaatcctctgtgcctacgaatatgttaatttttaaaagcattactgagatgcttagtaaagtagcaggtgttgtgaaattgcatttttattacccttccccatatcaggcaagaaagttatggtctcttcagctattttaccatttgctaaatgttcccagtcagttagcacagataatgcttttttttaaaatcatatttaggcaattagaaacttttgggttaattaattttgcatattagaagacaggactttaatataaatttaaggcaacgggtttaatattgtaaataataacagttatcacaaaccataaacatatttataatttatatgcatgaaaatagagtctgctgttaaaatattgaaaattaagataacacagctttcagcctcaaaatgaaaactttctgcatagctacactctctaagtaagacatatttggccaatgacttaatataaatgaatggcaattctttattcagacataccattattttctaatgcatgtagcatattcaaaagatgcatatgtttccaaaaattataccatcaaatgtgataagaaaggaagttatgatgaagggtaaataggagtgggagaacaaagaagccaggaattgggtttgaaagtaatgtccatgtcctgaaggcctctacaatgagctatgcatcctcccttttttatcatattcaatggtacaatttttggaaagatatgagggaaatgcaattggctaccctatgtttattatctagaagatgaaaataaccacctagtcaggtaatgcagatttcttcccagcaccaagataaagagatgtttactcattaatgagacactgtggcaacggaaggaaaaccaagctccacaggagcattcatctgatttcctaagactattttatttattgagctcctcaatgtagacagatggagtaacccaaacggcaatttagtggtagcaattctttggggggaaaaagctgagaatgttgcaatccaggtaaacatctcgatgatggctctaatgattgcagctgtcaattaactgatactcccacatttttgttgcaatggcagagaatatgaaagtcctaaggacaaaaacagcaaaccgtccttgagaatttacatgtggaagatgagagcctgagcctgtggggcctgactccaggctcccagaggcaacatgtggctccatttggacttcagaaaagcaggggaaaagaatgacgaggaggcacaaaagttattttaaaaccaggatgtagttgtaacaaatacagctggaaaagaggaaatgagatttttaaaatacaagaaaagatagcgaaaaagagcctctgttcccgttaatacctcctactgtgctaccaaagttcagggattgcaaatggctgtaatcatttggccaccgccatggactggcctgttagcagcaaagtcaggtctgatggcaggttccactctgacatctcagctccatattttagggttatttgcctctcaccttgaaaaacacctactgcagttaattattaactgtcaccttcacatcacccagagcgggctgatgttacagaacagcctcagccaactctcatctaaactctgggtttagttttctagtttttgttttgttttattttgtttcaggcatcatacctaaataatgcctaaacatctttctcctagtaggcagattattttttccttctaaatgtaattaaagatacaaactcaggctgtgtttgtgcttgccaagaaaagaacaagctagatttggtggccttcacagtattttttttagtattttaggtttctccattatctcaataaaagtccattttaatacattgaaatatttgaaatatatttataaaaattatgcgttaagtaatttagaactaaacaacaaatcggtaacatataatactatttaaagcaaatatcatcaagggtcaatttccttaatgcaaaaaaaatcatgcaaatcaatacgtgagaaaagaaatagaccaacagggaaaaatagataaatattatgagcagacagtttacaggaaaaatgatatataagaagatgcatatatcttaaaatatattggttgaataatatcctatcttaaacattttatttctacttaaaccatataaatgtatacttgctaaccgatcttttgacatagtttttcatgtttctcttattatataactctacccatcatgtattgccttttatttccaattttgatttcatcaaagcatagcaaaacataaaaaccttgtaagcactgacaatgatggtttccagctttacccatgtccctgcaaaggacatgaactcatccttttttatggctgcatagtattccatggtatatatgtaccacattttctttatccggtctatcattgatgggcattggggttggttccaagtctttgctgttgtgaacatgtatgccaggacttgtagtaaacaacaacaacaacaaaccttccaagtgcaaaatctctgtagatttttccttttttcccctcagtctttttttttaacagctttgctgaggtatagttttcatagcataaatttcactcattcaaaatgtataatcatccagcctgagcaattggttaagactcccatctctaaagaaatttaaatgaaaaaataaatacgacgtggaaatcaatgatttttttagtatgcttacagaattgtacacccatcgactgaatttaattttagaacatttttgtcactccaggaagaaaccttatgcatattagcagtcactccccacaccccttcctcctactccccagaccaagcagctgctgcttcctgtctgtgtagattttcatttccctattctgcacgtttcgtataaaaggaatcatgaactacgtggtctttcatgactggcttctttcatttaggatgaaatgttttcaaagttcatccacgttgtggcatgtatcagtactttattccctttagtggctgaataatcttccactgtatggatgtaccacattttgtttatccgttcattagtcagtggtcatttgggctacttaccctttttgactattgtaaataatgctgctctgaacatttgtgggtgtgcaagtgtttatctgggcatgtgttttcatttctcttgggtatatactcaggattgaaattgctgagtcaaatggtaactccatgtctaacattttgaggaacgccagactgtgtttcacaacaacttcaccattttaacagtcccaccggtaatgtatgggttcgaatttctccacatcctttgcatcacttgttattatctgacttttttattatagcaattttagtggttgtgaaatggcaactcattgtggctttgagttgatactcccttgtagaaaaacaagagtcaaacttacgttttaaaaaatatatgcttggggccgggcgtggtggctcacacttctaatcccagcactttgagaggctgaggcaggtggatcacctgaggtcatgagttcaagaccagactggccaacatggcaaaaccccgtctctactaaaaataccaaaaattagctgggcatggtggtgggcgcctctaatcccagctactcaggaggctgaggcagggacaattgcttgaacccaggaggcagaagtggcagtgagccaagattgcaccactacactccagcctgggcaacagagcaagactctgtctcaaaaaataataataatacacacacacacacacacacacacacacacacacacacacacacacacacgtgcttggggaacttttaacagggaaaatataatgtatgtgttatgtaggcttcagccacagatacatgatgaagcttacaactgtaaacatgcaggctttactcttcttgattactgagatggatggcagtttatcgacacttattcaggtttttgctcctttctgtcaatttaaatctcaggatcagtgaaaagagcccagggagaagacaggagatctgtgtgtccccagccctgtccccaaactgtctgtaagaactttcagcctctgaaactcatcagcagtagaagataacttgtctccaatatttgacagtggtgatgtgaaggtaaagcaaactgattaacacgaatcaactatgaaaaacttaaagcgatttaccagcatcttacatgtagtaaatgtattttacacacacacatatctattatattatatatacaggaccgaaagaataaagaaaaacattttttgggtaggaaaatggcagagacgacagcaatagcagtattttctggcaaaatgttacagaataagatggagtatacagaaaagtaaggttactcattcaaaacaacaaccacagatattttttgttgatattgttaggtttgggatttattttttagattttaatgaagatggtaggttaattgataaccttcttggcaggagaccataatcttggctttcagaatgtgaataaaaggggctctagtttctttcccctttttgtaatatcgttgtcacctcataactacagcttggggttttagctacagtccaaatgacattttaattaataaaatttggccataattaaattacatataaaaatatatcacaagtacctcttatttaacttttacttctttgccaatatataaagtggtcaataagacttctattcaaaaatagtgtattttttaaattttattattactatatttaagttttagggtacatgtgcacaacgtgcacgtttgttacatatgtatacatgtgccatgtttgtgtgctgcaaccattaactcgtcatttagcattaggtatatctcctaatgctatccttcccccctccccccaccccacaacaggccccagagagtgatattccacttcctgtgtccatgtgttctcattctccatttcccacctatgagtgagaacatgtggtgtttagttttttgtccttgcgatagtttgctgagaatgatggtttccagcttcatccatgtccctataaaggacatgaacccatcattttttatggctgcatagtatttcatggtgtatatgtgccacattttcttaatccagtctatcattgttggacatttgggttggttccaagtctttgctgttgtgaatagtgccacaataaacatacgtgtgcatgtgtctttatagcagcatgatttacaatccttagggtatttacccagtaatgggatggctgggtcaaatggtatttctagttctagatccccgaggaatcgccacactgacttccacaatggttgaactagtttacagtcccaccaacagtgtaaaagtgttcctatttctctacatcctctccagcacctgttgtttcctgactttttaatgatcgccgttctacctagtgtgagatggtatctcattgtggttttgatttgcatttctctgatggccagtgatgatgagcattttttcatgtgttttttgtctgcataaatgtcttctcttgagaagtgtctgttcatatcctttgcccactttttgatggggttgtttttttcttgtaaatttgtttgagttcattgtagattctggatattcaccctttgtcagatgagtaggttgcaaaaattttctcccattctgtaggttgcctgttcgctctgatggtagtttcttttgctgtgcagaagctctttagtttaattagatcccatttgtcaattttggcttttgttgccattgcttttggtgttttagacatgaagtccttgcccatgcctatgtcttgaatggtattgcctaggtttccttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattggtcgatatctctgttttggtaccagtaccacgctgtttttgttactgtagccttgtagtatagtttgaagtcaggtagcgtgatgcctccagctttgttcttttggcttacgattgacttggcaatgcgggctcttttttggttccatatgaacattaaggtagctttttccaattctgtgaagaaagtaattggtagcttgagggggatggcattgaatctataaattaccttgggcagtatggccattttcacgatattgattcttcctacccatgagcgtggaatgttcttccatttgttcatatcctcttttatttcattgagtagtggtttgtagttctccttgaagaggtccttcatatcccttgtaaattggattcctaagtattttattctctttgaagcaattgtgaatgggagttcactcatgatttggccctctgtttgtctgttattggtgtataagaatgcttgtgatatttgcacattgattttgtatcctgagactttgctgaagttgcttatcagcttaaggagattttgggctgagacaatggggttttctagatatacaatcatgtcatttgcaaacagggacaatttgacttcctcttttcctaattgaataccctttatttccttctcctgcctgattgccctggccagaacttccaacactatgttgaataggagtggtgagagagggcatccctgtcttgtgccggttttcaaagggaatgcttccagtttttgtccattcagtatgatattggctgtgggtttgacatagatagctcttattattttgagatacgtcccatcaatacctaatttattgcgaatttttagcatgaagggttgttgaattttatcaaaggccttttatgcatctattgagataatcatgtggtttttgtctttggttctgtttatatgctggattacgtttattgattttcgtatgttgaaccagccttgcatcccagggatgaagccgacttgatcatggtggataagctttttgatgtgctgctggattcagtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacctctggtagaatttggctgtgaatccatctggtcatggactttttttggttggtaagctattaattattgcctcaatttcagagcctgttattggtctattcagagattcaaattcttcctggtttagtcttgggagggtgtatgtgtctaggaatttatccatttcttctagattttctagtttatttgcgtagaggtgtttatggtattctctgatggtagtttgtatttctgtgggatcggtggtgatataacctttgtcattttttattgcatctatttgattcttctctcttttcttctttattagtcttgctagcagtctatcaattttgttgatcttttaaaaaaaccagctcctggattcattgattttttgaagggttttgtgtgtctctatttccttcagttctgctctgatcttagttatttcttaccttctgctagcttttgaatgtgtatgctcttgcttctctagttcttttaattgtgatgttagggtgtcaattttagatctttcctgctttctcttgtgggcatttagtgctataaatttccctctacacactgctttgaatgtgtcccagagattctagtatgttttgtctttgttctcgttggtttcaaagaacatctttatttctgctttcatttcgttatgtacccagtagtcattcaggagcaggttgttcagtttccatgtagttgagtgattttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagagctgagttcaattcctggatatccttgttaactttctgtctcattgatctgtctaatgttgacagtggggtgttaaagtctcccattattattgtgtgggagtctaagtctctttgtaggtcactaaggacttgctttattaatctgggtgctcctgtattgggtgcatatgtatttaggatagttagctcttcttgttgaattaatcccctcaccattatgtaatggccttgtttgtctcttttgatctttgttggtttaaagtctgctttatcagagactaagattgcaacccctgcctttttttgttttccatttgcttggtagatcttcctccatccctttatttggagcctatgtgtgtctctgcacatgagatgggtttcctgaatacagcacactgatgggtcttgactctattcaatttgctagtctgtgtcttttaatcggagcatttagcccatttacatttaaggttaatattgttatatgtgaatttgatcctgtcattatgatgttagctggtgattttgctcattagttgatgcagtttcttcctagccttgatggtctttacaatttggcatgtttttgcagtggctggtactggttgttcctttccatttttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccctattctcttctggcttgtagagtttctgctgagagatcaactgttagtctgatgggcttccctttgtgggtaaccctacctttctctctggctgcccttaacattttttccttcatttcaactttggtgaatctgacaattatgtgtcttggagttgctcttctcgaggagcatctttgtggtgttctctgtacttcctgaatctgaatgttggcctgccttgctagattggggaagttctcctggataatatcctgcagagcattttccaacttgattccattctccctgtcactttcaggtacaccaatcagatgtagatttggtcttttcacatagtcccatatttcttggaggacttgtttgtttctttttattcttttttctctaaacttctcttctcgcttcatttcattcattttgtcttccatcgctgatactctttcttgcagttgatcgaatcagctactgaggcttctgcattcatcacataattctcgtgctgtggttttcagctccatcaggtcctttaaggacttctctgcattagttattctagttagccattcatctaatttttcccaaggtttttaacttctttgccattggttcaaacttcctcctttagctcagagtagtttgatcttctgaagccttcttctctcaacttgtcaaagtcattctccatccagctctgttccgttgctggtgaggtgctgcgttcctttggaggaggagaggctctctgatttttagagtttctggtttttctgctctgttttttgcccatctttgtggttttatctacctttagtctttgatgatggtgacgtacagatgggtttttggtgtggatgtcctttctgtttgttagttttcgttctaacagacaggaccctcagctgcaggtctgttggagtttgctagaggtccactccagaccttgtttgcttgggtatcagcagcagtggctgcagaacagcagatattggtgaacctcaaatgctgctgcctgatcattcctctggaagttttgtctcagaggagtacccggccgtgtgaggtgtcagtctgcccctcctaggggatgcctcccagttaggctattcgggggtcaggaacccacgtgaggaggcagtctgcccattctcagatcccaagctgcgtgctgggagaaccactactctctttcaaagctgtcagacagcgacatttaagtctgcagaggttactgttgccttttgtttgtctgtgccctgcccccagaggtggagcctgtagaggcaggcaggcctccttgagctgtggtgggctccacgcagtttgagcttcccggctgctttgtttacctactcaagccttggcaatggtgggcgcccctcccccagcctcactgccaccttgcagtttgatctcagactgctgtgctagtaatgagcgaggctccgtgggcataggaccctccgagccaagtgcgggatataatctcctggtgtatggtttgttaagcccgtttggaaaagcgcagtattagggtgggagtgacccaattttccaggtgccgtctgtcacccctttctttgactaggaaagggagttccctgaccccttgcacttcctgggtgaggcgatgccttgccctgcttcggcttacgcacagtgcgctgcacccactgtcctgcacccactgtctggcactccccagtgagatgaacccagtacctcagttggaaatgcagaaatcacccaccttctgcgtcgctcacgctgggagctatagactggagctcttcctattcggccatcttggctccaccccaaaaatagtgtattttagacagtttagagagtcattattccatggttcagtatgaaccttctttttgctactgtttgtaccttttcgtcactgtgacttcatcaggaacaagaatttcatccctgcagcaaacaccgctgcgaatatggactgcagggtgacaaaatcatcgtcacaatttttacgctttctgaatttctcttgcaaatatccacattaacagtactaatattcttcagccttcaaaactcatgctgttttatttctcacacttgcccttcattctctttgtaatggatccacaatcgttccatctgtaatgttttgccttaaaagagcagtttttttcccaagtgtcttcaagaaccatttgtattagcatcaactgggtacatgtacagaatgcaaattcataggcctgaagctagacctgctggatcagggtatggcctggtaatgtgtattttcataagcatccaggtacctcacaggtgcacttatatcttgtatatactgctatggaaggtgctctgctctaattaatcaaacaagtatgtaatagagtaagcctcatagcataataaataatactgtgggccatggcagtaagaactggctcatttaaatactgttaaattatcaggacaagtattaaatatgtaatttttattaaatataccactggttgccagaagaattctcattgatgtagcagttttcacatttatatatatttataattttaaaatgatagataacatatactgaatgcttactattagccatgccctgtttttcataaattaatccatgtatataagtattttacatttactcatttatacagcatgatgagcgacaaggtgctatcattattatcattatcatcttagatggggaaactgaggcatgggggccccacagcactaagtggcagagccatgattcagcagtaaataatccagtaccaaagctctggtccttagcaattatacctgtactgtctctctatttgtaaagaaagtgtaggtctttaaatgctattttgaacagatttccatatacctatgtatagaataaccaactacaattgaacttttattgtaccttatcatactctacagctagatggctgtctttagtccattttgcactgctacaaagaaatacctgaagctgggcaatttataaggaaaagagttttattgggctcacagtgcccaggctgtacaagtagcatggagccagcatctgcttctggtgaggcctcaggctgcttccactcatggtgaaaggtggagggaagctggtgtgtggcaatcacgtggtgaggaagaacacaaagcagagggggaggtgccaggctctttttaacaaccggctcccatgggaatcatgtgtgagaactcactcactgccccccaccaaggagggcatcaatcttttcaccaggcatctgccctcatgacacaaacacctctcattaagccccacctccaacactggagatcaaattgcaacatgagatttggaggggccaaaacaaaccaaaagatagcaatgtctctggcatttaaacaatatatttaaactatatttggccacttaaaactacgtttgaggcctacctaatttaaaacgaatgaaaatagacaataattctacccttataatgcctaaaatctagttgcggagatttaaaaaaaattctaaccgttccataaataaacataactttgcaactttggcaaataatacaaaatagaattacacagaattgtgagagcttttaaaagatggtttattctcgacaggaaagtctggaggggcttccttgtgaacaggtgaatggatgaacagtcattaacctggtaaagcagggaccagtgatggggagctctgccttcggaaatggaagactgctgttacagaacaaatccgctatcaggaacatccagaaaaggtcaaaggcactgcagagctgccaaggaagtgaggacttgtgtcttcatgtccaaaagatggaagaacagagaggtagagaaatataggggtggcattcactcatttgcacaaggcagctgacaggttgtggatttctatagacttggggtctaaaagtagaagtcctgagaaacacactagagtttgaattggaatccccaaaggctacacactagaaaaaaagaattagagatggaattttcctcaggacgaaagcccagactgtaaagatgttaacccttgtctaaattaagaatatttgccttcttcctaactacctgccagaagcaaaagtgaatccactctggaggaagacaaagcatctagagcttcaaattatctgcacacctagtattggaaatatgaagtattgagccaaaaattaccaagaaagaacaaaataattgaacaaagagcaacagcaacacataagcgcgcgtgcgcacatgcacacacacacacacacacacacacacagacacacacaccagaataacagaagaaccagaaagaacttattagatatggactttagcatgtttgtaaaactaaatcataaaatacagagttattattatttatttatttttgagagggagtcttgctctgtggcccaggctggagtgcagtggtaggatctcagcttgctgcaacctccacctgccgggttcaagcgattctcctgtctcagcctcccaagtagctgggattgcaggtgtgtgccactgtgcccagctaatttttgtatttttagtaaagacagcatttcactgcgttggccaggcttgtctcaaactgctgacctcaagtgatccacccacctaggcctcccagagtgctgggattacaggtgtgagccactgtgtctggcccaaaatgtagaattataccatgaaatggaaaccatttaaaatcaaatgggcatattagaatggaaacaaaataagatatgaaattaagaactcaatgaatggatttaacaaccatttaacacagctgaacagaagaaaagggagcaaacaaaaaaattcaatatctggttacaagtagaaaaatgtagaaaacagtgtaacatgcataatagatgttggaaacctctagtataggtgtaattaaagttgcagaaggagaagacggagagaatagaaagggaactgttacagatgagatcatttcaaaagtaacggaaaaatccaacagatattagctgctgtatgaacttcagatagattacaacaaacagacaaaatgtacctaaggatatcataataaaatttctgaaaactgaagacaagaggaagtctaaaaagcagtcagagacaaaacatatgttatctttaaggggaaatagaaatactaataatgactgtataagagtgcaagtcagaagatggagacatgacattgtcaagtgcggaatgaaaataaatgccaaaatagaactccatatgctctaaagttcttcttcaaaacaaaggaaaaatataaggacatttttttgaaaaacaaaaacctaggaaatttgtcaaacttccagtaaaggaatgactgagagaactcttcatgcaaaaaaacataatcacagatgaaaatagatgacttaagaagagaagaatggaaaagataaatgtgtggctatgtccaagggaatattgattgtacaaaacaatgattagaaaaaaatacctatataaatcttgataaataatagcacaaaagacaggactttgttaaataatatttgattactcaaagttccttattacctggagaattgtagatatattaattaatgcaactatcaactaattgaaattaatatgattatcaatataagattctaattaagaatatattttgaatttatggggtaaacactgaaagaataataattgtttaataacaggctaatttgaagaagatttatcaataaacataattaactcaaaagaggaaaaacgggacaaacagaattagtaagattgattggaatgccaatgtgtcagtgattgcattaatgcaaatggattgaatactcagattaaaaggcaaaattgtcagactgaattagcaaataaagacaggcagctcacaaaaaaagctgcctaaaatatgaggaccaaaaaaaaaaaaaaaccctgaaaaaaagagagtaagttgaatacatgcaagcagtaggcaaaataaaattggcatatataattttgcaaatgacactgaaaggcaagaaatgacacatttctaaatataaatagtgtcattgcattaggattaaagggtctatctgacaagaatttataatcttagactggtatgcacctaataatatagcttcaaaatatataaagcaaaaattaacagaattaaggaggaaaatagacaaatctacaatcttagattttaccatacctctctgagaaactgaaagaacatccaagaaaaaaaatcaataaggatgtagtagatttgaaaatcacaatgagctaacttgatctagttgaaaaatacagaaatactacatctgtcatttcagaatatacatcatattctatccaatatgtatatgcattgcccaaattgaccgtatgtttgaaaacaaatcacacacacacacacacacacacagtatcaccaagtatagggattgaaattctgagtattttttctctaactatagtgagattaagctaaaagttaatattaaaaatatacctcaaacatctttaaatatttgtaaattatttctaaacaactcattggccaaaaataaaaattacaaaggaaattaaaagtgccaattttataacctaacatctcaataatttacccaatagaacagcaaataacacacagtcacacattgcttaatgacaggatactttatgaacccaacattcagtgatgttagtcattgtgtaaacatcaaagagtgtacttacatgaatatagagggtacagcctcctacacacttagcctatatggcatagctcctatactacaaacctgtacagcatgttgctggactgaatacctaattttactgtaccttttctatgtttagatatgccatggtaagtagttgtatatctaaacatagaaaaggtaaagtaaaattatggcataagaaataaataatgttacatctgtacagggaacttaccataaatggagcttctgtaacttagagttgctctgagtgagtctgggagtgagtggtgagtgaatgtgaaggtctaggacattactgtacactactgtagactttcccaacactttacacttaggctatactaaatttgtaaaaacaaaaactaaaactaaaacaaaaaaaacccttttcttttttcaataatatgttaacgttagcctactgtaacttttttactttctaacattttgagtttttaaaaaattatttgattcttttgcaatcacacttaccttaagacacaaataatacaatcatacagatattttctttatattcttatctatatgcttttatctattttcaaatttcttatttcatttgttactttttaaactttttgctaaaaattaagacacacacacaattttgtgtttattattatcaaacattatgtaccatacataattgtatcgctatacttttaaacaagcggtagtgcaataggtttgttcacaccagcatcaccaaaaactcgtgagaactgcattgtgctatggtgttaggacaatgatgatgtcactaggaacaggaatttttcggcttcattataatctgggactactgtggtatatgtggtctgtcatatgttgactgaaatgttatgtcatgcatgattgcataaagaaagtaggaaaaaatagtacgtatgaccaatcttattaattaaattgataaaaagtgcatgacacaactcaaaaagctaaaagttgtttttcaagcaaataattaaataggtaaacaccagggaagattgaatttttaaaaatcaagtattaccctattccaaatgaaaaagaacatcattttaatggaaaccaaaaagaagaagtatttgcaatgcttattaactgacaaaggactcatatcctggatatattaaaaggtttgacaaataaagatattaaaagtcctggacactacaaatgacaaatgggcaaaaacattaacacgcacgtcacaaaagaaaatatccaaattactaagaaacatataaaagctttccttttcactgtcattagtttttgaggcaatgcaagatacccgtataccgtcatcagaaatgttactcaaaagtgaaataaaacaaaatataacctgacaatatcaaatggtaagaagaatgtgaagcaacaggtcactcacatcctacttgtgtgggagtaattttgtgcagcctctgtttatcaggttacacaaggctgaatacacacattctaataaatctactaaggctaaacatataccttctaataaatctatcaagtttctagatatatagccttcagaaattcttacatgtgtaaatcaagactgtaatgagaatggtcataacatcattatttatgttagtgcctatccaagcaaaaaaaaaaaatccaaattgactcaacaatagcatggattgattatgaaatgttcataccatggaatgccatgcagtgatggaagctgactacagctacatacaatatctccgagtctcccaagggagacagagtgaaagaagccattcacattgattccatttatatggagttcagaagtctccccagctaactagcgttagaagtcaggatagtgattttctcaggggagaaatgggattgtaactagaagaatgcaccaagaaatcttttgagacaccgcttatcttgtatgtcttcatctggttgtgattacatggatgtatgcactttgagataagttattaagttgtagacttatgacttaggcacttctctctaaatgtcgtacttcaacaagatgttttggtttgtttttacattaaaagacagaaggaagaggagagtatttaaggtaaagaaaatagcacgaaaaaatctctgtgcaggaattaagtgtgtaccaagattgaataaagccatgtgaatggagtacagaggtaaagaaataaagataaagagaggaggaggggagatgggaaaaaaggaaggaggaaaggagaaagaaaagacaacagaaaaagaaaaaaaatgaagctggaaaagtaagtaatggcggcccctctccaaggtccagaaacttggatacttccctaatagcagtgaacgccagagaaggggtttagctgtggagagtgtggtgatgtgatgagatttgtacttcagatatctctagatgaatgcactggagaagggaaaaaagtagatgtgagtggatgaaaaaagaatgaacagcagttgtccagcagagagaagtgttcgttacctgggtctgagtgttggtggtagggaagctgcaggaatgtataattgtgtggatgctgggggtagagggagagggagctatgcttaaaataccagcccaagcttttctaactccaaaatatcttttatttatttgtttctttctttctttctttttttattttgagatggagtctcgctgtgccacccaggctggagtgcagcagtgccatctcagctcactgcaacctctgcctcctaggttcaagcaattctcctgtctcagcctcccgagtagctgggactgcaggtgcacgccaccacagctggctaatttttgtattttaagtagaggcagggtttcaccacattggtcaggctggtcttgaactcctgacctcaggtgaaccacctgcgtcggccctcaaagtgctgggattacaggcatgagtcactgtgcctggtccaaaatatctcttaaaaagtcatttaaccacgtgtttctcttttctataactcgttgtaaacaatgaattcctatatttaatagtgatgtcctttttgtattctagtttaataacactatttcatgggttaattgttttaataggaatttcctagtcgatatagttttatttattacctcattggaggaagagttttatacatattttatagaggtgggcccaaaagtccccgctatgttggtagacacataataattaaattttaaaaagctatggccttctaaatttttctttcttttgaaataaatatatacagatttttgacttatttatcaacaattgtgccatcttataggaaaattaacaaggttcatttatgaatgtgtcacaaaactgcttttcttgaactgctgatgtttgaatattataattttatgccatctgtgatatgagcatttgttacatataagttctatcataagcaaactaaaatcactccctttgtttaaatgtgtttagtaagtctattgctttcagtttataagtgtttgaccattgctcttctataaaagactctacaagaactctaaaatatatactgtgcttcactgattctgtaaaatagatatgtaaagtaatttcacattgttcaaagatactaggaatcacatacacttaactgcttatattttccaatactttgcttagttacaaagtttctgtataaagatattctcatgtataaaagagcccaacaattgttttgtacttcttacacttccttaagatagtatttaataccaacaaaatactgcttgagtcaggaggccttaatcaatttgttagagtaggaaactgaagagttaaaatagttgtggtattggcctacaccgacatgtgacgtgagacatggctgtggatatgacatccaggctccatcctctgttcctcctcttggaaattcggtctgtagcctaacacatttgttaatgcacagagacaagtatgtggggagaaaagacacactgagctggatacctgtgtattttggttcatacctgagatgaacctgaaatacagtctattacctgaaatagaagaccaacgtgttgtaatgaatttagtctgaattatctcattcctgggaggttcctgttaaattgagcaagtgcgagatagagatgaacataaatcatttctttcactcttagtctactctggcaaagtgaaacattgccaaagataacagtcttttaattaattttggaggttggtttatgtatacccttggaatttcttggatacatgcttcattaataggccaatatgcctaggtttaaagaagatatttattttaaaatttaatatgtcgattcttagttgaaagtatagtggaagaggcagcagcataaatatcctctcatttattgcttcgtttgttcgagaaacatgaattgaacaacctactactcatcagtcagtgtgaaagtaggaggactcaaagaagaacatgcaggcataggccttcaagttgggatgcaaaggcagccgtgccaataagtaaatatgtgtgataagttgttagatgtgcaattctagctataagatgattgatttaatggccaacatagcccttgtaatataacattagcactgaggtgagattaaattccgtttccatctcttggttgcaaagggtcagtggggaaatgggtcatctgtgagcagggttgatattggacttaatagttttgcatggatgatctataaatggctcttctctaatccttactacctacccaaatgatatccttattattccaacccaaaattagtgcaggagcttcctagctgccttgcctgtccctgtctccctgctttggagggtggatttgattttaaagtatggatcatgctatatcaatgtctacctgggggccttggctgcgacattcctgtttttgtaggacacggctcacatggctctcactgctggtctccacatgtccttccaccctcatttccatcacccagctctgcttccaggtgatagtgtactgaactactcaggccatccctctgcaggcattcattttccctggctccaggtcctaatggctaaatttgtattgctcctataaaatgtatttcagctgtcatcacttgctttagctttctttcatatttgcctaaagaccccaggagccctgccatctgtattcctgtatcatatttgtacaattatttttgttgttgtccatattgttaatttgcatatcacccaccagacaccgtgagatcctcaaggacagggactgttttctataataaaatctatcacatgtcatcaagcttggcatatcattagtctctcaacatattttaagttaatttgtctaatttctgaatgattgagagaagctaaaaacattggttatatgctttctccaaacgattattatcatacctgtgtgatttgtaaaataaatgccgacccatctcatactttttctagtagatatcttcctgaaaatttatgggtaaattaaatcatgtgaaatgaataatgtcttcagtgaaataggacagctcacattttaaagaacatcagtaatgaactaatctgtgtaaaagaatagttttagtctcttttcttatgtcacgttgactgtcgcttttacaaattgggaattttacaggttgagttgccttatgttggggttcctctaggtaaaggtattcatgcagttaaacttctagtaataagcaacaagaaaataacactgataaagtgacatgaggaatctgctcctgtgctgtaactatttcctgatgtcaaatgtgaaactgaacattttgccaaaagtctcaacttaaatcaaagccactttaatcaaagcagttgctaatgccagcagtacataaattgaggatggagcaaaaggatcgacaccaccaatggctgcattgtgataggtgtggacagagcctgccagaattaaacacatgccaggagtcaacactaggcaaaggtaaatgggataggtgctgtgaaacatggcagatcctatgggacttaggtgctcccaaacatggcagaccctatggggcttaggtgctgaaaaacacggcagattctatggggcttaggtgctgtgaaacatggcagcttctatgggatttaggtgctgtgaaacacggaagattccatggggcttaggtgctatggaacagggcagattctatgtgaccaaacctaacagaaacagtgcggtgagaatcgtaagataaacatgctattcctgtgatctgggtgaacaaacaaacaaaaacaggaaatacaactgcaaaacctagacagagaagagccaaaactgttgataaatataggaccaccttcgcatccccgtttgcgaaaatgttgataaatataggaccaccttcgcatccctgtttgtgaaactgttgataaatataggaccaccttcacatccctgtttgtgaatgcaatagcacaagaaaaagtcattttgaggatgggatagggaatgaacttctgatggtaatgctgtcttcaaatggttccgaattgaattttatcagaaatttaaatacccaaaattaatatagaaattgagaaccatcttatgttaagcactttttccttacacttactttccttcttttccttttttttgttctttttttttgagacagagtttcgctcttgttgcccaggccggagtgcaatggcacaatctcggctcaccacaacctccgcctcccgggttcaagcaattctgcctcagcctcctgagtagcttggattacaggtgtccaccaccatgcccagctaatttttgtaattttagtagagacgggattttaccatgttggccaggctggtcttgaactcctgacctcaggtggtccacccgcctcggcctcccaaagtgctgggattataggcgtgagccaccgcacctggacctgtctttcttacagagacctcttagcctcattcttttcctctccagtattccatatggcagtggctcaaggtagacacgttgcaaagaatgaacaggcattacctggatattcaggattgctttgctgttttattctgtgcagtgtttccttttatgcctgcttttcagccctatcctttctgcagggctctgggtcacaagctgggcaggaggagcagaacacagcgcctctaacaagtagcaggactggacgctgttggttaagtgttaggagaaaatgtgtctgctaatagggttatttgtttctttttttgggggaatttttattttttattttttatatataaactttaagttctagggtacatgtgcacaacgtgcaggtttgttacatatgtacacatgtgccatgttggtgtactgcacccattaactcgtcatttacattaggtatatctcctaatgctatccctccccaattcccgcaccccacaacaggccccagtgtgtgatgttccccttcctgtgaccaagtgttctcattgttcagttcccacctatgagtgaaaacatgcgttgtttggttttttgtcctcgcaatagtttgctgagaatgatggtttccagcttcatccatgtccctacaaaggacatgaactcatcgttttttatggctgcatagtattccatggtgtatatgtgccacattttcttaatccagtctatcatgttggacatttgggttgtgggactgtaaactagttcaaccattgtggaagacagtatggcgattcctcagggatctagaactagaaataccatttgacccagccatcccattactgggtatatacccaaaggaatataaatcatgctgctataaagacacatgcacacatatgtttattgtggttgtttcttaacataaaggtttaatccgtatgattccacttctgatttccagggataatttgaaggaaactataaaaatagaaggttaaaaaatatgtttgtcggccgggcgcagtggctcacgcctgtaattccagcactttggggaggccgaggtgggcaggtcctctgaggtcaggagtttgggaccagcatgaccaatatggtgaaaccccgtctctattaaaaatacaaaaattagctgggcgtggtggtgggcacctgtagtcccagctacttgggaggctgaggcaggagaatcacttgaacctgggaggcggaggttgcagtgagccgagatcacgccactggactccagcctagtgacaaagcaagactccgtctcaaaacaaaaatatatatatatatatatatatatatatatatatgtttgtcttcttgatttttcctctcctccatcatgtggtgatgggatgggaaaaggcaggttgtggggagcagtttggaggcccatgcttggtgggaaagagagggaggaaaattctagatgaacgaatgccgcttcaaaggaagaagcaaaagaaccatattaaccctgcttacaatcggatttagattggtgatatattctgtccacactcaactgggtttatcctgacattcaacagtgtaagtgacctgtactctaagtgttcccttcttgagaaaaggtgtgattgagcagcctgctgttgtctgaatttttgtctctcccttttccagaattcatatgtgaaacctaaccccagggtgatggtgttaggggctgaggactttgggaggtgatgaggtgatgagggaggagccatcaccctgataaaagggaccccagagaggtgcctttcctcacaccatgtgatgcacactgagaaggcgccatctgtgaaccagaaatcagattctcaccacacaaagcatctgcttgcaccttggtcttggacttccagcctccagaactgtgagaaataaattcctgttgtttataacccacgcattttacactattttgttatcacagccagaagacagtaagacaaatcccaacagagaagagtgcttctagaacctaaagtgcacctaccactttctagcaaagcctgatccacattactttaaaagtgacttttcaagcattttgctttggtttacctatttcttccacttacctctctcaagcccaaatcattagtttacacttgtaaccaattgctcgtgcacatgtcctaatgtttttgaatatacatatattaatacataatgtatcattcgtgtttgcatgtgggcattgtggataacttacatgtaattacagttgcaattacttagaatcatctacttcttcatgagctcgaaagtgacctcttattcttttttacaaacggagatttttttgtgaatgtaaataatggaaaagcttcccaaacccctcccagactccagctcccgccatgcccttcccctcaggcgctggcacgcccttacacacacacacacacacacacacacacacacacacacacagcctgatgtgtctatcagctctgaatctggtttttcaagtggcttgggtgggtctgcatatgaatttgaccaacctctgcgcgcgctcctgggagcgcgcatctgtgtgtggtccagggagccaaccgcgtttgtgaatggatgattgatgggaacagcgcccaggggcagcaggtggagacgggaacccaggtcgcggtcactggtcaacccgcctcttggggtggaggttagagaaatgggcgctgggatttggccccggccagtgctggggttccagggtagggagagccgtgggcgccagactgggctgcgggaggtcttcggggtcagatcccgcaggcagccaagagcgagccaaagaaacaaagccgccgagggacgcggctggggcggaggcccggagggaagtggaggccgggaagccaggtgtgcggcggggagagcggcccctgccacccgcgctggtagccgggcgctgccattcactgcaaggtcctctgcgccctggaattgccgcggcggcggatgcagaggccaacccagagtgcaaccatggagacgcgacgtgtgtcccatagtaacctgttacaacattatttataagctgccatccctagccttcccccgcttcccctccgctccctcgccagacttgcgggcgacgggcacagccgcgtctggctcttcccggcctctcccttctctcgcgggcgcagccgatcaatagttaacacccggctgcggacggcggctccatccgcggcaatcaccgtagtgcttgtttgtggaagccgagcgtgcgtgcgccgcgcgcgcacccagtccagcgcggagtgggcgtctacccgaggaggggtgtctggggaggggctgccctcgttacccaaacagtttgcgctcgcttaaccttgatgcagctcgaggcttcccagtccagctcagttcagacagaaaacctggcgcgcgcgcgcgcacacacacacgcctcccctggcgtcgccgcccggccgggtccctgcccttagggaccagagcggcgaccgctgcaccccgcaccgcctgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgctgaccgcgggtcggtccgagccccaagcagacccccagggctcttctggggaaacgcggggagaggtggtcacttcggccagggaagggccactgggccctggcgcccgcgccggcctcggtgctccgagtccccggaactcgagacctgttgggtctgcggagccttcggtgctctcggggcaggcgccagtcgctccgctccgttccagacgccgccgccgggcgggaccctgctccctggattggggacgctgactcccccaaaagcttgactgtgccggaggaggtcaggggcacttcgtcccccaggagggccgcgtgcctggaaacgcggctggtccgcggaaggctccgggcagctggccaggggacagttctgcacggataactttctaagtggaggacccggcgatccgcctccccagcgagcccacccgcctcgccgctccccgctgacccgcgcggcctgggcgcgcctgctctcgggctcacgttagtccggggcacggggccgaggggtcagggcgctggagtctctggcgaggacgagagagttgccatcttgttctgttgaaattgtttgtgtgccttcgtgtgtttattttaacccattaggtcatggtctgagaagaatcctctgacggtcccttattttaagttgctggctggcactttttttttttttttttttttttttggcgacagacaaggagatggggattgccttgctacttttgaaggttctgcagatttgcagatgctacttttgagggttccgtaagaattgaagaaattctttcaggggcaaggtccagagttgtttacagaagtgggttgggtccaagtgatgggggtgcagaggcacctttgcgggaacccaggcagtggtgcattttgagatctcgctttaagcaaaacaggcaataagtgaaaaattctacattaattgaacaaatacccagctggcttaaccacacccacggcagacacctgttgcctggcagagagaagcgccgtgggttcagaacttgactctggacggaggtgtgagtctctgggttcaagacacctcgcagggaagtaatcgccgcatggaggggcttactcttcaggaccctccccactcccgagacgacaagcccccatctaggggcggttcgcagtcctcggtccgtgggttctctgactgacctaattgcttgtttatgaaaatgcatctgcttccctcatttttcccactctttttcttttttagccattgtgttgttcagcataatttcttgcataaacaggatagaaacgtgtatggagtaatgctttttcattaaatgcccaaccacatccatcattcctaacttacgtgatgccatcatgtgctagggaaacctgtatatttagggctgaggctgaagttaaggattgaggttaattatactgataaggcaacattattgactcattacatcaatctaccgccaaataagtttctacttataacttgcatggcatgaaagagccaaatcttcatattacacctttattagaaaccttatggtctttgccctccccctaacccctctctgcgttttacttcagaaaataaagaatgaaaggattgctaattacatttctctcttctgctctgaataaggatattccatgtgatactcattgcatcccttcccctgtgtctaatgttaagaagtgtcatcggagcaaggtgaacctgagcctagagaattctacagcaacccatattttcagagttatttgtgggcccaagaaaacaatgagatgcacacttactcaaactttgaatgttcttatcaattcttgaattgataattatggctccacagcctgctgtgtaacttatttgaattttcatgttccaaggaaatccacgtggcttcagttgagtgatcatttaggacttacccatgcctaatctctcaagttgctttggaagactcttgctaatcacagcctctcttggattagatgactggcaaattctttgcactcacaacttgattgaaattcaggtgatattttacattcaagatgaggactgaatgatttactcctattactgacagctgagctgccgcacatctgacagctacaaaaagtggcagaatgttttctactttgcagtaacagtgaacccacatacacacagagaccagatctcagttcaggggactcaaagatctctgagctgtctggactcgcatttgaggtttgatatttaaaaaagagaaagacactttgcactgcccaaatggtcacggaaatgtcaaatccagttcagccatgcctgtaaactgctttctaatccagcccctgctcgctgacatccacattgtatgattgttctggacctgcagcctgttgtttcaccgggagttctacaagaatggtgacaatagcctcccggctggtccttgccatgccacattgcttagttgaaagtatgttcttataaaatctttaaaaaatgttttattcctcacatattgctttaggaatttatttctgagtacagctagaggattaagagaaggcagatgcaccagcatactatctgatcttgttttgttttagtaaatgggtaaaagaaataccacaggtggaatcagtttagaacttttttttttttttttttttttttttggagacagagtctcactctgtcacccaggctggagtgcagtgcagtagcgcaatctcagttcactcctcccccagggttcaagccattctcctgcctcagcctctcgagtagctggggactacaggcgtgcaccaccatgcctggcttttttttttttttgcatttttagtagagacggggtttcatcatgttggccaggctggtcttgaacccctgacctcaggtaatctgcctgtctcggcctcccaaagtgctgggattacaggtgtgagccaccatgactggccagtttagaacttctattttaatttttttttttttttttttttgagatggagtctcactctgtcacccaggctggagtgcagtggtgctatctcggctcactgcaagctccgcctcccgggttcatgccattctcctgcctcagcctccccagtagctaggactacaggcgcccaccaccatgcccggctaatttttttgtatttttcgtagagacggggtttcgccatgttagccaggatggtctcgatctcttgacctcatgatccacccgcctcggcctcccaaagtgctgggattacaggcgtgagccaccttgcctggcccctagaacttctattttaattcttgagaagagtctatttcataaacttataatactgtgagaattcacagactaaccatgccatattcaatctgtaatttaatatactaagagataaatattttttacttgctcgaaacaaaaattatttttttaaaaatagctgttattttttccataaaatctacatttcagagttccaagggaggctgatgtgcactttttcaacctaatcttcctttattgctgtttggttgatattctgcttgtttaacagaggtatatactcttgcaataggttctgaggttaatgggaaatgtcatcagaagggtgttgcttcgtgctgaattcccctactctgtccatatgagcttttttcagacattgagttgcttaatgaagttggagtaaagattaaagactaaacatcttggggactgtcctgtgacccttggcgtctcccccttccttggtgtgtgcattggtggctccaccagtatgtggtgggtaagtgagggctgtgcaggcccatggtgactacagcagtatcagaggaggttcagacctaggacacaaagcatcagaggtctgcaagccatgttgatccttgagaatcccactgttgattgttgttggttttaaatgaaagtggctgtcttgagttccctgtatagggaaagctggagttcttccttgtgctcactgacactggttttaggcctttggtcactggttgatgtatctatggcatgacgagcctaggatcttttcagaactattgtcttctcttttctatgttggataaaacatctgaatgtgaactttccacagtaagagttctctttcgggcatttgaccgttttgctgattcagttaaataaagcagaatggcattccagcgatgatgctgtacttgtaattagcccaggtgagcagaggctcgttgaggtttttagataagtcatgagagctcgtgtgggacacaaagcttctattatttttttttttctgagatggagtctcactctgtctcccaggctggaatgcagtggcacagtctcagctcactgcagccttcacctcccaggttcaagcaatcctcttacctcagcctcccaagtagctaggattacaggcatgtgccaccacacccagttaatttttgtatttttagtagagacgaggttttgccacgttggtcaggctggtctcaaactcctgacgtcaggtggtctgcccgtctcggccccccaaagtgctgtgagccacctctccctgccaaatcttctattattgaagtctgtggggacagcatttctaggagtgtggccttcagtaatgcaatatttttcctctgtctgagggtacttggtatcagattggtcacttggtaacaaaatgcttggtgctggttctaaatgggagcagtgtagcacagattttgagggaatttgccttctcaaaatgggttccaaaaattctaaggtcacagttttctgagagttgtcaccatgtgtcccagtggtgtgatacttaggttggtctttctctgcttgctagttgttcaacatcccttcataaaatcatcacccttataactagacgtttcttgaaatattgattaatcccatctgtgcaggaaacagtagctaggcatgggtctgtttcataatcctccttgcaggatttataggaatggggatactttaaacatgtttatggcccattaaaaaatgcagatttccagaaagaagatcccaaagccagaggtgatcagcacaggatgttttataaaatttcttcaataaaactgtagtgaagagggctgtgctgttttttcacagagctctgtttagttctttagttcatatatccactgggtctgagtttttcaacatataaatgtactaaattggctcttccctgttgcacagccatcatctccttttctgtaacctgtcctggtcagtaatcacaatactgctaacttgatcatcatttggactttgaaccctctgtgctattaccaagaggtgtggtgcttattgaaatatgaacatctagtattcattcgtccccatggacaagggctttgcacaggaagcatttgagcggatgaattcgttaaatgaatggatatttgttccttgcttaggactgcttagcataggctgtgcatttgtgagaaaggctcatggttttagttgaacgtttaagaactccttcaagtcctaatacatcaggtaacaggagagagaattccctgcatagagtattttccactttcagctacaaatggaaacttaggctcagtttagattgtaaacagctgatgcatcaatcttctttatttgaggaggcgtagaagtcaaataaaatatagagagcaatctctcaacttaaaatgttttacttgggaagcaagaattgcaatctgaggcatacacagaccagtggtcttcagtatgtctgaagaacaaagacgagattgtggattttattaggaaaggaaatgttacttactgttttggaagaaaactcattggccctggagaagcttttgagagctggcaagctctgattggtgagttgactgtggtaggtaaagctagagtcactgcaggttgtttcagcagttactaggtaaaactggtcttagaggtacagcaggctgtttcagcagctgagcttgtgggaaatttaattcttggagcaggtgctatgtgtccccagtactttttccctggccccgcaactcacacattgagttgcttaatgaaaatggagtaaagactacagactaaacttcttggggactgccctgtgacccttggtttccaaggaccacaaggattttattgggtatgacaagaatgacccaatttgtataatcagcttttgcagaggtaaatacatttagtccagatcattttaaaattttctgtttattaaactaaaataaattcagcaacatagaagaattccatgacctcttttggttgtgggagccaattttatttgatagcaagaccacattttagaactcaagagcgtgcctcagatcttctaggtcccttgaacatactaagctcagaacagacaggcaggcagaaccaagcagaattccccctttaccattgtggcttcctgggatgatgggagaaagggttccattcgggaagtagaagtttcaaaaacccatcttggacagtggctcttggcaatggctgaacagtagaatcagctggaatgttttgaaaaacccagtcatctatgggtgttgtggagttgggaatgtttggttaagtgtagaggttctcaacattgcctggagccactggttcctcctgcccccgacctcttccccagtacccacccctggcctagagatacccaggggattctgattccactgcttcaaaatgcagtctgtgcactcatatgtttaatagtgcttctgttgtgcagccaagatgcagaaccagtggatcagaggcaaattttttgaataaatattgccatcaaagcctaaggaaataattataacatttataagggagcttcttgaaaaatatgcaatcaagtcttgttccctgggttgtggaggccgccaaatacatggaaagatgggcagagaacacagaataaggagaaaaatgaagtgaaacatgcatgagagagaaaagtaaatagtcaccagggaaaagatgaggaaacatgctgtgtttttaagttttctaacctcagttatagactgaatttggggaaaaacaagaatctttaaagaaattcaattgtcctcctttcctttttcttcacgcccagaaaaaattaatcttcttgactgaaagatactctattatgtgtctgaggtccccccgaaaagttattacaaacccaacagggcaagtagaaacaaggagggtgatagaagaaagctgaaggctgccctcgaccagcagaagttgttctgggatttgcaatggcctctgaggggcctctgcaggcagctccctggactgctgtttcctcatgtgtcgaataaggaaatttgaatagattgattattcttgaagtccctttcaactccctctcccagttaagggtagcctcattactgtctcctcaacattgctcttaggacatgctttagaagtcaccttccatgccagaacaaatattttgttggcatcatgatttcttctgcattgacttatgtggcatctctcagctcgccagtcttgtctcagcaagcatgccactgtatacggggaaaacaaatagatggcatcaatgtatagtcctattggacacaaaatctagagcattcatgcaccagccttgatgacccaggaagactgtatatgtgtgtgtgtagcacaccatatacatgcatgtgcatgcgtgcacacacacacacacacacacacacacacacacacaatgttcatacatctcagatgtaaaatactggcaccattgtccagcatagctgaagatctgttggataagagctcctgtgggtgcaatcactttgactgcttggctttcttggatattaaaaaaataaccacactgtaataaaacaggagtgccaaggatgttctggtttccagtgtggtgttactcgtctgtgaaaataaaagtgaattgctggctagccaggccggccacaaggcctgttttgcaaggcaccaattggatgggatgggactgcactgggtctcactacgagaggtctaaggctgagcacattttcttcactgatattggtatttgaaaagtgggattttcttctctttttccctctcctactggactaatgcccctattaagccacacatagttttattttaaataattctcattttatggtattggtcctatataaacaacttttagtaaaacctccactgacagaaactcaactacaaacttgagcaaactggactaacagtctcatacgtttcattacattaatctaaaaaatggtacttctagggtatgttctgacttcattatacattcagcttaatattctataccttcttgtcctatatttttgggaagtgagaattaataattttcaagcctaaaggccaaatttttttttcattcttataaaaattattttgattgtggactacattttctatgatgaggtaaaaatgaattaacacatgaacaatttatctttaacaggctgggcacagtggctcacacctgtaatctcagcactttgggaggctgaggtgggaggatcacttgaggccaggaatttgataccagcctgtgcaacatagacagcatctctacaaaaaaatttttaaaaataattatccagaagttgatattatattatgtggctgtcatcctagctactgaggaggctgaggcaggaggatcttttgagcccatgagattgaggctgccgtgggccaagattgtgccaatgcacttcagcctgggtggcaaagcaagaccccgtttctttaaaaagtaatacataaataaatatacttatttataacagaaaatcaaagattatcttgttaaatggtagttttctagaaaattgcatttatcagaccaaatcatatcttgagcaaactttttataagagggttctgttttgttatttttcttcctatgactctgtaaattgtgcatctatttttttaagatctccaccctttcatttcaaacttaattatattgataacttatagttgtagagaacttacacagcttccaaaataattttgtctgtgctatgttattatgttagaacaacccattgtgttggaaagacagatattagttctttttttatggttgaaagagctaagattttgagagagtatatagtggggctggttatttgaggaggagctgaggtgctgacccatttccagcccaggttctttgcacaccacaatgtattctttcagaaattatcttctttccagttgcaactgaaaagaaacatagtgcctggaagatgggggagaaaaataagagatcaagtgggagagtatgtcttctgctctatcctcataggatttctagcctctgctggaacacatccaaggactggaaacttgtgccattgttgacaagttctgtttgttaaaatggtatttcttaagttcggaagatacatatacatacctccattgaactttcacctacagttttagcttgaagccttttaactacaaaaattttcttatccctacttcacatgacaacctttcaagtaagttccaacagttgccatgtgaccccttcatagtctcttttctagggaaaatgtctctatttctttcaacttatatatgaaagtttgatcagggtaactgtgaatttaacaacaagacaccatattttttattcaatcattgccatcgttatctgtttcttagcttccacaaatttcttcctatttattgttgttgatttgatagtcttcatactgttttccacagtggctgtactaatttaattcccaccagcagtgcacaagtgttcccctttctccacatcctcaccaataaatgctacttgtttttgagccattagtgaactgatagaaaacagcattctggaccgaaaaagtagattgtctccaaaagctgtgtggataaggagcaatgaaagaaagataataccaaggcaaatacctggaggatgtgaagccaagagcatcagaggagaaaaggaaccatcaagaggttggttagtgggtacaaacagacagatagaaggaataagttctcatgttcaatagcacagtagggtgactgcaattactaataatttattgtatatttcaaaacagctaaaagagtctgggtgcagtggctcacacctgtaatctcagcactttgggaggtcgaggtgggagaattacttgagtctaggagtttaagaccagcctgggccacacaacaagacgccatctctaaaaaaaatttaaaatatgccaggcttggtggcatccacctgtagtcccagctacttgggaggcttaggtgcaaggattgcttgaggccaggagttcaaggttaaagtgagctgtgatggtgccacggcactccagcctgggtgacagagtgagaccttgtctgtaaaaaaataataataattagaagagaagatttgaaatgttcccaacgtgaaaaaatgatcactgtttgaggtgatgaatatcctaagtaaacatacatcaaaatatcacatgtacctcataaatatgtataattattatgtatcaacaagaaaatgaaaacgagaatgttgaaacaggtggaaagatattcatatagagcctttgggaaatgctagtcactggacatgggaggaaaatggccgtcttcagttgcggtatcagaggccttccacaataagcagtgttaattggcaaacaggggctatgagaaacacacaagtgatgaaaaccagccttatttctactggaatctcaggtcttacctgacttaccaccatctaagtttgcatagtcacctctaaaagtgtgagcatcttttctgtgctttgctggtttgtatataacttttattcagatatctttcactctaataagtagttctttgcattctgattagttggctttatgaaataagtcaccattattcaagaagggaaaggcgagagacaaaggcattcggcttccattagtgtttggaattacagccacacacaaattaagggtgaatgaaaacaaatgccctcctgtagctgctgctggtattcctccccacctcctcttcactctctctcctcctcctcctttttctccttctcttatttatcctcctcctcttcttccttctcctcttcctcttccttctcctcctcctcctcctccttctcctcctcctcctttgattatcttaagccagatgtgtattcttacccaggtttgtgatatgtctacccttgcctttatgttgggaaacgtgaggaagctgagcccagctcccaggacagtttggtcgcctctaatcataccatccagccataatctcaggctgaaggaaatcattcattggcactaaagagagctggggagatagctgacagaggaatgcaatggatcgtctcgctcatccaccttttgccatttgtttgattttttcctgcaatgtgttttcttctcgtcaacttggccggaatggtggtaaatgctgtttttatatgtggacttacttgaaaaactgatctatcttagtcttggactttgaatatcattaaagttctccaaggaccttgcaaatagctgcttgccaaacacaatagtttaatataatttgatctctcactgctgcttagcttctgagaaatgtgttgtgctcaaagtgttcaagcattaattaaaattgagagcactgaaattgtcagcgcccactgactccatgtgagtgtgtaggtgagtgtgaatgtgtgtgcacaggcaggtgcaggtgtgtactcacatgcgtattaacgcttaggaagctgaactttgcttctttctcattaagagttgaaggctattatctaatcatgaaaataaaaactctgatggaattaacttgatgttgactctcagtttgatttctgaagataaaccagagtcatctctactctgaaatattaacgtattctagagagtggttcccaacatgatgtgacgctggacctgcgttatcagcatcagctgggagctttagaagaacaaaatcttgagcccacccagacctactgaatcagaagctcagagggtgggtgattctgatctgcattaaaatttagttctaagtgtacccattcgcaaactctttgtggtgaagtgccagtgatttcatttttgtttttaaaatttcgtggctcagtactttctcccatctttctgttttttttttttttctgagccctacaaactttttcaacctctgccctaaagctgctttcagattttcaggtatctttgtagcaatgccccattccttggtatgtgttgctataaaggcatacctgaggctgggtaatctttaaggaaaagaggtttattttgctcacggttctgcaagctgtacaagaagcacaggcaccagcatctgcttctggtgaagtcctcaagctgtttccactcatggcagaaggtggaggggagccagtgtgtagaaatcacatggccatagagggaacaagagagagaggaaggaggtgccaagctctttttaacaatcagttacccagggaatgagtaacgggatgactaactcattatctcgagggtaacaccaagccattcatgaggcgtctgcctccatgacccaaatacctctcagtagattccacctccacctccaaccttggggatcaaatttgaacatgaggtttggggggtggataaacatccaaactatagcagcacccaaaagctgaaagtgccatgtcttattttttattttcagccttatccgtagcacgctttatggtagcaaagaggtctacaagctgtggccccaaaataatttaactttcttactgtaacctttccattttaaatttgattcactgtagagcatttccatgggtagaactgggtcaaagagaagtctttcattttagagttttgttattaaggaagaattgggtattttcatactttttaaagtttatttttggctatgattacttacagtggttcattttttatagacatctaggaaatgttaattactgcagataagattcccaattcagaagccaaccacaaaggcttttcttcttcttcttctatatatatataaaggagataatgctaaaatgctcttatgcaaattttaaaattccctagtacattaacaatgctaatgacagttaatgcattcctgaagcttctgtgtgatccaaaatattcaaaatgcttagaaatgttttaggtccaccctgcaaatatatgggaagtggaattttgttcatggaaattagttccttgaaaatagattcagtgccaagtttaagagatgaagaagagctgaaaagtcagtgtagtgcaatatagagtcttctgcggataaaggtcgaaaccctcttttcccagaccaccatagtgggtaggtacagaatctcagataatcactgcagtttggttagaagaggaaattgcccttcataaagcaacacagaagaaggtaaggagaaagtggtattagattgataggtcaactaatgataatgaagaaactttctcttgctgacggtgatgtcagcttctaccaggactaacttcagtgagcacaggaatggcattgctgttcaatagggttataccctcaggtgggatgacagaagacagaccctcgttgtttctttgctgacctagggaattctgcaaagcagaaatatgaagaatgaagatgctgactctttacagacagctttatttaggtgaattcaggttgttacatggtcttgccacaagtgcatcttattctagaagttgtctgactacttcaacatgcatttctttccttctttcttccttgagctccttaatattaaatgcaaatgaggggaggcgtgttgaagttacactaaggtttagttgtagcaaaaatgtgctttgtgcacctactggaaattcccttgtggaatctttatagtaaagcctattggggaaatataattgaaaacaaaatcttcttccaacctagaaatcctctccacaaaggtagtagagaaagagaacacttttcttatttgaataagcattaaaccagaatggtgatgcacatcacagacaagatgctaaaagatcacaaagacagaattctcttatatagccaggcagatgcaacccattaaatacatgttttcaagataaacagtagctcaccctgaagtaagaggatttgacagcatcatttgtcaaatagttcatcctaactttactagctgcttactggctttatttagaggggggaaaagcctctcatatcttcatgatagaaggtagttttgcatattagagcaaagtgtccaccgatgttaggctccagaaactgggagacaggggttctgtctcccttgatgtttgcattttaaaaagatggttccagatctttgggaacaagatccccgggtcataaagctaacaaaagccctccctatctagtcttcacaaggatgcacttccaagagatgaaaaagtgcttataggccgggcgtggtggctcacacctgtaatcccagcactttgggaggctgaggcgggtggatcacctgaggtcaggagttcgagaccagcctggccaacatggtgaaaccctgtctctactaaaaatacaaaaaattagctgggtgtggtggcaggtgcctgtaatcccagctgtttgggaggttgaggcaggagtatcgcttgaacctgggaaggggaggttgcagtgagccgagcttacaccattgcactccagcctgggtaacaagagtgaaaccccgtcaaaaaaaaaagtgcttataattacaagttttcttaggtaaagctctaagaaaaaggagaagaaaacactttcctcctgattttcaacaggaagaagtaagtgtcttatttctagcttgtattagtccttacaagccagagcattcaaatgagtaaccgctacaatagccagcaaagctacagacacccagtaagaggaactggagcctgtcccaggcttgcagatgctgagtgctcgagatgttgacacaatttagccaaaattgaggatcaggagactgccaaggacaccggtgcttgatggaactattccctcttccaagaatttaagagcaagaaaaaaactcagccatatacttggagcagtggctttcatattcaggactaggagcatttgggttctgcaggatgtgggatggaggcatggctaaggagcagccataggggtgatcggagtggccacaggggtgatcaggcctgaaaagcctgccactcagaagcctttcttccaagagttgtttattcactgcttagcaatgagatcagcactttgcctgctgcatctcacaaagccctctgacaaccctggatgaaggtactaatatctttagttttcaaatgaggctcaaagaagttcaatgagaaaactgcccagggtcacctaggtagtaggtagaaaattagtatcccacttagatgtgtgtcactgtgtcatctgaagagaagagattaagcattgggcttgctagacaacaaggatactcttcaacatataaacaatcttattcaataaaatcttattaatgccctgttgactgaggttgcattaagagcatgtggaagcttatccgatgtttccattctctggtctctacttgtgactttgctttttattttctcttctgtgctggaagtgctggaaagcacctcatcttttgtcttttcagttgttggatttaggttccatgattaagggttgtgttgctattgttttcagtactttgttctctttctgtatcccaggaagtcagcaactgggccctgtctcctacagaagcaggaagaggactgagggttgagggacttttggtggttttctaaaactgtcaatcatcctatgtgtgacaagcagagagtttcctgtatctctgttgcctaagcaaaggagcaggtgggaaagtattttgctaactagcgatctaagatgaggtttttgttgttgttgttgtcatttttgagatggactctcactgtgttgcctaagctggacggcagtggcatgatcttgactcactgcagcttccacctcccaagctcaagcaattctcctgcctcagcctcccaagtagctgggactacaggcacgcaccactatgcctggctaatttttgtattcttagtaaagacggggtttcactgtgttggccaggctggtctcgaactcctgagctcaagtgatatgcccgcctcagcctcccaaaatgctgggattacaggcgtgagtcaccacacctggccagttattctttgattctcctgcaccatctttcaattttttacacttggggcattttccctgttctcagcaccctcatcagtgtggaccaggacaacgggagagggtaaacctgaattcctccaactctaatgactttattaaaaggcttgagggggagggcagaaagggtatagtggtaacagtgagcactttgaatctcacttaccctaatcatttcttgaatgattgaaggagtaatgggaccctccttattccttactcctaaattctcactattgattgaacgtctcatacgcaggcactgagacacctcagtgaataaaatatagtcctcgccttccttcttggggcttccattctagtggcagaaatagacagtgattacacagctaattatttaattacaagtctgatgcattctgcaaaaacattgtaagggccaagggaaagcttctcctttgccttctgaaggttcactgaaaatcaactgatgaaagacaggtgaacaggagaagaggcttacaaatttgatcacagttttacacaggagctttcggaatgaagacgcaaagatagacaggaagctgtccatttttatgcttaggttcaacaaactgtggacagctgtgtggaaataggattggcacaaagggtctgatctaatgccaatacagtgagggggaaagcccagtaagatctgcccatctagattcttcttggcctctctgcagaattccttccttctgggcatggggcagcaccctctctgtaatgggaggtcttatgacccacagtcgaacaaggcaggtcaggtgatttcgttatggtcagtttttacacagaaaggtggggaaagttggagtagtagttttaggttttatggctggcttttgggaacagaggatctggttcgtatgattatgttgggagagaggatcctagtttctctggccagcctcgggagaaaatgaggggccagaaacagaagagcaggagggggagtggggagaaatgtttgcttctgaggccttcattttgggttatcattttctgggcctcagcaaaagcagattgagattattattatattaacataagcattgtggtctaggtttggatgtttctacaaggtgtttcgaagcgaatgactcagtgaaagatacaatgggtgagaaagatggttctctcacattgtcaatccaaggcagaataaaaaagtcataattaaaaatatttcttaaaggggataaaatgagtatgtattggcaatttgctactacagtgaggtgtttaaaaagagaaaaaaaattaaatgaaatgtaaaatgaaacctgggtatctataacttgtgaaggctgaggaatagaagatacttcactgagaaaaggcagaggactcccttgactaggtgtaaggatgtgctcttgagatgctgggaacaaggaagtccgtgggagcaatggggaggaccaacacacgagcagcatctgctttgaaaagtggagactgaattgcggtttgatcctgggagcaaacaccaaagaacttagagctaataatagcgaagccataggaagagcagcaacagagaagcttgggtggaaggacttcgaatacataaaagttggaacaaaataaaccaaggagacaaacggaagtgttacacaggtatttttctttataagagaaatatattttaagagcactaaagggcctttgagctcagcttttatgaagaaatctgtttcaagatagaagagatatattgtaggtttctgttaaattaatggcaaataccactagctaagacaaagctagtgcttaagagctaagcattctttattttaattagtttattcttatggatttaggggtacaagtgcagttgtgttacgcggatatagtgtgtggtggtgaagtctgggctttttgtgtgctcatcgctcatagactgtacattgtacccactgggtagtatgtgacaccccacactcctcccaccctccaatctttggaatctacagtgtctattattgcactctatacgttgctgtgtatccattgtttaactcccagttataagtgaggatgtgtggcttttaagtttttaatttctgagttagggtctcactctgtctcccaggctggggtgcacttgcatgatcttggctcgctgcagcctcggcctcccaggctcaggtaatcctcccacctcagcctcctgagtagctgggaccacaggcacatcttaccatgtctagttaatttttgtatttttttgtagagacagggtttctccatgttgcccaggctggtctcaaactctcagactcaagcaatccacccgcttcaggcagctagggtgtgaggattacaggcgtgagccattgctcccaaccccagtttttaactttttgttgtcgagcaatttcactaaggataatagcctccatttctacccctcctggaaaagacaagttttcattctttcatatggccgagtagtattccatcgtgtatacgtaccacattttaaaaatccagtcatccattaatagacgcttagattgcttctgtgactttgctgttgtgaatagtgctgcaataaacatgtaagtcagatgtctttttgataaaataagttattttcctttgcatagatacccagtagtgttattggtagatcaaagtgtagttccatttttagttctttgagaaatttccatactgtttcccatagaggttgtattaatttacatttctaccaatagtatataaccattcccttttctctgcatccttgccaacatctgttgtttttttgactttcaaataatggctttctgagtgctgtaagatggtatctcattgtggctttaatttgcacttctctgatgatgagtgatgatgagcattttttcctgtgtttgttggccaagagctaagcattctgatggcttcgtgtggatcaaatcacagctggattgttcagttttggatgccaaatataaagagggacagacaaactggcattcatccagaagagaggaatcaggatcacgagagattagaagttgtattggtaaagggaatttgaataaatgatattatctaatctaggtgtgatagctaaatttatgtgtccacttggctgggctgcagtgcccaggtacgttgtgagacatcattctggatatttccatgagggtgttttggatgagatgaacatttaaatcagtggactttgagtaaagcagattgccttccctggtgcagtgggccttgtccaatcagttggaggtctggatagaacaagaggctgacctccccagagtaatggggaattctgcagcaaatggcctctggacttgaactgcagcattgacttttctctgggtttccagcctgctggtctgtccacattttggacttgccagctcctataatcacatgagctcattccttagtataaatctttctatatacgtatgtgtacgtcctattccttctgtttctcctgggaacgctgactgatacactaggaaagcagagatgtgggatggaggcatggtaagtgtttttagatatctggagggcttttatggaaatagacacagatttgttttctatgaatttgagagacccagatccctggattgaaatttagaggctggaagttttttttttttttttttttgcttaattgaaagaagacaacaagaattgatacattgatacaattcttttttagctgattgtgagtcagcaaaattcaaaacattgagttctttatagcttccgtgcatcaccacttgtgcaaggtactgtagaatggattcaatgtgcctgttgggaattagaattataaagaattttggaagtttctagtctgtcattgtttctggtaatgcatgctgtgaagggctaagaaatgtgttcatcccacagaggatgaaacaacagacttggtcaaaaaagtatagttatggtccttttaaatggaaaaattcagaccacagctggataggaacaaaatcctgaaaacagtgacagattcagtgtctggttattttaatactactcatgtgtagacatggatagaaaaatgcagatagtagagtaccaaaaaatacctattggaagtataaaaagaatggtaattaaatgatttctataggcacacagtctgataagagagagacctcattttatgtagctcttttactgaaaatgtggcatttatttttctgtattaattcaatgtatttcaaatgaactaaaaacctgccatcttcaaggatttcattatacgattccttatgaacactgtcataaaatgagtagttaactcatttaattttttgtgaatgaaaatatgaatggtcacatgttgaatttatttttatttttttacttttttgagacagagtcttgctctgtcgcccaggctggagtcagtggtgcaatcttggctcactgcaacctccgcctcccagattcaagcgattctcctgcctcagcctcctgagtacctgggactacaggcacgtgccaccatgccgggctaatttttgtatttttagtagagatggggtttcactatattggccaggccggtctcgaactcctaacctcatgatctgcccgcctcagccttccaaagtgctgggattacaggcatgagccactgtgctcagccctaaatttactttaaaagggttatacatgtgttggtaaatagcatcaagaaatacattccttctatgttatcgttattttaattctttatttttgtccccaaaagatttacttacagatcttggatgatcttgggtcttgaatgggcatgctgaggttctacctctgggcaggaagataggtgtgaagcaacctctaacagcttgtgcggaaaattacccccaggttagcaccagtgaggcacagttgttcagcagagcaggggctgggcattgttgtagagcagagccacgcccttccattccagagcacttggagcagttggtgtttatgctgctgggttgtttttattgaggacaaacatgcttttacatttatctatcttaaaaaaaacttaaaaactcacaagacaacttccctgatatgccctgtccccctccagctaccagtctttcccttgaataactcaatactataatgccactatttttaactcctcctcatttcctcttaaaaatctcccatctgactttggttcttaccactgcatggaagaattacctgtccacatcgcaaacgacctccttcccactatattcagtggtcagttcccacttaagtctctgaaggagctcaggaaatgacaccccaaaatacaccgctttggacttcaaacttccccagtcacttggtgaacagcaaattctgagaggagctttctgagtaccttttacctaccagacggatcctccagaggggacacaattgtcatgaatcccctccctagaacttcatcaaccagggactgctggctgatatcacaggagaggatattggagctgacactgcacccagacaggttttgtctcaggctgtcttctgtcctgctaaggggccattcacccgccctagaaatcatttactctcccctaagttgcctacatccaccctctctctcctatggagagggtatataagctttcggatgtctctgggtttcgagtattcatttttctttcatgtgatgctccgtgaatgtaatacacatgtatactttttctcttgttaatctgtcttaagtcaatttaatttgtagcccagccaaggaacttccaagagtggaaggaggccattttcacccttccagggcctggcagcacttttttgaccactttctttctttctttttttttttttgagatggagtctcgctctgtcacacaggctggagtgcagtggtgcaatctcggctcactgcaacctctgcctcctgcgttcaagcacttctcctgcctcagacccctgagtagctgggactataggcacgagcccacacccagataattttgaccactttctttattgagcttccaggtcacccttccctccatctcaggggctgcttatttccttttcctggctgcctctccagcccagggctcaagcatcattcttctgccttttcctagatggcctcattcatctacatagctttaagcagaatctgtgttctgaagacttctaaatttgcatgtcagcctctgagctttaggcttttacaccaaatttcccccagacttcacctctcacgtgcctaatgggtcataaaaaccagcagagccaaaacagaactggatttacctcttccacccctttctccctgggcttcctgaccttggtgcacagaaccattgttcatcctaatattcaggctctgaagcttgcagcgacctttggtttcgttctcacttcatagctcacagccaatccccacatcaacaagcagctcgggtttcagatgcatcacatctgaccacgtctcccctccctcaggggtcccagttcagtcagtgccatcatcctctcctacctggactgcaagtggactcttacttggcttccctgcttccactttgggtcagagacacatcatgtgtcctcagagacaaattatgagtccagagtgatcgttttagacacgggtcagattacttcactcactagctctgcactctgctaggataaaaccatatttcttactgagacactggctggctgatgtagaggcctccagcctgacccctagccttgctggggtctcaggggcacattgagtcttattgagtcccagctcctttgcacctgcttctccttccctgaaaccgtcttcacccagatgttggcttgctctttgcagagtgctcttcctgtagaccttcatgctcaaatcgttgtccacactctgtgccccttccccagtatcatgatccctgctcagtcactcgctgtccacaccctttcctttcactgagatcatagtgtatgtttattggttggcatgactattatctgtctccacagctaggatgtaggcttcactctcagggatcttgtcttgtcttgttcactttttgtatccctagtagatgctctcccaaatttagatggaatgaattaatgtgggggaggagttgttcagaatgtgatttaatacataaaaaacttttggctccccactcccttcctctctcagtttgcaatggaaagtgattgcaaagtaaagatagtacagattggtaatttggtaatcactgtgtcagtgtggctcacagtggcaacattatcacatgcagattaataaattgaggtcaacagaaactgcttctgcatgcagagaatataggaggacagagaggacagagatacatatagtgttatattactatcaccaattcagttacaatgctgttaggttttgtcacctatttttaaataattgtcctgttacatctttttctttttgcggaaggcaccagtttagcatagtttgtgcaatggctgtccattaaaatcttagtaaggtgataatccaaatcagatgctgtatagcctatgctggtttaagtcctgaagtacttatctgaaaacttcgggttaaattaggaattcagaacttttcagaattcaagaagctaacacaaattgtctttattatgtattaggtaacatccccagtggtgtctgaggcaccatcccacaaacccattgtaatttctgccaaaaaaaaatatgtacactaagtagaatcaataaatttaccagtggcttcatatcagttcctgtaatttttgccactgaagaagttcagagaagaaaagattttgtctccaaatgagtttttaaggagctttattggatgaaattactgaaacattgaaacatatacacactcaaataaaacgaactggaaccgtcgcaaaggatgcagaggaggtggcctgacatcagctgagaggggaggtcagagagaacccagggagcgagagcttcatgaaagagatgcagctggagttgcactttagttgaaggactcctctgcaaaaagctgaatcctccccagcctggatccaaattctctttcctattacatttcagctgccaaaatagctctttgaatttggtgcttagaaggatttagagatactaaaaattgcagcatttcctacagagctatttgtaagaggaaagcaatggaggtagagaagtgggttgttgagaataatagggtgaacttgaaagaggaaaagatgaggattaaaataggggcaatcttcctcatgttgaaatttctgaaattcagtattctctaaggagttgcactctaatttttcttaagggggagaaaatgaaagttttcaaatcatacacgtgcacagacacacacacctatgttttgcagggaggaatagctgagctgttagagccccacacagcaggtaatctctttggcctcctcattaacactctaatcagcccttttgcagccattctaacttaagaaaaatagtaaacctctgaaatagccttaaaaaagatgagtgtaaaccacttcagtctagcttttgaacatggtgtctattgaaaaccctattatgttagctggtaaccaacgatggaggtttcttctccagtagtaactgtgtgtaaaggtttttatgcttaggactgtgtttaggagttgtgatacattttatttagttttgagatggaatctcactctgtcgcccagactggagtgcggtggcacgatctcaactcactgcaacctctgcctcccaggttcaagcaattctcatgcctcagcctcctaagtagccgggattacaggcaagcaccaccatgctcagctaatttttgtacttttagtagagacagggtatcaccatgtcagccagcaggtctcaaactcctgacctcaagtcatcacccaccatgacctcccaaagtgctgggattacaggcgtgagccactgcacccggccaacatatcaattatttggtttgagctagcttacaataaaatcactcttacaacagagattcattgtttcttcatgtttctgtaagctgcatttaagtatcataaagtctaaaaattggataaaaatatgatgactgaccttaatttctacctccctgggacttggttctagagctgtagtttggaccagcactaagtctgtcttaccttttttcccctgataaatattcagtatttgaggaaatcatcacatctccctttagcattcttttggcaaggtaaaagactactgaatccagttttggggaccattgttaaactttgctttttcagaccttagaaacatgttaaagtcttgcaaaggagcccttggcataactgtgtgactagatatgctccaaagctctagaacatgatgatgttccatgtacgtctccatctgagtaagggggggaagagggcttggctggtgctggatgggtctcattcaatgcaatgccaaactcttaacatttgaaaattatatagtagaaatacggactttcttatgaatgccaagaaactgcttgcttctcctattgtctgaatagccagagagaatacttgcacttactattcactgaaaactgacttatttggtgataacggtttggctgtatccccacccaaatctcatcttgaattgtagctcccataattcccacgtgttgtgggagggacctggcaggaggtaattgaatcatgggggtgggtctttcccatgctgttctcgtcatactgaataagtcccacaaggtctgatgattttataagggcagagtttccctgcacaagttctgtcttccctgccaccatggaagacgtgccttttgccttctgccatgattgtgagccctccccagccatgtggaactgtgagttcataaaacctctttttctgtataattaccccagtcttaaatatgtctttttcagtagcatgagaacagactaatacatatggctaagtcagatcctaagtccaggaattccccagttctccataccttccctggagctgtatgtttataagaattttctcttcagtaggagcccttttaaattgcagaagtgctttcttctgaccacagccctatctttgagggaatagctttattgagttattgtttgcatagcatatttaagagtacagttcaataaattttagcatatttagagttgtgctaccatcaccacaatctaattttataacattcactgcatttggaaaggaaacttcatctcatctcatgagtttattttgaatgtggatcttcttggaaaagtaactgattcctcttctttacagataaagacatcagcgttcggagagattgagactgcctttgttctttattccacagggcccagagtgcatcacccaagaaagctctctgaccatgcatggtcaagtataaaacagtgtacgaatgttaaactagtgttagatgatttttgtctatgctgtggggctcacctctcccatctctcccagtctcatccataactgggtctgaactcttgcttttatttattatttaaaatttcaaactatcttgtccttgtctagctaaaattgctaatgccctttttaagctttccttaaagggatttaattgttcagcagtagaatcttttctgctgtacgtgtgatttctcttggaggaagtgaattctttcttataagtgagtgtcaaggggaaagcacagaacatcaggcttaaagcttgagttgtggccctatgatttcagttccatatacagaaatccatccgcccaacaaagaaccttctaaacattctacagacttgtccaaagtgactctactgtgtagcagagcagagaaaccaagtttgtgacccattttctggcatcctaaaggatatctaagaacctagtgatgacacccccagtccctagctcctacccccatgccaagctgtctcccactcattgcctctggatcatggtgcaacttgccactccaagaagatccacatgcaaataagctcatgaaatggaacgaggtttcctagggccatgtcctactcacatttgaatgaccatagttttagcaagatcatctttttaagaatagtttgcttctttctaacaccgaagtgaaattggtagaaacagagagaatcaggatcagaattaaagagacgagatagctctggaggcctttgaggacagtcactcccatgtgaagtgaaaacaaaccaagggtagcagtggcccctaccactgggggcagagatgctggttgctagaatggcaccaggggtacagaaagtcaccttctgctcctgtgacttgcttatcccatgctgcatgggtgtgaaaggttctgatgctactctttgtatttttggtagagagacaatgaatcagcatttcaagctacaggcaaaataaataatatgtttagacatgtcttaaaggattaatacttcagaatctgagaaagcaaagttagtaaacccaacctgggccagtggtggacacactaagataaatagctcctctgatttttatttatttatttatttatttatttatttatttattttcgagacagagtctcgctctgtcgcccaggctggagtgcagtggcgcgatctctgctcactgcaagctctgcctcccaggttcacgccattctcctgcctcagcctcccgagtagctgggactacaggcgcccgccactgcgcctggctaatgtttttttttttgtatttttagtagagatggggtttcaccatgttagccaggatagtctcgatctcctgacctcttgatcctcccaccttggcctcacaaagtgctgggattacaggcgtgagccactgtgcccggccctctgatttttaaataacatgttcttggagaaagtggggcctgaacagtcagtcacattttcttcccctatctccccttccctcctgtcccctcctatctcctcccctctcctcccctcccctctcctcccctcctctctcctcccctcccctcccctcttcgaagtctatctctgtcacccagactggagtgcagtggcacgatctcggctcactgcaacctctgcctcccaggttcaagcaattctgcctcagcctcccgagtaggtaggattacaggtgcccaccatcacgcccagctaatttttgtatttttagtagaaacggggtttcactgtgttggctaggctggtctcgaactcctgacctcatgatctgcccgcctcggcctcccaaagtgctgggattacaagcgtgagctactgcacccggccttcttttttatttttacatatccttaaggactaggaaacatttgggtcacactggtgcttacattcaaacctataaacaggaattaatgtatttctttgccatttattttataaattttattactctgtgtgtgtattttaaagaagaatttctggtgagttttctattcttatttgtatctattacttacctcaatggcttgttccaacatgattgttgtgtgtaaaagtaatttgtgaatagagcatcgctgattagtgttgtcacaattgagcgagtgtgtcccagagctttgcttttcacactcgcacactcatatggatcatctgaaaatcttgtgaaaatgtagattccattcagtgggtctggggtgggacctgggattctgcatttctaacaaactccagagagatgtggatgctgcatctgtgagctgtgctttaagtagcaagttcttatagggtctacagtgtgatgaaccagacagggccaagcaatgcaggtttccccagagatgagcacttcctgcccctcagtctgtagggattaggacacagtgcctatcacagttggcttgtgggaatatattctgggagcagaggcctgcttggagaacaaatgtcctctttgctacgtttttccagcatttaaattgatccagtatgggactgtacagatagcaagaaatgcagatgaacttgggcagtgttaaaacctggatatcctccatgaagcagattgggtctggcccatgctggtggcagtttacctcctcccgctgttccctcttccctggccactgagggtttataaacttgtgaaggcgtggagactctcaggaagttgctgccacatttctctctcttacagacgctaagattccctttcagtaattgaaagtggtctgaaggctctggaaagacagaaatgaaggaccttctttaaaaacaaacgtttacagcaccttctcgaagattcaaatttcgtggattatatgtggttattctagtgtgacatgcgaagggtggataggtacctgtttttaaaaggtatttttgttttgacatttcgtatttccattatttcaaattgcatcagactgaagtcctagcaaaagtatacattacttttatctttccattcatgggaaaatgaaagaaaatgtttcagagacttttctaaaaagatttgatctcctcagtgttaatatccttagctacccaattcagaaaattacagatttccttataattggtttacttgattatttaggatgttttctgtcatcctgggggatgtagaatgtgtgtctgatacagtgattgttagttttaaacaaataagaacatgctatatgtgacacatgcacacctcgtgagctgaactggtactttaactaccacatggcacatttattcccaaagctattgggtcagataccattttctggaaataaccgagtcataaatgatggcgtcttattggtctctacaacatgaccctaggacactttgactgctgtgaaactggcacttaaaatagagtgaaatataattgaaaattgcacattgaagatttcttattcattccttattattagctgcagaaatcatgtgtttatagacctttttcagttggatatcttttgctattttaaaatgattgaatacgttagtcagtttgactatttctgccaaggcaaaaagaagagttaattaaaacacacacacacacacacacacacacacacacacacacactctctctctctctctctctctctttttctgccaaggcaaaaagaagaggtaattaaaacacacacacacacacacacacacacacacacacacacacagtctctctctctctctctctctctctctctctctctctctctctctctctctctgtctctctcactactggtgatatcatctctgtgtagccaagcagaccactacagatcattgcttttcttagaaattacagccgggcatggtggctcaagcctgtaatcccagcactttgagaggcccacctgggcagatcacttgaggccaggagttcaggatcaacctggccaacatggtgaaaccccgtctctactaaaatacaaaaattagctgggcatggtggtgcatgcctgtaattccagctacttgggaggctgaggcatgagaattgcttgaacctgggaggcagaggttgcagtgagccgagatcatgccactgcactccagtctgggtgacagagcaagactctgtctcaaaaaaaaaaaaaaaaaaagaaaatttgagtaataaaatcagaactatcctgtgtgcctcggtacagtggagtaagaatgtctgttcctcatgctgtaccccattcaaaacagttgaatgcatggcttgagaatgggttgtaaaccacagctggatttccttggccttattcttgaactgtttgtaattggtgagaaagcagtgagcccagcagatggagaatttgctacctgaggacactcggtgtcatccaggtgctaggtgatctgactctatgtcatccttgcaccagtggaagattgggttatgcctttcccctagcaaactctcatgcagcctcctggggcaccagtgcattcatcgtccgaatgcctggctggggacaagaccagagggcctgaaggaaagctggttccaggaggaacccaggctcattcttggcctcatgcatgtgagtccttaaacaccagtttgcacatattcagtgctacactaaactctacctctgcctaagttgaatggttgtctactttgatgaaaaaaaatgtgtttaatagaggacttcctcatgtaggaaagcagaaatggtaatttacagaggataagaaaaagtacacgttaatccaagaaatacaaactcaggtggatgaactgcagaggccaggagtcagggggaaataagaattagccccaataggtctgttttataagcacagagaacaacatgcatgtaatattgtgtcaaatacttctaaaaaatgaaagcttcggcctctgtttcatgaatttctccgttaaattattcagtctgatttatgagctactgtttaatgtattttagattggggaaatcaaataggagtggggtggatgtaattgtatttattacaaatgtgagttgcttgttcattgagattattataaagttggccagagaatggattgacttttcaggtcctagacacacctgcccaggaagtaacgtcactaatagtaatagtacctggaggtagcatgagcttattgatttagttttacttctgcctgaggccaaaatgtcctgcagtagtaatgattcaaatgtacctcatggaaatcaagtgaggtaatgcaaagaacatgaaatccacatacttgctgctgttgacagaaaactgttccatgccaggcaggatctagccaacaggctgttgtagattgctgataattagcttccctgaaagtcgagggggtgacctgcagacatgtcactgggttaataatttctgtttttgtttttataacttcccttgaagcaaagttctttcctgtgtccgggtcttcccagaattggctgagagaaccgacaagcaactggcttgctatccaaagtgctaaagaatcttttgcgatgctgtgtggcaacaatgttgcaatcattaatagaactgatctaaaaggaagaaagagagaaagacaagaggcctcaaagcagcgagaaaggttgctggaggtactgttccagaatgggttgtagaactcccagctggtggacccttcacttacttcctgtgtaggtagtcaacctttttcttttatctctctctttttttttttttttttgagatggagtctcactctgtcccaggctggagtgcagtggcgggatctcggctcactgcaacctccgcctcctgggttcaagctgttctcctaccttagcctcctgagtagctgggattacaaacgtgtgccaccatgcctggctaatttttgtatttttagcagagatggggtttcaccatgttggccaggctggtctcgaactcctgacctcatgatctgcccacctcagcctcccaaagtgctgggattacaggcgtgagccaccgcgcctggccctttcttacacgttattaatattaatacaaatgtgtcaccaatttcactatcatcatgcaccaaataagtcacttcctagattaaaatactaagtctcagaaggcttaaataagggcatctacccacacgatcctgaagttctgtgggaggttgtatttatctttcacaattattgaattccttgctctatagcgagaagatctggccacatgactttccctggccaatgatatgtaggagaaagcgagtgttaggagccacttgtggctgtgtctctctttttctgctgttagatcagcatgtattttaggtacaggctgtgctgtcagcctggatcccagagggaagaagacacagagcagggtacccttggtggatgctcggcaagagccgggagcaagcctctcctcctcaggcctctagggttctggaattgattgttatcacagcataactcagcccagcctgactgataacagacatcttaagtattaggatcttcagtttatatttatttaaaatgatgttatcttgtcacattgttccaaaaactattaaatgctgcttacaaaatacatccaattcagtggaattaaaatgaataaagcacataactcataacatttttgagtaaaagaaaatgagggtagagaaatcaatcaaggccaaggctgacaccgtttgatccagtaaagtgtgtgacgtgtctgcccaaggccagccacagtgccactgtaaagagggaacacattgttcacagcctaaatatacctgactgttttcatctccagcaagctctgcacacagtgagtaatagcagagtgagaattaaagtgtgctactttatcagtagctgaacaggtacataatggccctttaaataaaatgctggattaggacacatcacttaggtctccagacttagtagagtgtcttaccttccgctgtttcttctcaacccccaagtctaaattttgattcaagcaaacttgaaagtatctgcaaggcgagaaagttagctgggtctgaggagcaggctctggccaagctgacacacccagctgtgcattttggagagtgctgcaaagcaaagtctcaccagggcctgcctctctgcctactgcatgggaacaggaagcctatcagagccgacggctttgcacgtcaggcccagcaacccaagggcactattgatctggttcaaccgatacggtcctgagtgggagtctagaggtaaggacacggtgtgtagagtcagtgatgatgactcgatggcaaggtagaaacacttcccacgctcatacaaactgtaaacccaagtgggtgtacttttctttgtttaaaataaaaagaataattggctgggtgaggtggctgatgcctgtaatcctagcactttgggaggctgaggcaggcagattgcttgagtccaggagtctgagaccaggctgggcaacatagtgagaccccgtctctataaaaaattcagattagctgggcatagtggcatgcttttgtattcccagctgcttgggaggctaaggtaggaggatcacctgagcctgggaggtcaaggctgcagtgagccgtggtagcaccactgtactccagcctgggtgacagagtgagaccttgtctctaaaaacaagatgaagcaaaatgataatctcagccacctgtcaccagcttaactgcatttctccaggtctgagaaacaaattctatacatatttttatgtctctgatatcattgtatatcttataaataatggtataccatattttaattgggagtaatttttctttataaagtggtccataaaacagtgttacatattacaatcaataatctcttagatttgatgaaatgtggtaaaagaacatttaccatggcaaaaataccaccttgcatcaggagagaaagggttctatcctgaatagcccacgctgggtttaaggagaggccttagcgagcccccagcactctgacgtgtctgacatccagtctttggacaacaatcaaaaaagggacatccaaagctggcccatttcagaaaaggcaacgcagacacctgcagtccctgacatcagtgattccaaatgggttgggactctttgatcatttttaataaacccaaagtttgcagctcaaaatggccagagccacgtagtgagtgatttgcagaagcaaatgcaatgcttggaccttcaatccccagaaagcaaggatggaatggtgaaaccagctgccgccaaacagccaggcagtgggcgtcctagcgggaaagaggaatagaaggatttgagattaagcaggcactgaacacctaggagaccatccttagaatcccagtctctttatgttgaaaattattgcctgttagaaagacctgtttcctaaggcaaagggcaaggtgaacataacatccatggcattaagatgcctaatgccaggtttattatggtatgtgtatgtgcacgtattttctatcctgcatgctaagtatttgaagtggaacttgcagacaaccatgtggagtgatggattaaatttcccctttcttaggaagttcagaagtccaaggaggcagtgttcatgaatagaaggttccttcatcttggcccggcgtggtggctcatgcctgtagtcccagcactttgggaggccaaggcgggcagatcatgaggtcaggagatcgagaccatcctggctaatatggtgaaacctcgtctctactaaaaatacaaaaaattagccgggcatggtggcgggcacctgtagtcccagctacttgggaggctgaggcagaagaatggcgtgaacccaggaggcacagcttgcagtgagctgagatcgtgccactgcactccagcctgggcaacagagcgagactccatctcaaaaaaaaaaaaaaaaaaaaaagaagattccttcatcttagcggggaggatctgaaggagtcaccctggttacatctttgtatctcaccctcacaatgctcatttagtcatcggtggatccctttaaatatcaagtatgggatacaaaaggataatactagaaaataaatactaactcagccatgctatggtttaaatatcaccaggcacacaagactcaagaactgcttttcaaatccatgaacatacgtgtctacagtcattttctagctgggtaaccctgagctggttatgcagtctctctgttagtttccttatatgtgtaacataaaataacagtaatgtgtattattgaggatttttttttttttttcgagacggagtcttgctctgtcaccaggctggagtgcaatggcgcgatccctgtgatctccgcctcctgagttcaagcgattctcctgcctcagcctcccgagtagctgggattataggcacatgtcaccacgctcaactaattttttgtattttagtagagacgaggtttcaccattttggccaggatggtctcgatctcctgaccttgtgatctgcctgcctcagcctccccaaagtgctgggattacaggcgtgagccactgtgcccggcctcattgagggttttgaggaggtttaaatgaattgatattggtgtttgatgatgatgacaatgatgatgaaagttgttattaaaccatcgctccctccctgtggccagccttcccaccttctgggagatcttattcaatcttttaactctccccttttctagagctttccttctgctttctggatcacagcactgggaatgtggatctgcttttagatcagtgctttgagaagtaggagaacaactgtggtcgtggcggttggtctttgatgccagtaagcaacagaccatctgccttgttgttgatctgagtcattgatggccagattgaaagagcagagggttcctgagtcccaggtgttgcaggacgttgtgtgtgcccacaagccaggctacatggcttagagcagcagcccaagtgctccgttggttcagggggtagcaggggtccatggagaagtcagagtcctgactgccagtgtttggaggcatggtttctgtaagcttgttgcgcagcagtcaagaaagatctggactcgaggacattggtgtcagtgtcacctacctagctacacttggtctggttgttgacattgtacttcagggctgtgggtcttccagggccaggtcagaagcctgctgatcgacccaaagtgtggatgatggaagctgtggagcagggctgagggtgaggagagaaggagcccattaaccacaagctcagagtatactctgattccctaagaaggctggtccaggaccttctgagtcaagtctgaggttctgatgaagggagaccatccgcatagtagaaggtccccaagattctgatgaagggagactatctgcatggtggaaggtccccaaggttctgatgaagggagatcatcccgcatggtggagggtccccgaggttctgatgaagagagatcatcctgcatggttgagggtccctgcagttctgatgaagggagatcatcccgcatcgtggagggtccctgaggttctgatgaggggagatcatcctgcatggtggaaggtccccgaggttctgatgaagggatatcctgcatgatcgagggtccctgtggttctgatgaggggagatcatcctgcatggtggagggtccccgaggttctgatgaggggagaccactccatatggtggagggtctctgcagttctgataatgggagatcatcctgcatggtagaaggtccctgaggttctgataaagggagatcatcccacatggtggagggtccctgaggttctgatgaagggagatcatcccacatggtagagggtccccaaggtttggatgaacggagatcatcccacatggtggaaggtccagcctggcagtgtgacccaaagtggcttccctaatctttctgagcctctgtttctacaaactctaaagtgcccactcaccaggggtaactgttgatttttactttggctccacaatgtgagtgtctggtatatttccagttacatcgtaggaactcctgtgatggcatgaggagggtgagggtgatggcatcccttgatgattcctgccgaccacagcaggtacctgcagtccctgtagttcctcagggacactcctcacacccgttagggaacagttcaccacagcatccttccacgtcctctctccaggtgaactcagagatctgttcattcaacaagaattgatggggcacctgagtcattcttctaaggtagttgacattcccagtcctgattcatggttgttccatccttatctcatctgttacctgtcaccgatcatgtacacctttctatctttgagtctgttttgcacatatatacaagtaaatcacatcgaagtttaaattgtctcattaatttgtgaaatgtgattacaaaattcttgaaatcacatttctatcctattaggaaagcaaaaaggagaaaacaattttgaagcctaactcctaagagaattgctgtattacaaggagacagggatgctgtgaattcgttacaggaaagaggatgtcagccctcatgcctttgtctcccaagggcctggactttcctccacttgatttgtagagagtgcttttggaagatgggtgtgttttatttagatggtacaggtgtcagaaggtaagaggtgtgatggaagttgataggtgactgttacttgaaggaagggggaatgaagtctaaaaggttagctacacattttatctccctgatctccctatgatgcaaagaacccaagaatgtgtctttgtaacaaaaactggttgttacatggacagtgatcagagaaatcacttgccgattagaatttctccctatgtagcattccatgaaataaacagacagctgctcctggttcccccagaaaaatacagatttgtaaaaaaaagaaaaaaaaaaatactacttgttaccaaaatgttttctgagtatattcttttatcttacagaaaacatctacgtattttaaattattgttgtggaaaatgtatacacacacctacacattcattgtaagaaattccaaagtaaaagtttacctgaaattctgtcatgctgatatttattttttaagttaaatttttttttttttttactgaaagtaataattggctgggcatggtgacttatgcctgtaatcactttggaagacgaaggcaggaggattgcttgaggccaggagtttgagaccaatctgggcaacagagttagaccgtgtctctaaaaaatattgacaagttggctgggcgtggtgctgtactcctgtagctctaactactcagaaggctgaggtgggaggatcacttgagtgccggagttcgagtctgcagtgagctgtggtcgtgccactgcactctagcctgggcgacagagcaagacccattctctaaaatcaatgagtaaataaatcataaaaataaaaataattgtagatatctgtggggtacaatgtgatgttgtgatacatgtatactttgtaaaatgtgatatatcagctttaatattttggtggacaccctttaattcatctctgttacaatatacatatactgtatggaattgtgtgtgtcataaatgaaaccatggcttctacttcagtgatatccattgtaacatctactgggaaggttggatgcccagaagatatggccaactaaattactcagtgtatgaacaagaagcacatcatgtcgtcttaaaagtgattgtgttcttatacatttttattgtggatgagttagaaaatatggagaagatagaaaaggtgctaagagtataatccaaccaccctaggaagactttgtcttagtccctcagggctgctattaaaatgccatggatcttctggatagctaaacgatgggggctcctggagggtggggctttcaggtaaggcatggataccttgccctacccatctcttcctttggtgttcatcagtatcctttgtagtatcctttattaaaaacagtaaacatcagtgcacacttaaaagcatgataattgccaaaagaatagcttctgaagaccatgggttcagaggtctgaaacttggaaatcactcaagggaccctccgcctctctttctcttgcgctgtctcccagatgctgccacaaccagttgaatggtataacattaacaataacaattaattaaataaaagatatcatacactgggtagcttaaaaacagcagaaatttatttctcacagttctggaagctggaagtccaagatcaaggtgccaatagatttggtgtctactgagggccagttttcttttctttttttcttttttttttttgagatggagtttcatgctgctgcccaggctggagttcagtggcacgatcttggctcactgcaacctccgtctcccaagttcaagtgattctcctgccttagcctcccaagtagctgggattacaggcgtgcaccaccatacctggctaatttttttcttttctttcatttttttttttttttttttttttttggtagagacagagtttcaccatgttggccaggctggtcttgaactcccaacctcaggtgatctgcccacctcagcctcccaaagcactggcattacaggtgggagccattgcgcccacgagggccacttttctgagtcaaagagggtgacttcttgctatgtcttcacatggtacaggggacgaagaagatcctttgggctcttttatcagggcaacaatcccattatgacatctccacctccacagcctgatcatcctggaaggccccaccttttaataccatcacgttggtgattacatttcaaggtacaaattttgggggacacagacatttgcaccatagcagacttacattgattttgtgctgtatttttttcctaggcctttaacttatatatttcaaaacctaattagaagggtatagttgagagacaggatagccaagtggacaagagtccatgccgagggagcaactcgtgtggagaccctggacgggaagtctccccgcacgtcgattcagagaaaggtaacggaataaacatgggagatcttggtgggagaggtcagagagagcgcggagggccagaccctggcaccttacagcatcctacatacttgggctttacctccagagagatgacgtgactggaaggtttgagtcgaggagtgaggtggcctgaccaaggtttgatgggactgccctgtctgctgtgttgggaagagaccacaggtgaccaagggctgaagcagggacacccttcaggaggctgtttctctaattcagccaacaagtggctgatgttcctgcacactagggaggtggtgatcagatatgaaaaaacagcattccaggtcagataagatgtggggaatgagacatgaggatgggccaaggatgagaccaagatctgggcctgagcaactggaagaatgcagttgcttcgtgttgtgattgggaaagctgtgggagaagcggtttggggttgaagttttctgttttgcagatgttgggtttgatgtcctgggaagttgaataaatgagtttaagagcaggctagaagttgggctatcttcttaggagtcatcagcaactagatgatgtttacagccttaagatggatgagctgagaaagggagtgaatacagatagaggagagagcagccctggggaaagtacagacttgtcaagctattgatagcatatttgcaaatggctttgaagaaagacccagggcactttcccaccagcagtgggtgggaatgagtgccgtactgcacacttgtctgttctctgtattactaattttttaatcatgaccaccttgaaagaaaagcttttcttgctaaattactgtttgaattgtaatttatttgattgtcagacagggtgaattttcataaaggtattagtcatttgcattacttgaagtgaattatgttcattttccataattctaagtcaaagagattatgttttattctgacatcgtggaagccactgaacatttttaaagagcacagcatgatgcagatggctatttgggaatattaatgggaaagttcctatccttgcatcctcttttattcattcatcagtgagtctgactccagagcttcaattttctgaaaagtttggaaaaactagctttggataattattagtcacgtgcaaatgagttaactgggtattaatggaatgaaaccactgccatttcttgctggctacagtgtgaagcaaccacttagggtcatccgtcagccttgaatcaagacacagagtacagaagacagatttccatcctcttctttgcctttcttcttaaagctaattatcagctcaatcctttatttcaccccttcctacaacaaaatgggatgcactagcattattcatatccagccttctctcagtgtgtagtcagggtagtcactggtgggtcattgtcttcatggaagatggtgtgacttccatacttagaaaccagcatcctctgatgttctcagcaggatatggctcctattgtattgtattgtattgtattatatttttcaattgacaaaattgtgtgtatttttcatgtacaacatgatgttttgaaatatacatacactgtgtaatggctccatctggctaattaacatactgcacaccatggcaactacagttaataacaatgttttgtattttgaaaatctctgagagagtagactttgtgttcttaccgaaagactttttaaaggcataaaacatgagtggttcacctgctggctctcactaaatcctctcatgcaattggctcaaaaatcatggaatagacagttcagggaggcagagtttggcttttggaattgctttcaggacctgggatatgttgtaaggacatggtctcttgaatatctggaatctgcaaaaaatgagtagtggcaactggagggactgggtttggggaaacatctcttgagcttggctctcaactaagccaacagtgccaactctgcttcataggcgcagcttgttttagaacaatgtgactaatttttttacacagttctgaaagcaattctctaaaaggaattccaaaaatattttgaacagcagcattattaagattagctgtgttccatcccaaggtgactcctgtataggaaatgacgctcactgggatgtatctgtctttcttggcctttcagaagcagtctcgggagattatggtcacacttgtgtacttgcagctttcccatagaattaaaaaccctgactaattaccagaaactcagcatttaaaatcactgtggataagagtcaggctagaactataagatcatgttacccactttctgtagggaagtataattcagcatttcaaatcagaatggaggtgcttcaaagatttgccattttaagaagaaaaaaaaaaggataacattcatcagagcatttgccaagagacagtcttagcactaaggcagctctcatccttctggaagcttgacagtcttaccatgatggtgaatgagacaagttttactatcatttcaggctcattgctgtaaatgtaacctttcttcaggtgaatgtcctaggaagaaaaatattgttccttacagaaaaaacaaacaaaaaaactagttaaagtatttcatgggaaaaaaactatttaaattcattattctgtcagattccgtggagggcctccgaggctgccagaaacagccctttctttgagcacttatttctgtgataccctgagtacacaaattccttttacaagtgacttttcctcagacaacaattgaattctaatgtgtttatcttgaacttgtattatggctggtagcctaagcattgtatttcaacagcctcttaaaagtgtccataatagatgtggaaaatcaaagtgccacacatccagttgtttttcagcttttggtgccttaatttgcatcgcctgatcagctgaggatctgctgagtgcagaaacaatcttcgtgcaccggctaatttatagcatggcagaacagttgttttctagacaacttgtaaggaaactgcttctcctcatttgtcttctgatcagagctgcacaagaactcttgatcatttacaaatgacgaaagtgagacttgtaaaaggtgagagtaaatcttctatcttattctcttattgtttgctacttggctttgatttatcattttgtgcctttttttttttttttttaacagaatctcattctgtcacccaggctggagtacaatggcgccatcttggctcaccacaacctccacctcccgggttcaagcaattctcctgcctcggcctcctgtgtagctgggattataggcatgtgccaccacgcctggctaatttttgtatttttagtagacacggggtttcaccatgttgaccagggtggtcccaaactcctgacctcaggtgatctacccactcctcggcctcccaaagtgctgggattacaggtgtaggccactgtgcccagcctatcattttgtttatatgaactataagccactagcatccacaaagggggaaatgtcttctgattgatagagcttccttttcttttttgaacaaatgctaagaagtagcaacagccaaaggacaagagctgtattgtcttctctcatgtgtggcaagaacaaacaagattgagaatctgattgcattgaagaggcattgttcattaaacttcctccagacctggggaagaggataaacttcctccagacctggggaagaagataatctgttccacagaaaatacagaatgcataacattcaatgaactttgcacagggatcccagaagtcttggctgtgatccaggacctaccatgactttctttgtttccacctcctgatgatcttaacccgtgtcatatagtttggctgtgtccccacccaaatctcatcgtgaattgtagctcccataatccccacgtgttatgggcgggacgtggcgggaggtatttgaatcctgggggcagatttttcccatgctattcttgtggtagtgaataagtctcgcaagatctgatggttttataaaggggagttcccctgcacacgctctcttgcctgccgccatgtaagatgtatctttgctcctccttcaccttctgccgtgattttgaggccccctcagccacatgaaactgtgagtccattaaacctctttttctttataaattacccagtctcaagtatttcttcatagcagtatgaaaatggactaatacactgtgtaacctctaagtttcctcaacggtaaacaagattttttttttgaccaatgatctctaaaattgcatttggctttaatattctgtgatttcatgaaaatttatattaaatttgccttatgttccatacagctctaagctgtctctggctaaaatagggaaacattgtacaggcactcccaggaagggaaggacgctccccttttgttctgtccaatttgggtaaacctttgtctatgtttatttataataactagaaggaaaaacagtacaagaatattctgtgtctttatcaacagcacgaacacttctgccatcttaaataagttaatttctctggatgcttcactatctggcgttgcaccagctgctgtgtggctctttaataggcatagaggaaacaagactataagcctttcagatcatgcaatgatttctctctaccaccccatcctttaccttttgttaaaatatttgcaatgcccttcacattgccacattctctctctctctctctctctctcacacacacacacctgcatagaaacacacaccacaggtcgtctccccttcccttttagttcccccccagcaggcagatttctctccctagccatgtcctgtgcagcctacactgtgccgcatcctgggttgtttagagtcccatagggcatggattggccagccacagcctgcaggccgagcaggcccccaatgtgtttttataaatcatgtatcgtggatcgcgtgggaacacagatgctgtttgtgttcatgctttgtcagtggctggtgcaacaacagcagagttcagttgtgagggacaaccatgtgtttgctgcagagcctaggctatttactttctgggcctttgcagatgaaagaggacagccctgctgtagggtgacgccatcatcatctctaaggactgctctcagggacaccatccctgaagtgtgagggattcaggggctcccctcatctaatttgaagcaccttttgtttttccctgtggggcctggcgacagggtacttctgtggctcagcaggcagcaggcaggtgagcgagctgtggccaggtgctgggaggcctccctgtggccacatgtagccttcgagggaatgtactctgcaggggtgtgaaagcgccccttctccttttttttttccatcaaggctgttcttgtttattttgaccagataataaaataacagtgtggaataaaataatagttgtgtaaaggaagatagttgaggttctaaggccagcatttgaggttctcttccacattttggggtaactcatgtaaatacaatataagcataacttctggaagctcattaccctaaatttgacctgctctttcccaacttattatagttctagagtgtctatttctgtaaaatatagggatatgcccaagatattcatctgaaggatcactgcacctgtgtgtgtacacactcacgtacatacaaacacgagcagacactcacagctgtcatctggaagaggagagtttctaggaccacagagacagcagtgcagaccttgttttgctacaaaacccacttgcaggaaacgaggaagcagaacactgcccagatgctttgctgagtcagggcagcgggagactgtctgtgagctgcacagtctcagcatatggtgaccaggatggatcctggtctgcaggtcacatgagccgacactgccagtaccagggaggaggctcagtgccagcacgtttggatggaaatgaaaacaaggcttcggcactgaggtagcggagggtccgtcatagcccagggtgccatcctggctggaggtgcagggacagaaggcccgggggaggagctcagggaccagccccagggatggcgaatgtcctgacataacgctgtgcccatcccagtgggtgctgaggaagctgaacggcagtgctgactctgggcacagtgatagccaaacaaactcctcacttgctgggctctgcggggcagacagtgaaggggagctgcaggtcagcagacagagagggaccagtgtcccgtgcatgccagagaaggggggggacgtgcccggtaggagggggagtgagtcatgaggggccctgtccgagagggatgccggtcaccacaccgggctcctctaaccctagcgttagtcatgtgccctcagctggaaagtagacaacttctcatgtcagcgtggcacatcccagcattgaaatcccacgtacaccggcctaacctcccacccaggcttctctccctaacctgccgcacagagtggaacctgcccctggctcagctggtctccctgccgtccgaggccccgttggcccctctcgattatgatccaggcttagtggatggcagcacagtgcatggtacataaagaaatggcatcatgcttggtacatgtcattttgtttatcctttacagcagccctgggaggtgtgcgaccttggtcccctctacaaatgaggagactcaggctccgttgcagaggcacaggggcccctgggctcacagcctggctcagaccccaatctgcagacttccccaccaccacgcgctgctctcccgttcacctgactccaagcttccagtcaaagtcggctttacaaggctttggtgggctccccagcccacacctgtgccccctgatattctaagggcggttatcacttgtagctaagacctggggctggttacatgttgcatcactctccaaaggcctggcccggagctgtgctcatgatcatcaacatgcatgtgatgatctaatcagcagtctgaaatgttatttaattttcttttatttccaagaaatctaatgtcacgtgaagcccttagtccagcacggggctgggtgcagttcccttaagggggaatgtaaagctattctgtctgtaccggcatctgcgctctaatactccctagaaaataagtaggaatcacagcaaagtgcaataggatgcaagttttgtctcctaagaagcttataaactggtgggtggagacaaggcattaatatctggatgggacaagcagggcagtgatgcagaaaaaaacacctctcagtatatgaaatgttctccaggaggtcagatgatccctgtcaggagctgaggaactgaagacaggccagcaggatggctggagcggccaggatggggctggggtggggaacgtcctgcagctgttctggggagaccgcgagctcgtcaccccacggcctccacctcttttcagtgcatagatagacggtgttcccatcttcccgcacgtagacagagtctgggactgagttaatgccactgaaatgtgagaggaatagccgggcgtggtggctcatgcctgtaatcccagcactttgggaggccgagacagccggatcacaaggtcagaagatcgagaccatcctggctaacacggtgaaaccccgtctctactaaaaatacaaaaaaaaaaattagctgggcggggtggtgggcgcctgtggtcccagctactcgggaggctgaggcaggaaaatggcgtgaacctgggaggtggagcttgcagtgagccgagatcaagccactgcactccagcctgggtgacagagtgagactccgtctcaaaaaaaaaaagaaatgtgagaggaagtgacgcgtgacccttcagtactgcctccagagccagggatggtacgcttctgtcgtttatgccaacagtgtttgtgggactttgtatggcagccagagtggactcacccacaaccagagttccacagggagagaaaaactcaaggtcaggactcagaaatcttgatcaacggacttacttgcaattggcctctaggcaggtgtggtcgctggtggacttagggtcccatggaggaccttggggaggctcagatcccaggaaagcagctggggaaccagggcggctatgaggagaaccccttgactcaggaaagtagtctggtctcaagttctagggccacccttaggatagccagaggaaggctagaaagccctgtgggcctccagcttccagccttccaaaagtgaggaggtggggctgtaagattacgctggctgatggctgtcgcaaaacactaagtttattacataaaagcctcaattccctcctaactatcaccaaaacagatgagttgtggtgtccagctcatcatcattgaagaaagaacacctcctttcttcaatttgttcttttgtgttttcttccctcttcagagctaactttttttttttttttttttttttttttttttgagacagtctcacttggttgcccaggctggagcacagtggcgcgatctcgcccactgcaacctctccctcccgggttcaagtgattctccttcctcagcctcccaagtagctgggataacaggcgcccgccaccatgcctaactaatttttgtatttttaatagagatggggtttcaccatgttggccaggctggtctcaagctcctgacctcaagtgaccatctgcctcgccctcccagagtgctggaattacaggcatgagccactgtgcccagcccagagctacctttgatgcccattttcatcatgttcagcttggtgttggggaaagcacaccaggagattcctgcccagggatggccctaggacaggtcctggagctgcccctcagagtggcccactgcatcacgtgaagcaagaacgcaccctttggttaagcctgttggaattacacatgccagatcccattcaactgagggaaaggatgacataggttcaaaaaaatatatgacaggtgctacgagggctgtcctagttctctcttagtaaggagaacctctgagacaggggcaagaagctccttcctgcagtgtattacatcctattcagagtccctttctctctgaagaatatgatgagctccctgcaaaatctgatctcctccctggttggaaggaatgagtggaacctgaaaagtgtggcatttttattgtccctggaatctgatctattaccttttctgtcctctgcctttcatcttcgttctactcatgcgtttgccccagatgagcaggtaagcttttcagatctggggattggggacttcccattttagatggaagtcctgccattgggttggctgaaaaggtgcgtaaggaatctgtcagatttatcacatggaagtctagggcaggcactgaaatccttttaggaaaaatgagtttccagggtagagaccaaacctctaagtcttaaagagagcaaagcaaagaagttgacatttagatctttcagcaaaccatgaagattctctgcctgtaggtgactagatgctagaaagagcctaatggatgagttgagaaagaaaacagccgagtcaagattgctaatgcgttcattacatgcatgtgagtgctttgctgtagaaagttatcgacgtccaaccccatgagaccattactgtcccatttagcctgacttctctcacacggcctcctctcgccttccctgcaacttcatttttagtttcgtattcctcaagacctatcccttaaagaaggaaagcaaagaatggtggaaaaattcacatccataaaagggtttctaaagctaggagccttgctaagctgcctgagttgtcacattgcagagtgcacggaatggccggctgagtctcatcagtgtggtggtggttacacacgctcattttgcctgatcaaatcgtttcattaaaaattcttaagctgtagacacaaaagtactttttcaaatacatcagtggcaatacagaagtagactgtaattcatttgtgtgcacttataatacaacacacctccccaaataaaatgcattttttttctgggtgttcactgcaatttgctacaatcagaaaaatcataaagggtagaatgatgtcattttttaatatattattttcatttttcaatgcctcgaagaaggtgcattaagatcatccattaccttagcgatagtactgttagtcccatacttcatatacagtacaaattcgttattatcagttaatattgacttagtgctcaaagtgttctagataacacacagtctataaagtacaagcgttaagtcacagccatttgcaatttctcttctgactgccaagaattaatctcttattcaacaaatattgttaagtgcctgctctgtgccacagttgggagcaaaacagacatggcctcggggctcagagagtgcacagctttccagtctagcaacaaagtcagacgttaaaccaacaattactgaaattagtcttaaattatagttgtgacagagacacaaaggtgagtgtggggcactgtgaggagtctgaaaaaaaaggacctcactcaggctggggttagggattcctccccaaagactggtttctttgaatggtttcattcatttgcttgccatttatttgaatgtgtcaagtcttgtgctagatttaagaagataagaaggtgaataagacagaattctgattctcagggaactccatgctctcatatgaaagacagctatgaaagcaaataattgcacagactttcatcatatcactttattgcattttgctatgaaagatactatgctgacatgcctcctggaaagaggaaccagatggaagctacacagattagataaaccagctggatcttagaagatcagttgataacatggcagttcatacagcatgaagttttctcttactaagctaaagtcgagaaacatgcccgatcgtaaggagcatcatcaaagtggcagaaggtgtaaagggaggttagtgttttgactgtatgctgggccagccaggacaagacatggcatggctccttctcacaagtaaaatcatgctaacaatgcactgtggccctctagcttcctcctccctcttttgagtctgtctgcagggaacaggcttttacagttccaggacataggatgcagaaagcacccagaaggaaagagggaaaactcattttgtcagtccaccgaaaagctggtgctgacctagccatgacagcacttccttccaaaccagaggatctatttgaatattggccaagggtcacagacatggagttcccatatatgaaccctccgttttggctttggtgggattgatatggacaaaacacgccgcaacttaagtgttgaagtcaagtgttgaagtcaagtgcagagtcacttgactctgtagcaatattgtctcaacaatagactaagaattacttgtgagtggttttgcactgaaatagtctctatgaggttgtactaggtgggccctaattttatagctaggggaactaaggtcccagagaggtgagctgatttactccatgtttcatgacacacagaaacggggatgggaccacggtctacccaccccagctgcagtgactgcaccatgggaactatttccccttgcatctccctgtaggactctgatgattcatgttgacatgtgttaaatgccagaggtgaagactttgacccatagagaagagagcccacctggggactaagcaggacttagttaccactccagctgccacctggagtaatcttcctgtctctactctttaagccccaattcatgtaagatctgaataaaagcggtgtgttcgccaagcatatgcgcagcttcaagacaaggtgtctggccttttctttcaaccagattgcagctccgaaatctctcctgtagcgaaacctggaacttccatagacattggtgctcccatctctgcacatgggagagggcacagtctgttttccaggagtgactgattgccttcaatagatcaggaaactaaccgcggacagaatcagttctacactgattttatactgtgaatgtttaaagtgaggcgttgtccctaacggaagggttagagaaatgtgcattgcttaatgggtttcttatgaagattaaatgagttcgtgcatagcaggcatggaacacacagcagtggctagcacaaaaatgagcccttgatgtgttggaatgtgttgtcattgtaaaccagccactgttggcaccagacagcctcggggtgctagagctgcctgtgacccacgaatgccatgtgaacaaactgacacagccatggcattttctctaaagcaaacacatgaactcagcaggtccctgaccacagatgtccatggtgggaggtggtgctgggtgatgtctgtaatgaagcagagattcctgggcccctctggggtttggtggttaacaattcatcccagtagtccaggcctggatcccacagccatggaatgattccctggcaggacactgctggagagagagggccccacagactccatcacttgggtgacctttggtataaaaggaaggaagaaacaggaaacaggaggtgactgcatttatctacagcagcctcagctgtctcttggcctctggggtccatgctgcagctctgagtctttttcagaaacgggaattcaaaggataaggttttaaatcattgaccatagagctgaaggtgtatcaggtacacagcaaggtaagaaatgcagtcccaatcttttcactggagtttctgcatggataatcagaggagttttcagaacatgctagataagaaacaatctctcttgcactcctctctccctctctctgtttctgtttgtctctctctcctttcctacacacttccccaggaaagttcgatttccataagctcttgtagctgcatattttacctgtggctgggaaaaaaaaggaatgggtagcaagccaagcacctctgaagcgtttctgcaatggcaacttaaatcttctgtgaaaagatgctggatagagaatactggatgagctgctccagtgtggaatggtgcctgaggaattgctattccccacctctattcaatttagcaccaccgttgtgcatgtttcgattaaaaagaggaacaaaacatttatgtactcattcaattcaccgctgcctttttatcacgcatcttctgtgtgccaggcaccaccccacgcctggcatcctgccaatggccatccttcccagggctggattttgcctctcctctccttgcgacttacaagaatttgcatttaaactgcacacttcacctgttggttgatacccaaaaccttcttaagagggaagaaagcttcttcatgacatcctcaatgacacgtaagtgccagttccctgtgagatcttgagggtgtggacaggtggccctcagaggcattggctggaattggatcctttgctgaatgctgcatactttaggaatggacggaggagcttcctgaggtggagaggaggtcagtaatggggaggagagagggcaggaagggaggcaggagaccggtctgtaaaatcaattttcccaactaaaaatgtaatgtcaggaggtagctgtgctccaggctgctcagatgtacatctaggcctgtctgtgtgacactcttgccagagcgggctgtgtcttgtgcagtgggcacaggaaggtgggatccctgggctgctcacgaggccgccccacactctgttcaggagacctagttatgagacggctgcctgtggttgcctaccattctgcctcttccctgccacctcatcagcacttttacctgtcgcctgcttatttaaacacgtggtccagcaatcacagtgagtgtggtgctgactgttgaatgcccatgctcagggaggcccttcacaaattctcagcaaggacttctctctgatgcatggttgacctgatgctaatggtcagctggccccagcgacactctggcattattttaccccctctacactttccctagattcgcctttccatcccctttttgaccgttctgattttgtaaaagccttgtttttcaggaaataccaatatacccttaataaagttttattaataaggtgtttaaaaaggacccagagtcaatgatttcatcaattagagcacgaaatacaaaagtctgaagatccaaaggaatgaatctctaatggccagctcatgacactatgtggcagctagggagatattttcgggcagaggtcttcccttgcctctcaaattctagaagtaaacatctgttgattttgtaatcaacaaaatgtattatatgtccgagagagtgacttgtcttggaaatttcagacatcagatcaattcggtacttgagtcctataccagggccactaaaggacttccagtccaaattccatcaaatcatgtagagccctcttttttgtccttctccatttgctcagctgtttttcctcccaagtagggagggcagggctgggaagcttcatcaagatttcctttgacacgctctggcttcagatagtgatttactttctaatgacgtgcctctgttttcattccctttccagtgtcaatctcagttgcaaacacccccaggaagccacacactcagctccattcagctccagccgtggtgtgaatgaacaaggaagtgagaagagtttttcattgcttattgccagaaaaatgtgtctgccagcttcagtgtttataaaaagcaattttgcctccccctaagctagcagtgtttaataaacatgtaatagagaatgtaggtttaatatttaagcatctctatgccccgagtctgagtgatgctctgctacattctttctgcaaaagggaatttaaaagaatgatgagatccagccccggcctgaaacaaaggcagttccagtggagtctgcagggttcactctttccttccctctctcctcagatagctgctccacggtttccccacttaggcaaatgagcatctgctgtgttcatggaaatcggtccaagtaacacaatagaggctgctgctcctggtgtgtgaaatcatcccccgaattatcaattgaaggaagattgcatcgtaaagccctggagcacgagcctcgttagcacgctccttccagcacagccggggctcggtccgtctggccatgtatttggcaaccagtgtgtgctccggcccaccctcaactaatgggtgtttgcatgggtgtgcgtttgtgcatgtgtgttcaccgccactagagtgagttcttttttggcagtttgtttgaacatatactcacccgaggcgtgtgcttggacctgtagatggacaaaagaggaaggcagcagggccctgccgggtcatgtgatgttgcagcggtgttctggaggacaccaggagggatgggaaggcagcgagaagagcgtgttggggactgcggtggtgacttctcagccaccttcctcgaaggggtggccttctccttagagggatagccagtcttgctgtgacgtggactgggagggtagtgccagcacacaaggaggaggcgggtgtggtgggaggcctcacaacacacggggccttgcaggccataactaggagggaccatcagtttcttatttttgtgtgggttttttttttttttttttttttgagacagaatttcggcccactgcaacctctgcctcccgtgttcaagcaattctcccacctcaacctcttgagtagctgggattacaggcacacaccaccacgcctggctaatttttgtatttttagtagagatggggtttcaccatgttaaccaggctggtctcaaactcctgacctcagtttcttgtttttgaaagatactcaggatgaggctgcagacacaggaactgtctttctcttctttgaacaaaccaagctgttttttgcctcaagcgctttgcgttctctgttcctgctgctgggagcaccgctgtgctttgccctgtccaagatgtgttctttcccacaggtgttggcttagggtaactgactcaggagggtcttcccggcagactgcaggctctgaagggtcacccacccttgcgtacactcatgttgtaaatgagttttgaccctgctggtgccaacaactgctgctctgtgtgttcttttagaatgctgcctggcttggaatgatcttgtttctgtttacttgttgattgtgcatctgctttcttctctttttgtattttttgtgagaagacaggtccatctccctagtttttccctctacggaagttcccagccatgcctggtacagagcatgctaccaattaatatatttctaatggaagccagaagctgggagtccaatcagaaggcgaattgaggtatcacagagcaggaagaatggctgcttggactacatagaggcagtggagatggaatgaagaggatgggtatgttttgagaggaaatggatgacttgtgagactagaaatttgggaagttagaaggatagaggaaatggtctctagagagcacctcgtataagaataagaggcacagggttggcggtggaggcgcttggaggcacagaagggtgctcttcctacttttttcttatcgtaattctcctctgaggatacaagtaaaggtcttattcatgtggataaaattgccaaattttatgtttctcagaagcagttttgtgaatcagtaagtgtgaaggaaatagcccaggtattaaagggaggaatctggaaaggtttgggccgagcagcttccaggggctttgtggccttgggttatccttgtcctcgtctaacctgcatgccgtgttgactgagtatggaattttccccaaatctttgtttttattgacgtagaacacgattgattttcaatcagttgatcaaattcctaagtggagcacactggaatgtgtgtggccaccttctgagggttcatgaaaaagaagtggaaggattccaagagcagccaggctttcaccttcattgaagctgcagcctcgtccatcagaggcacagacacaagaaacatagctctgagcagaaaacacagaatacagctgttactggaaaggggtccagtccagacctgaagagaaggttcttggacctcacgcaagaaggaattcagggcaagtctatagagtaaagtgaaacttgattagagaaataaagaaacaaaagaatggctactccgtaggcagagcagtggcataggctgctcaattgagttagttatttctggatcatatgctaaacaagggctggatcattcatgagttttccaggttggggcagagatttcacggaactgagagttcctccccatcttagaccatatagggtaatttctggatgttggcgtggcatttgtaaactgtcatggtgccggtgggagtgtctttcagcatgcgaatgcattataattcaagcagtgaggggtcactttcattgacatcttggtttcgatgggttttagacggcttctttactatatctcattttatcagcaggacctttgtgacttgtatcttgtgctgacctcctatctcatcctgtgactaagagcacctaacctcctgggaatgcagcccagtaggtctcagccttgttttacccagcccctattcaagatggagtcactttggttcaaacgcctctgacatagctgagcattaagtaccatagcagtttggataagtgggaagtaattgatatggatgggcacaccaggtggggaggactttctggaaatagtgatacattgatggtaaatacgatttggctgtgccaaaaagatggagaattttaggcagagggagcaatttggtcaagtgtgaagacagagctgaccatggagcagtttaacttttcccgacataaaatgcgaatttccaagctgaagaggagcggatctagagcccaaggtggctaacgctgccataagctagtttcagtcccgtctttgctgacggtgtgatattcctgaggccaccggggatgattcacaagggtgtgccgtgattccctttcacagaagcagtttaaaaataaaatctcttgcactccctcttagccaaaggaatccattgaaagccaccaatgtacttcgctagcagtagaagcgtcccatttggtggatgatgcctttcaaaccaggatcacttactgcattcctttcccagagctgccgtaaccagggacctagacctggcaattttaacagcggaaacctactggctcacagtcttgggagcctgtaggtctgaagtcagagcatcggctgggttcattccagggctgcgagggagggtctgtctcaggcctgtcttctcggcttgtagctggctgtctttgtgttcacccagcattctgctttgtagaggagtaaaaataaaatttacctctatcttcttaagttctctagccaggccctataaactagactggcaaaaaataataataataataagagaaaattacacagatttacttaataagtcccatgtgatatggaagccttcctaaggcagtggagacctgaagagacagtgaagacctgaagggacagtggggacccgaagagacagtgatgcctcagcgctttctgtagtatgctggatgaggacgcagaggtcatggggaagcgtgacaggacaaagggagtgagctgagggtgatcggtgggaaccgcagcaaggtctgtgtgctcagcctcctcccggctgcctctgcctttggagatggggatgctgtctccagtggggcatttggagggtgccgctcacaggtgggtcctaggacctccttctggggaggcggggaagtcggatggtccttcctgcgcctgacactgctcacattcttccagcttataatattcagtatgccaaggtagcatctttgtggtagtgtgtcctgaatcacaccagcctctgtgccagtctgtgtccacatttccccttctcataaagacactggcatgttggattagagccataccggtgacctcatggtaacctagttgcctttggaaagaccttgtcttcaaataagctcatattctgaggtattgggcattgggacttcagcatatgaatttgaagggatacaatcaactcataaaattgccatgattttttttcaaataagctgctatttacttttaaaaaataaagtccaatactgtggccatattgctttctgtcaccagcaggtggcatttctatagtccagggatggcaaaggaagagccgagtgctttcctgttgttttatttggaaaatgaagcattgttatgtacgggtgagagagagagcacagattaaactttggaaatgatagtcaatggtacatgatgatgcatggagacttttgccataaattctagacatattacaggaaaaccagcaagcccacaccggttcccatggaagtcaggaatcacactggcttctgggcttgaccctgtcaataaccagcttccaggctccgaccaaaacacttagaaataggaatgttaatactgagataattgtggcccagagacattttcttctctaccttcctcactgtttttttatttttattttttttaggatcagatgagataaaatatgtagacttattcaaaaatgaacaaaatataatacaacttaaacaaaggtcccacttacctgtcctctataatatagactaccttcccttcaaaacaccctccccgagaacagtaactgcgaggaggaactttatttccttcaagcagtaatcaagcctggcccatacgagatattaaacaggcatgaaataaacaggcacaggtaaagatgactgaagaagttattctgattcacatttaaggattgacattacttcaagcaaaattgggaaagaatatgaaacaaaagacgtgtggtctctactctttaaaagctcacagttaattttgctgtatttttaagagaaaagcaaaatggatatatataaaacagattaatagacgactgaattgctccaaaatcattcattcgtttatgacacagtgcggtcctgagactcctcctgcaggcagctggggtggtctctgcccggagcatcggcatgagccgcactgcagtggagtgagtgttgcctggtgttgcccacactgatggatgtctggaagtgcagctaagtgcagccacagagattcactgtaagagcactggatcctttactctgagaaggagatgtggcagtagcgcctggtagcataggccccgtggccccttgtccctgaagcttcttccgttaacagacctcacagagcccagccctcatttccttgcagctcaatccatttctttccagtctcggagatgcttttcttatgactcaatcaagggcttgcatggtgtgtggtgctggcactgctttcagaggctgcctgatgattccgagatccctctgctactttttcgtgcctcatgcgtcttagggaaggtgtttgcaggtgaaggaaaaggtgggtagggtagacgttcaaagggaatcatgaacttgttttgtgtctcttcaaaaaaactgagcaagctgattctcacacacctaaacacgaaagcattttgttactaagctctggactgtaacaccccaaactgcatatgtccctgataaactttattttcctctaatcacttggaagaaccgagtttactgtgtgtaactgcaaggggcaaagagacattggtgagtagaaggtagaaaattcctccttgcatgaaagggaagctggcttctctgtaacaattgttgctatctaaagctagtgggaaccagctggtgggaataaactaagcgccccttgaaaggctgaaacagggtctggagggtgagtggctactctagggggatcccagcactgggttagaggccaagctggattaatctagtcaacacatctctaatgttttcctagcttgagtcagcactgagtcgatttggtataagaaagaaaggaaacatattcctgtggggagacagacagggcaagagcacttcttataaaaattagcatacagagggatcattaggctcagcctcaggtggaacaggtgcctactggaaggagcacctcggtttacctggggacagggtaggaaaggtttcaagggacaggaggcatttaagaattaaaattaaacactgaggcttctgggttgaataggagtttgtcaggtagacatggtaggaagggagtccaggcagagatggcggcatgtagaaaaataacaaggcccaagagagccgctgaaacttcatggaatgttaggtgtgagacaagaggaggtagagctggactaggaattggaagcctggttttgaagatccctgtacgttatgcgccgggagtttgtaggtgatgaggaggtatgacataagtctcagcaggggactgccacgatcacatatgcttgttagaaatatgtttgcaggtggagaagagactggtgagaagtgagggtggataaagaagcggtattgagaggtaataccacagcccaggaaggaacgcctgaagtggaaataaggaaagattggcagccccttaggcggtggactcagatggactgtagcattgcttacagagagaggagctgtgagaaaataagtgtcctatttcttaccttgccagttgggtggatgctgacctcattcaaggaaaataagaaggagcagagggcagagaagatggagatgcagacatggacatgtacaatggcaaggaacatatcggtggtggatgcagtaaagagttggctctctaggtctggaacatagaggtcgaacctgaagatcaagctgggggtcaacatgtctcgtggaatgcaagccacgtaggtgtgcgtgcggtgccctagggagagaagacaggatggagcacagggagcggccaacacctaggtgagcagatagtcttccctaggacagctcacggcagggagagaaaccatgagacttgagaagcaacagaagggaatgcagtgagggaaacatttcaagtaagagggaagaaataaaaaaaccggaggtcaaagacaggccaaagttcccattgtctatccactgcactttggtggccctggcgagagctactctgcagaaaagtgagaagtgaaaatcagagccctggggctgagaagcgcattggaggttaaaaaaacccgggggagtgagcgtggaactcgccaacacgcacagttgctcaccctagcacaggtgcatctggacgcaaagcaagggggagagtgagggagaatatctgacctgctcctgtttcagctgagattccagcgggttagaagcgctcgaggtcagtcaggcaggagctggtgagatacacgtatgggggcaaggaaacgctacgagactgaggattgagctccactcttttccactctgtcaccgaatgtgtcaccctcctcaaatggagtgacccaggtgtcggggactctgtctcagtctggatccctccccctggcagtcgccactgacatgctgcagctgctggatgtgcaaataactgatcagccttgctgtccaggaatttacaggcgtggtgagattattttattttattttatttctggatactatcctaaaccttcccacaccaaacacaagaagttttcccttgctttcttcccccactccttgccttggaacatgataatcaagaaaaactgaccaggtgcagtggcttacacctctaatcctggcactttgggaggctgaggtgtggggatcacctgagctcaggagttcaataccagcctggtcaacatggtgaaaccccgtctctactaaaaatacaaaaattacttgggcgtggtggtgcatgcctgtagtcccagctactcgggaggctgaggcaggagaatcacatgaacccgggaagcggaggttgcagtgagccgagatcgtgccactgcactccagcctcggtgacagagctagattctgtctcaaaaaagaaagaaagaaagaaaaaactactgaatgaatctcattaaccttttgaacaatcctgtcactgtgggaagtttgtcctcgtgggttgtggtagaatgtagacctcttaaatacaagacccagctcctgttagcctttgtgaaaagaatagtgttttaacacttagtatatgctcaattaatgtgatatcaaaagcaattttctaccatttgtgttatttcagcatagctgcctttcatgtgtaccctgcaaccacattgtgaaatagacattttcattcccatttcacagaggattaaactaaggccagaaagattaagaaactgtttcaaagctatataggctgctgatacatcacttatatcactaggtaaatctcactcagattcaaatccagattttaattctatcaagtatatgcaaattaaagaaagtgttttattatttttttcctggaggggattccaagaagaagggtaatcgcattttccaaattcagactgtgatgagcacagtttattacggagcatccatccccacatggggtgaaatgtggagaaccaatgtcttatgagcacctttgaatgaaaatcttgagtccttccagcagagaaaggactttttgaaaggtttatttattcctttactacattccattcttatcttattaatagttcataagtctcagctaaatctctaggtcatagtaaatcacatccttcactatgagaacttgagatgacacaagcattcagttatagcaatttatagcaaatgcttaaaattggtatacccacaatctttcaaagccctgtcaaatacaggagtcagtcagatacaattttaaaaggcttaccatagaaagctctaaatctttgcatagtcaagcatatcttaatccaggagaaaattatttttgtaaacctttcctagaagaattttatgtcctgtattacaatcttataatgtggcagagggaaggtgggaggaagggagataaatacccatgtttatctccagcctgcagcagtgaaatgagatagttcaccatgtattccttgaaaaccactgaaaataaatatcaatactaccattatcttttaaaaaaattcagtagtctttcccacttgtcaaaacacttttttaaaatcttcctttaaatttccagagtgtcctcatatctagtttgcattttatcctcaacaccacaagaattaaataagggttggtattatcactgccatttatagataaggaaacggaagccaaagaagttgggtaatttgcctaagatcacacagctatttagagatggaactaaggaaatgacacagatctccaagcatttctgtaaattttttctaagtaaaagatgtttccttcttttcccaccaaccctcaaaattccgtgtgctgtctgtggaattcatgcacagattgctgtggttcggggaaagatcatgcccaggacgtaggggataaagagggaccagacctgcctcatctgtgccctcgctgcatgggcctgggcaagtcggtgatctgtcagtatcccactttcctctccataaaatgataaagctgggaaggaaatggtaaatatcacctgatcacctggattaaactctgacttggaggtttcttggctatactgttagtcagcattctccagagaaaaggaactaataggatgcatgtgtgtgtatatgtgtgtgcacgtagacacacacatacacacaaagaaacaggatagatgagtgcatgtgcgtctacaggcacacatacaaagacatttatttcagggaatttgctcacctcatggtggtgctggcaagtctgaaatctggagggcagcctggcaggagggaaatgcaggcaggtcttccatgttacagtcttgaggcagcactccttccttcccagaagtcctcagtttttgctcttaaggccttctgcaaatcaggggaagcccacccatattctagagagtcaatctccttcacgtaaatgtcagctaattacagatctccatcgcttctataaaatgccttcacttgaacacccagacaagtgtttgaccaaacagctgggcaccatcgcccagccaagttgacatctacaattagcccttacaagaaaatgtcctttggactataatgtttgtctgtaaagtgtcactatcgcaactatgatgtgtgtttctttggacaaaatatacattagttgaatagtaaactctgaccaaagatgtttagtattaaataactttcttaatagtcaaactgcagaactaaaatttaaatttctactaaattttgtgtgtgtctacccataattatctgctgattctcatactttacatttgaaggactctaagctcctgaatacagtacagatattcataatttttggagacggtttaccagattggcacctcatgaaaatggaatcaaactgtgatgggtaattttatgcatccacttgggtaggccttggtgccttgatgtgtgttcaaacattattctgggtgttttgtgtgagtatttttggaagagagattaaatttacatcagtgaacttcaaataaagcaggttaccctccatcatgtgggtgggcctcatccaatcagttgaaggcccaaatagagcaaaagactgaccgccccagttaagagggaattctccagcagacggcctttggacttgatgcacctctttcctgtgactccaacctgttggtctctcccatgcaattttggactagccaagcctccacgatcatgtgaaccaataccttaaaataaatttcttcgtctttctaaatgcatatatcctcttggttctgttcttgggagaatgctgattcgtgcataaacaaggctgaaaggcaatccttactatcgggaaggtaagaaaaatgaatgcaaggtgtcagaagtgatggttggtgggtgtgtagcattggggcaaattgatatttaaaaattaaactctgttcggctagccagccttcttcagtcttcagactgcgagaatgtagcatctctgaattttaacagggcatcatcaagttctgtcataatgttgttatagataagatggaggaaaatcttctgggaggtaggaaaacaaggggtagattaatgtaaacctagagggaaagtcctagtaggtttttagggaccactgttctttattgtgtcctagtgaatatttgtctagatggcttcatggagaaataaaatcttcgtggataaagaaatcatcatcattatcaccgtcatcattaatgggtatgagtacttaacatggcctattttgtgctttatatgtgttaccttatttaatttttataataatacttgttagaataggcattattgttgttatttatttatgtatttattttgagatggagtcttgctctgtcacccaggctggagtgcagtggtgcaatctcggctcactgcaacctctgcctcccaggttcaagcaattctcctgcctcagcctcccgagtagctgggattacaggcacccgccaccacgcctggttaatttttgtatttttagtagagatgagattttgccatgttggtcaggctggtcttgaactcctgagctcaggcgatccacccacctcggcctccaaaagtgctgggattacaggcgtgagtcactgcgcccggcccgttgttgttattttagaattaagaatttgaaacacagaagatgttaacttgggaaaggtcacacagtggtaaatgggagagcagggatttgaactcagtaagtatgatttcagagtctacactcttaacccatgtgcactctcagatatagctactgaatcagaagatgatataaagaaggaggaagtagtgattgtgtggagtgacagatgtggcccttcatcccatcccaccaggattcctttggattgtggtcctataaaggtgcgtgagaagcagatggatgttcagtaccgcccctgggcccagttcacagctgcaaaagtaccggatggagcagacattaaccaagagtcctgtgaccgagccaagggtagacccaatacaacctggtgtaggaggcagtgaagttgacgaacacttcggctgtatcatcagggaagcaacacttagatgtgggcaggtgggggctggtccagtccatgctgctcagaccccacctgcaggggtgctcagtgtagaatcaccattcagaagggagactgggctgaccacggagaggcaggagacaaggcaggacatggaggatggacagtagtgcggtttgaggaaggcctgaaagaattggcagtgtttgctccagaaaagagacagcgaaactcagggctggggataggagatggacgagcatcatgatagcatctcggcttacagagcatagaaagcccaggtgataggtcttcctcttacctctgcagcaagttcatggtgtgactgagggggtggccacagtctcaaatagcttccccaggtgggtctctgtgtcacaggccatgtgacttcaggatcccaagatgctcattctggcacatttttcagcaggacccaaaggatcaggctgtcttcagctgctaagaggaccagtcttttgcgagtctttcttactttcagcctgtcattgggcagatttctgaagcggaacccagtcctggcagcaatctttcttctgtctcagctaatcccagcctcagcacacagtgcaacattttcagtggtcttgtgtctgtaattatctttcactgtttctagaagcaacttcattgtgcaacaccattgctgtctggaagggtcattatctggaatcggttagttctaaccagctccttacaaactgcctttggtagcaaggctcttaggatttttagagtgttaaaaaaaattccgaaacccagatatgttcttagttgtaaattctgactaataataagttataagaaagaagacttcggaaaagtgtgtttgtaaattctttatattgtttctaaatggggtcgattacctgaggagagatgagttcctgccactggtgatgttctatcagagagacaagcaaaacatggaaagctgaagtaaaataacctcagggtaagagggagaaaaacagtaaatggcatgggtgtggggttcagggtactgagatgtcagaaaaatcagtacagaatgtgagggagaaggtgtgaagagtccaaggacgccacctgctcttgcactccgaaccctccccgctcactagcaagtccacagactgtctgctgaatttgtctacaaacagaaaacaaggcactgtggtgcctgttgtatagatgagagagcataggcttggggatggtgaaatgagccttctccggcctctcagactcaggctttcggagtttttgaataaacctaagttagtccacttcccggccacatagaagttggagcagtaaagctgatgggactgtttttcatatgagatgcaaactcctcaggttatggcaagtgagggcgagaaggaggcctgggcaagagaaaggacttgctttattttacatcgctagtttatggaagtaccagccaacactgaaacttcctggcctccaatccagtggggttattcatcctactctccactctctctgttttctgatgtttggaaataaaaaaaatcagaactacctcattaacgctctctttcctctttcatctgaagcagtgtgttagttaactttctcaacaagtttacatgccctttggctaataattgtggagaggacctatgactcactgtcattagtgtagactagctgccctagaaaaattgctcgggcgcggtggctcacacctgtaatcccagcacttggggaggccaaggtgggtggatcacctgaggtcaggagctcaagaccagcctggccaacatagtaaaaccccatctctactaaaaatacaaaacttagctgggtgtggtggtgggcgtctgtaatcccagctacccaggaggctaaggcaggagaatcgcttgaacccgggaggcggaggttgcagtgagctgagatcacaccactgcgctccagcctgggcgacggagtgagactccatcttaaaaacaaacaaaaaaacaagcagatagaccacaaaatagacaatggcttgaacacaataactgcttctgttttcctgtgtaagaggttagtgaggcaggcgcagggctgggggagtgcacttgtaagtgggctttgtcatcttcacagtatttttccaatgttgtcctgaagcgttgcctcattccctccacccgagcaggtagagaacagggaggaccccatgcaggagctgttgcggttctaacacgcatcctattctcttgggcagagctcagtcactcgaccatgcccagctgcaaggcaggctgggaatgtagactaactaggtgggtgagccagggaggaggaggagacctcaccctagccccagctacacttgcaggtcgagccaagagctgagggttttgcatatactgggtacactgattcctgttgagtctgcagcctgatttattttgtgaaactctagaatcatcggaggcggggttgcatccttggtacagccctctttatcattgccccatggctggggctggaggacagcaggaacagacactacaacaaaatcagctctcttggctccaatccctgaaagcccattgctatttctccctgaacatctggcctgtttcctggggtgtgtagagagaggccttctgttccttcagggcctcagctcagcacctgcgaacacagacattaaaaaaaccctcaagaactgcttggcaagcgcttggaacacagtctgctcagtatgcaccttcccacaccccctgcttgtagtaataatctttacctgcttggcagagcacgccgttgaggggatacatcacttcacctgctgagatgagtgcagagattttctaatgagaggcatttggtggcaaaaattaattatgacatatttcaaaggcaggccaagaacctggcctcctctccgttcccatccgatgcttctggtcactaagggaaagagaatgacaataacaataagtcaggacttttttttttctgttgtataaatagcagggaaggctggggcttctgacttcagcaccacagaatttttctgcagtgcctctttccctggcacatagcatgctcgttactaatgggtcctaaatgaaccccaggtgtcctggtgctcacctgtgggttgaatctcccttgctcagtaagtgtagaatccctctagggtccacctattttggagggactcaaactaggagtcccctaattgcattcttaggagaaggatatgacttcttgagatgataaaggagacattacctgcagacatttcaggtggaaagccaaattgtgaactttttcttgtgcagcttctccatcagcacttgctgcttcaccttgcactatgttatggagatggttttgctccttaaacctcatgagccaatctttgctagcttccagcttttcttctgcagcttcctcatttttctcagcctccatagaattgaattgaagagaggtagggccttgccctggattaggctttgtcttaagggaatgtggtggctggtttcaccttctatgcagaccactcaaagtttcttcatgtcagcaataaggctgttttgctttcttatcattcatgtgttcactggagtagcacttttaatttccttcaagaactttgcctttgcactcacaacttggctaactgtttagcacaagaggcctagctttcagccgatctcagctttcaacatgccttcctcactcagcataatcatttctaatttttttttttatttaaagtgagagatgtgtgactcttcctttcactttgacactttgaagctattgttggttgattagctggcctaagttcaatatcagtgttgctttttgaaaagagtaaaaaaccatttggagccaaatcaagcaaatgaggtgtgtgatcaaactctaatcacttagatatctgatatcacttagatatctgatatcataaagtaaaactttatgaagtttggggtacctgtggccatttcttaaaataagacaacagtgaggtttgccccactgattgactcttactttcataaaaggttctctgtggcacgtcatgctattttataacattttacccacagtagaacttctttaaaattggagtcaatcctctccagttgacttccttgtgtacgcataattttataattcaaaggcctagttttagttggacaaaaacacattggtcacattcttaatagccgcaccccaagtgagccaggaaaaatgcttgtaggaaaaagctgtaggaatgtgctcttcaccttcctgcaaaagattagggatggttgatatgtgagggaaggtgaaagctggaaagagtgagtgataccgaactttattttttcataggaaatacaatatttccttcactgagctgactggtcatctgttggaccccagcccagctcagcttagcagcctgtctgtgtgtgcacgtgtgtgtgtgcatgtgtgtgcgggtgtgtatgtgtgtacatgcgtgtgcatgtgtgtgtgaatgtgtgtgcatgcgtgtgtgtgtgtgcatatttgtgtgtgatttctccaggtgccctcatactgtgtggggacaatgagttgattgctcccctgctgtgtcactgggtgatctaggattatatcactgcctgaggacatgagtaccttttcctttgctgtcccctcaggaaaaagcccagtgtttcacagttggctgtccaaagggaggactgttctccaaccttcctaaaggcccatgtgtggggaaggatggcagtgcttctgacattgggcatggcaggtatgttaatgaggcagctggaaagccatgcccggctttgggcttccatacatgtgattatccctaacaccttcttttatgattattaggctttgaaaattgctctgagctatttttaagaagtctcagaataaaaagagatgatctgggaaggtgagaggagccgatgcccagccactgttaagaacaatggtgtttggcatttatctaggtctctcatcatggttcaggcaggaactccctagccaggtggaacctgtggcaggaatccacaagctgtgagttcaagcctcatgccagctgcctaagctcctatgagaagttggtagatggttcatgtcctttttcctcatttttttattttatttttttttaccagggccagtcttctgtgtaggcagagtgggcagaggcacagatcgtgtgattctaggtttatggagagcacgctcttttcaaagagcttccctcgctgctgtctgtgagtttatctgtgacctgctacagcagcagtccccagactttttggcaccagggactggtttcatggaagacaatttttccatggaccggggagtggggtggggtgggatggtttcaggatgattcaagcacattgcacttattgtgcactttatttcttattcttattacattgtaacgtataatgaaataactgtacaactccccataatatagaatcagtgggagccctgaacttgttttcctgcaactagacagtcgcatctggggatgatgggagacagtgacagatcatcaggcattggattctcataaggagctgacaacctagatccctcagttcacagtagggtttgcactcctatgaggatctgatgctgcagctgatctgacgggaggcagagctcaggcagtaatgcgagcgatggggagcggctgtaagtacagatgaagccatcattcatggctcaagttggggacccctgtgctagagcacacacacagccattatatgtcccctcttgtggctgatttgtttactgtgggagcacagactacactgcagaggagagcagagctggggggaaagaaatggcggtggcatcactttgctgggaaaggctgtcttgttctggaggcaggataaaggcagcatgaatgcttctccagaagactttatcttacaagagcctgaatggatgactagctctccaaaagtaaagcactggaagggaagtgaggtgccaggagataatagttttgaagactagtcctgtgaaacggtgtttctttgtactccaatggcctattttaaatccttatcctatttgatactgtctgcagaatctgatgctagtgactccttcttcctttctgaagctcacttcctccttcgctcctgtggtaatagccttccttgccttctctgcaaagttttcaagttctcgtcttttgtgcttctcttcctctgcctgaactttcaatattgacgtttctggttaacaatctaagatcatatggtcactgtgtgatttatgttgtctactccttggtgtcacaaccacccaccatcatgccgtacagtcggtcccagccccttacgtgagctgggtttttattttggaacttcctaacaaacgtttctagatgaagcccacagagacccgatgctcaggaagtaaacctgtcaagaagccaacacattatttgctcctccaaatgttcttgtttctctgtgtttcatgtcttggttactggtactatcatccacccatgtggaaccatctagaagcctaagaatcaccttcagacaccaccttcccaccccacaaatactctacatttta

SEQ ID NO: 188 - DNA, 225790 bp, Homo sapiens
agcgtccatacatataactgatttaaacttaacattcttcctacacttttacagatcacatcagggaaaaaggaagattttcatggaataaattaacttacactaaaaacaatttgagcacagaaacattagcagaatgaatatttatgaatttgcaattaattttaccgattttattgtgtattacttactatgtaatatgtgactaatttaatgtactcatttatgtaatagatgtctacagaggaccaacaaggggcccagcactgtgtaagtgccaaaattacaacaataacagtggcaaacaaactccctattttcatagcgttaatattctagaggaggagctaacatttccaaaggcagctccacgttttctatgacctataaagaagaggtgagatgatgttgcctgcatgtggctgagtgaaaggcagccagcaaagacctctcagaggaaggaaattgacacctgacctgaagcccaagtgcatgaagaaactaagctacgaagagggacagagaggaggtcagtgaggctacagcagggggtggcaaacgttttctataaagggacacatagttgacgattttggatttatggcccagacagtctgtgtcacaatgacccccttttatttggcaagtaaaaagcagccacagtaatatgtaagctattatgccaataaaatttatagatggacaccgacatttacatttcatataattttttgtgtcacaaaataatgtttttttaattttgttatacccactgaaaagcataaataccattcttaggtcacaggctgtataacgcaggcagtgggctgggtttggcccatgaggcgattgtttgcagacctcgggccaaagaccagagagggaagaagatgagggggctgaggtgggctctaggtcactgtagaccttagagaaactagcattttgttctaagagaattgcaagccatggagggaatttaagcagaggagaagcggtctgatttatgatttcataaagttccctctggttgctgtcatgagcgcctcataataggcaagtgtggaagcaggaatgctgtttaggaggctattctaagaggctacaggtgacaggtgcagggtggtgggggtttcaacccaggtgagagaagcaagtgggtatgtgagtgtatgaacataccatattatatctgttcttcctctgcagcctccagcctggctctttaaataatcaaaacttatggttgtagcaataaaaactagcctactttagatttcagcttaattatattaccaaccacatacatgtttaatctcttcttctcgatttaaacgaaagcaaggacaaatcctctgttctctgctggtaaaagggatatgtcaaaatctccagccacgagggggctcctgtcatcatgcctcatgtgttcataactacaatttatgacgcctccttctgtacactgatttcagttgaatgcttctagagaatactgttgaactgagtctgatgatacagatgtttgcattttatgaaaaaacaacattctaatgcagttcatggatatcctccacttttcacaagttgcttttgtaggctagtggtgtgttcttccccaggcagtttgcctgatgccaaggacttagatacatcatttgccatcagtggaagtctgaataggatggagggatatataaataagtcaagaatgcgtgacccagagtgacatattatactggaatgatggtataccatgagaatatgtggcataaggtagttagaggttttgatgtcctatgtttagcagtgatttttttctgtaagcacacggttgttattccaaagataatatgtactttcaagcataagtgactttatttcaatctatagtctctttgagtaatttttattcttccatttccaagactcatgtcgtgttggggcaatagagatagtgtactgtagaactgttagaatcccaaatgcctccccttgcactcatggaagctcagatgtggggtggtattagaaggatatacttgcttatttctcaatgtgacacagctaaggtgcatatcattttcctttgccgtgtatggaaaacttagcactcatcttcaacatttgtttagagatttgggctacatggtatctctggttgaggcctggcagttttcatggcaatgcgaaaatgttgattgaatgacttcctaaagtattcatctcttgcctgtgcttcagtggaactgcatgcacgctgcaaaggggattttccagagttgtggatgcaactaatctcctaaatagatctccatctctagtcctccatcacccaactccactcatgtcatacgcaatctaaaacgtaatcctctttttgtataggcataagcatgatttacaaactctcaagatttaaactgaaatggaaacaataaaaagggagaagccagccgggcatggtggcccacacctgtaatcccagcactttgggaggctgaggcgggcggatcacttgaggtcaggagttcgagaccagcctggccaacatggcaaaaccccgtctctactaaaaacacaaaaattagccagcgtggtggcgtgcctgtaattccagctactcaggagcctgaggcaggtgaactgcttgaacccaggaggtggaggttgcagtgagctgaaattggagtgtcactgcactccagcctgggcaacagagcaagactctgtctcaaaaaaaaaaaaggtgggggtgtgtggggagaagtcaaattcacctatctggctttggaatctctctacactacatagttggcatgcactcatgtcttgctgtacaacatggtcctaagtaactctatcataggactgaaaaaccttggctcacgcatttcctaccagtgggaccaaggacaatgcattctgctttcatctctgcagcctttaagacacagctaaccctccagcataaggatttccatgcctcacattgtcttaaaatatctgttgtactttttgccttgtactttaaactcccaacttcttggttaatagtgtgagtatgggccaggtgcggtggctcatgcctgtaatctcagcattttgggaggccgagatgggtggatcaccttaagtcaggaattcaagaccagtgtggacaacatggcaaaacccggtttctactaaaaacacaaaacttagccgggtgtggcagtgggcgcctgtagtcccagctactctggaggctgaggcaggagaatggcttgaacccaggaggcagaggttgcagtgagctgagattgcaccactgaactccagcctgggtgactccatctaaaaaaaaaaaaaagtaagtacatcccatctcctcctaggaaagattaaaatatatttaggaatataatggtaaattaatttctttctatgctaatactgtcagccatggtgtagatctggagcaatgtgcttaaccctctgggcctcagttttctaagtcaaaatttcctgagtctcagttcatttatatgtaaaatgaggataagaacctccactttacttgcttcttctaaaggttaaattgtacaataaaatgaagagcccagcagcatgtcacgcatcagggattagcatagttgcatatcaccttttggtttacatagaatttcacaaatattatctcatttgattcttgaaacaatgagatggccagaacatgttgttttgcatcattttatagttgagtaaactgaagtcaggagggcctattagcaagctgcatttgctggaactgcctattcaataattatttaataaataaacaatttagggcaaggagaatgtgtcttttcatatagagaaacaacgtggcaaatgttaatccagttaagtaggtacatcttaatgctaaatgattattcgggtaaatatagctggagcatttgtattttcactcggcaataactattagcaagtactctgtacaatatctcagcaactcaatacagtgcaaggctcctcttgaggaatggtagtattaagagagaagtaagcaaaattgacaaggaagaacttgtttatcttggctaaagtaacatgtaggtgccccctcattcttgttatatatgcagataacagattataaataggtgtgatgttagtgaatccagaggggaactaatggaagaaaactgaatttatttctgtctaacatattgtttcttgtcagtttccttcctttgtaatataatttttaacaaaatgcctgacaagtaatttagtgacagatgtgattaatgctgacgtggcttttaagtagcagtgaacagttagaggaagcattgttgtaaaaataaaggctgtcttcctggtgtctttcaaatacctagaaaactaaaagactaagtttgccctctactggaattcagaattataccactggcggttttatgactgtgtggaaaaaaaaaaaaggatctgtgtatttttcgtttccaggttacaaattcaagcctccttttaccaccttggttaatccgctttagtattagttctatacatacataagattctgtgaaccaaatgctctcaagatagaatttccattcccatggaagccggctgtgagggcaggtgatcaggtgctctacacaaggattacagcaggaattttggctctcctactcattttgcaaaatatgaataatcacctaacacacagtctggggttttagtagtttttgattggtgttaggaacttaaaataaccccaagaataaaattgtgccagaacctagaacatcatccaacgattggttttgaggacagacctaagagcagccaaaagggaaagggggtgttacggaggcagaaagctgcttactggccttttctaaaaactgcacttccagttcactggctctgagcatgcctggtacaacagtccagggggtggaattattacggcagctgccctgggaccagtgccagtagaggtctggagactctagggaagataaaggtcaaaaagatggatcacaagacccgtcagcaggaagtaaagctggtttaggcaaagcaaagtgcagccctaatttgtcctctccttctggctaaacatcatttagtcttcctcttccttatctgatctccaaacaccaccagccaatgcctatattttgttgtaacatgaacatttatacgtgcacactcagtggtgcacagatttcagaaactggaaaataggacgtttgccacgctggaggccaatgcaaatcaacaaatcaaacccttgtgtgcctctttctggctcagatctttttcacaatttatcgcgtttggccaaaggttcagagagaaaatagatgcaatattatctatcaaagctagagtgagcatttgtacgtggggtgggggtacagggggaagaagagtgcatcccagaccctattttactctgatatttagactttagtatctaatatagcagtttgctctgattttaaaatagccagggaaaagtgggttcaaaagttacctatgcctccataaaggacattatataatttatctttgctggtcctctggaatagtagaaactggctcctattatctagatcaaggtgttttattgtaaaaagagaataatgacatttgttttctcagtttgtagaaacatagtcagtggattaaattttatacatgtttgagctttctctcaatatttttcataaaacgtaggtagcctgccagtacttatccctaccagaatgaagcttcttacagtctctgataaggcatgatgcatgttttgatgtaaatattttaagtttattgtagcatttcatgcccatgatatattaaaccaggtcatgaattccagggctctgccccatgaacaatattagactcactctgacttccagttaaaattactccccaggttcagataaattgtgaaaataaaagatacttggattaccctctatcttgtggctcataagagagtggctgctgcggaggctggtccagcagcatccttggtcagtcagggccatcggtgtgcctacatcccaggcggagggatgcaacgtgctcattgtaatcatcatgccacaccgccaagaaaatatttgacactgagatcagaagacagggattcatagagtttctttttagatcataatcacttctaaaccatggggggttaaataggattctccttcaaggaaagtgaaaacttttgaggtgttttctttctcaaagtatacaatttgtccattacaatgggatggtgcacaattttatatctactaaaaatgtgtttttttttgtttttaatccaggatattcacagcaatagctgccaatgtttggccctcaacaatgggtcacaagtattatgataactaactaatctagcatcgctacaattctgcaaggcagatgttcttgcctcaagctttagttaaagaaatagaagcccagacagcttaaataccttaaccaaattcacttagctaatcaatatgagacactggattcagactcaggtttttccaatactcacactcatctttgtgccatgctacctttccaggaaacctgttaattaaaaatcccttttctactcagaatatatacttttcaatgctaatacagaccgattttcctactgtcttattgaatgtatagagggtcactggtaacatcaaataacaatgcccttttccagatctttgtagttttttctttgtttttatttttgttttgagacggattcactctgctgcccaggctggagtgcagtggcaagatctgcaacctccacttcccaggttcaagcaattctcccctcctgagtagctgggactacaggcacctgccaccatgcctggttaatttttttttttttttttttttttttagtagagatggggtttgcccaggctggtcttgaactcctgacctcaggtgatccacctgccttggcctcccaaagtgccgggattacaggtgtgagccaccatacctctttgtagttcttataaaagtccactacctgtgtctcaggcaggtattattgaagctagttttgggaagagagctacttcagaaaagaaaggcaagtacaatcatgaacaggtgtcataatagggccagtataaaatttctcaagatggtaggaaaaaaatgtgtctacacgttaaaccacaaacttcatactgggcatccaagaagtggaccagaaccaggaatcccatgcataagggttccactggattccacactccaagcagcagttgactgttgagtcaaggttgcaagggaccagagtccacagccacaaacccagtggaagggtggggaattctgccaaagagagacaatttctctctcctccatgctaggctgtcctctgtgtttcagtggagatttcagtgaagaattcagtggaatttcttcaccctgatgttgaaattagcaggaagttacccctggataataactctgcccctgattgactcaggtagaaagaagtgagaattgtgttaccatgtaactattgttgaaacagcaaggtgaagacaaagggaaacatgaaaataagagaaagagaatgggatactgagtaacaaaggatgtctgtgagaatcattgagaggttccactgattaaaataacagaaaccaagttaagagtgaaatagcgtatagtaagtattttatgtcacctcattccatcttaatgccttggtgtaagaaatgagaaacgttttctgaaactgtaacaagcaaacagttaatggctaggtcaaagtactggaaatcacatttggcctgcagctgatttttccagcagatgacatttgctttagcttaaactaaaataaaggaacattattgctctgattgttccagcttataagtgaaattctttcccacttaaaattgaaaaattaggagcattcctggcacgtgaatgatattcagtacccaacaccagtggttctcaaatgtgccatttgagtcagtttctaaacgttgttgaaactgattgctggacccacctccaaagttcctgattcagtagatctagggtagagcctgagagtttgcacttctaagaagtttccagatgctgctgctgctgctgctcagaggaccacactggcaaccactgctctacactaatgtgaaccgtggcatgtgtctcgctatctgatgttactcttctgttttcccccattggaaacaacaaactatgaggaaaaaatatctgaattcttacactggtatcattgactggaaaaaacaaatagtcattaatttgacaattgtcatcttttaatttggtgggttaaaatctgacaggatgtgacgccaaggcatttcatccttagtggtcccttcgaggtttcacacattatttctttgctgagaccttgagagcacaattacttgccagaggttttgcaatgcaatggtgaggaatgcagaatgttgggttcagctgatggaccctgaacgctaaccagaaggcacacgtgtgcacacttaggcttagagtcctcttccaggctgactagtccaacctcagacagccacaacagtagggagaagtcccactgggcaggctcctttctgaagtcacagctgcatggacagatttctctcctacacctgaccctctggggtagaaaaacacacgttttcacagtagacatcaatagactctttcaagttaatttcatggaggaacctaaatcatcgcgtgctcatggatccagtggttctcaacctgtcctttgcatcacagtcacttggaggactcactggaaaacagcttgctgggaaccgcccccctgtttctgattcagaaaatctaggtctgattctaggatccaaaaatgtgtttctgattcccaagtgaggttgttgctactggtcttgaggtccacatttggagaactgtgggtctttatccaaaatacatagaagaattctacattgacaaagtgaagatgcttgttcccaaatgctggagatgtgtgattttggctttgtccaacaatgaaagctctacatagccactgtgtcctggagtccttatgagagatagacagttttattggttgtagaaatttgcaactttgtacaaggggcaacatttacacaagatgcacatttttatgaagatctcttctaaaattttgaataatattccatttcagtgtgcttcactaaacttgttgcaaacgtgatttcagtaatttccctactttcaattactaattgcattaaaatatcagagaaaaaaaacatactgtgcagcaactctcagtccaggaaagaatggatatgtagaaaggattttttatataattttaggtttataatagaaactatagaactgaattaaaatgtaatttctagtaaaaattcttactcttttctaaacgcaactcacacatattaccctgtaatttgattttggtacttgtatgaattctggtgttaaataggaattttctgagagcagaataaagaattaaaaaaaaaactgctctggatgctttaaccagtgcctcaaatgtaataattaatacttattcactaaatcaaagttttagctctacttcttcatgtagaaaagtgacttggaaataaacagtcagaactccaaatgtaagactttgagatgtaaagagactatctgaagctgaaatcacctgtcgggaaaccatctggatagagttctgcacttaggggattactgtaagaacttgaatatctacacccaaataattcatggaaaaagacagcggacatttctacctaggactcagtaactgttcatcaaaaggatcagggcatgggtaatatttgcctctagcaataatagacgtttccttccaccccggtccttacttaatataaaaagaagttcaaatgagggtttctcgtctgagctgagcctgagaaacaaagtgaaaggcaagcctgaggagcagtcaactctgtgtccagttcatttgtgaaatgagccccaatgaaataaccaattaaaagctccttcctgtgaagaaaaaccagcaaggtctggaaatagcagaagagccccaaccccagcacctgtcagcggcctgcggtttgagtctcaggcaagagtcacagtcattgcgtcaccaataccactcgtttcaccttaatggatattatgtgatgatggggattacttcaacatggtgcagaatattttggagaaatgaattcccaggcttcaaacacttaatatctcattgcttatacacaaagatgcattgtcgttttgaaagtcagaatatcagttatcactaaattatgtaagtaacctccaggaaatttcacaaggaaagtctcacctcacatgtgacaaatgatctggataattggagtgcccttcttcaagatccaagatttcgtcttgttgactgccctacctgctttttcatccccttccagatgccaagttcaggccgctcgaactcatttttcttgtgctgaatgaggcttgaattaaattctctaaacacaaattaaagggtatctcggcattaccaggaagatttgtgtcttgtgaaataatgggatggtttgagtcaaacgagtttgcaagaactactcaaaccaaattggttttgcccatattttaaaatcttttcacatttcacttatatttccacacaaatgcataaatcttaaagcaactagagtcagctggaaaaaagaagtgttctaagcatttaccgtgaagaacagatcgttaagaaagtaggctgaggaaaattgggaagaatgctgaaatgagtagcaataactgatgagctatgctgatctaacacactccaagaaaaagaagactagcagtcagttgacatggtgttgtttctttctatgcgttatattcgttttgcttaagaaatttcctaatacaaaataactgtgtcattcttcgtttctaactaaattcttctatatgattctctaatttaatgtgtgcccaggtttctcttgacgtttcattgatgatccagtggcaaagaagaagaaacgatactaagatggaaggagttattgtgaaaatgtacatagataaaagcaggaacttattgcataaacatgtcgttcctataaataaaaatcaaacatatatatgtaagtcttctgatcagtactgcaaatttgccctccagaaaggttatgcaagtgtgcagtccaagaagcattatttagaaatgctactaaacaggttggcattgctttgagaaataactcattattcgtttaaatagcatttttaatttagtttcattatatattgtttagttgtatttcttctttgtaatttaccattctttatttgcaaatcattttgactacaataatcaataattaatatatcaactgttataattcaatattcctgtagttaatattctcatttgccttataggtttttctttttttgtgtgagatacagggttttttttatttttctattttgcattcaatcttttcctttatggcttctgcctgtttaatcatgtttaaaactgcctgtctactgtaaaattatataaatgtttatcttaattacctcataatcattttatgacttcagtttttacatttaaatcttcaaaccatctgggttttactttaccgtggtaagaaggatgagatagagcttaatttttttccaaatgattagtaaattatcacaaaaccttttgaagtaatgatttcttcactgattgattggaaattcacttatataatacattattatttatagatgaagttattcagagacaaatttaagctcagaaatagatctaagtattggaagtaattttagaacacaggaggtgttctgataatattcaaatctcctctaaaaatttttcattgatatcacttgtttgagtatctccaagattttgatagaaagtattttttattggaagaaaatcgatgcccccactcacccacctgcgcatgtgtgcatgtgtgtgtgcacgcacatacacacatacacacaagcatgcacacacacacatgcatacacacatgagtgcatacacgagtgcatacacacgtgcgcacacacacgagtgcatacacacacgagtgcatacacatgcgcatacacacttgcatacagacacgtgcatgcacatatgtgcatacacacacgagtgcatacacacgcgtgcatacacacacgtgcacacacacaaatgcatacacgcacatacacacgcacatacatgtgcatacagacacacacgcatgcgcgcgcgcacacacacacacacacacttcttacttctctataccaaaagctaacaaagagtttctgtaaatgtttcaggctttgtggtcccagcctctctcacaactactgaactctgaggttgctattgtgggatctcgccagcaccccacaatgcaacggggctctctctttgttcccaggtggatcggcaggtcgagaaataatagacacacaagatagtgaaaactgggtccggggggtcaccacctcctggacctgagatgccaccaatgcactggatataccagcatttattattaagtttagtgagggtgggggtaggttagtgagggatttagggtcatttgattatgaggtgagatggtcacatggggatgaagtaattctttaacataacatctgtattcagaagtacagtatgcagagataagaacttacaatatagtgtgtgcattagcaatttctaacagagccttaaaacagaaacacagtctttccataacctatgattagcaagacattaatcagcaggaacagttgcagcaaaagctggttacaaacaatccatagaaacaggacgtgaagctagacaaccggtcagaccagaaattctcggaagggagtatgccttaaccctaaagaggcctagaagagctgcggcaagatgagggcgtttatagccctatcttatccatatggacaggtgccccccatgcatccgtttataggctctccacaagggtcgcattccattcccagagctatgaacatctgcttttctgggataggaatcttggtgatgtgaaacctccctgactgcacgtctgttcataggctctcttcagggggaagcacatcacccgctgttggctcattctggcagtccaacctggcattgtctttacacaatcctgcatgcaattttgtatttacaataatcaggagcatttcatcttttattctgtagcagtagtttcaggtctccctacaactccccctttactctgatttaaatgaaccatagcaatcatggcttggcgctgatcctgattggattgaagaatatttttttccaattttacacatgaacaataaaccaatagcacaaattatacacagaacaaaattaacaatagtggatcctcccaaagattttacccattgaatggggttgagattagataacccctcagagatacaaaactctgggtgacacccaatgaaccattctgttctaatcaaccttgatttttgtacattacaattagaaccattgatgattttaacatgtcaggaaaagccttttctttttctgatatttttttcaacaatttaaagatgtaaaaagcattcttagttcatgggtcatacaaaacaaatggtgggccagattcatccggtgggacatcgtttgcacttcaaatattggaagactcttatgatagactttctataatctgtagttggaaattaatgcactttttaaatataatgttttgaattggaatgggcacaaattatttgatgtgacttactatcaagttatataaacaactgaactctaaataaaaatataggctcttgagtgtggtagaagtaaacaaaaaatgtttgagtatttgtcacccatgtaaataaatttatgcatccttcaatgttgctgtgaaatatttggccatccaggcaccaggagcaatacaaggaggtatttagctttcatttttgaattaaaaagtaggacattcaccagaggaaacataatttagaaggaaaactttaagaagaattggctttaacagatggattctgttttgggaatgatcatcaatgtaatagacaatgtattgtgaatgattttattttacaactttttattaaaatgtactatattggaaatcttatattaagaatgcttataggtcaacctcgcttttactttagctataacctaatgtttaataattatagtagttttttcattaatatttcggtcaacatattttaagctagattattaggtttaaaggactgaattcatgttaccatatattgaagccctcgtttcataaataaagcttattgtcttaataactcttttgtctgacattaatatactgctataataactcttttgtctgacattaatatactgctaaacttttgatcagtttatcctattatttttattccatatcttcaatttttctcttatattttagatatgcctctcttaaacagcataaatctagattttttttacatttcatctaaaaatttcaatcttttaagtttatatttaaccatgactgtaattactgatacactggaattcttctatttttgtgcttttcatttatctgtcatactaggctaagtgtttcttcttttgctttactttataaaccaaatcattttcttttctccactagtataaggtgaaatattctatttctgttctcttgtggttacggtaggcattttgatatacatatttaatgtaataagttaaaatataatcaatttctttttcaaattaaccatgactttagactattttaactctaatcatattcatccctctctttgccctaaatatatttctgtaatgcccaggtttgaatgcaccttgatttaattatactttcattattttggattatttaattattttgattaaataatttcatctaatgatttactgttttctgtctctctgataaatacataaaagtagaaaccttgctcataagttagtgtatgtttaactttatgacataatacctaacatctttccaaattagttttatttgtacttttccccactagcacagcaatgtaggagagtgtcaggtgccccacatcttcgtcaacatttggtgttgtccattttaattttagccattctaatgagttttaattattttctctgataacttataatgtcaagcagcttctttttctcctgtactactggcttttcaaattaattattcccagaagtgtctgttcaagttctttaccatttccttattggttgatttatcttttggctattgatttgtagaaattatttatgtattctggatacaagtcctttgtcagatatatgcaatgtgttctcccagtctgctctttattcttctttctcttaatggtgtttttgatggacaaaggttttttacattgatgaattcaacttattaatttttttttgtatttccttctttatgtgtcctttctgggaaatgtatttaaacttattttatggcccggcacacattctaccttggtgaaatttcatgtatgtcatttttttttctgcctcatccaatctctattcttcttctgcaattccaattatatgtgtgttttacacttgacactgttctagagctcaaggtggcttggttctttttttttttttttttttttttgagacagagtctcgctctgttacccaggctggagtgcagtggcgcaatctccacttactgcaagctccgcctcctgggttcacgccattctcctgcctcagcctcccaagtagctgggactacaggcacctgccaccacgcctggctaatttctttgtatttttttttagtagagatggggtttcaccctgttagccaggatggctaccctcgtgatccgcccgcctcggcctcccaaagtgctggagttacaggcatgagccaccgtgcctggctggttcttttttaaaaatattttttcctctctatttttcagatttgacaatttgacttgttgctttatcttcaagtctatagactattgatttagccatctccaactgatgttaagaatatctgtgattttttaaaaaattcagatagtttctaatgttagaatttccattagtttgtttttatttttatttttttaagtgaaagcaggtttattaagaaagcaaaggaatgaaagaatggctactccataggcagagcagcctagtttatttttatactgtatatttccctgctgggattatccctctcttcactcacttatggctattttcccttttacatctttgaccatatttataatagtggtgtttgattctttgtctgctaattccaacatgttgatgatctcagtattggtttctattgatgtttgttctcttgactatgcataatattttacatttctttgcatatatagcatttttgtattgtatgctatactttggggatgatgcattctgaaaagagagtggattttgttatcttttgcagattattcatttttgttttagttaacagttacattcagggctgatcaccctgaatttatggagatttggttttgtactttattggggcaggctgtaagtatggaccttatagaattttagcagacactccaaagtgtctactaagcccctttaatttgaatggagttaaaatctaaattgtcttcctctgatgggcagcaattgaaatctatgtccagtttttttcatccatctatcgccttctatagggctgtttggtgttttttgcatgcgtctgcagttcagtttaactaaatatttatggggactttatatgcagacttttgtcccctcccatttctgggatttcccatctcaattcacagccacgttggcaatgtcacactctcttctctgttacctaaagccaacaggcctgtggttttctactttctcagtagctgcctgcctcacgtgtactgggaaccttgccaggcccaacccgcagacactggtcaagcgacggatgaaaaaatgtacgcagacacaggttttttgcctggtcgggcggataggggaccgggccactcagacatcaaggatgccataaagagtcacagcggctgaggccctgacaagctagcgctgagggcatttatttagtacagatttaataacaaaggctttgagtcaacacacttgtgggtaattaacatggtcgcccccccaccaatcccccaacccctacccccaccccagtcctcaccccgctccccgagagagcagtcctgcacgtggatgattaaaggccaggttctaaggcctaagtaaactaacttatctggatcaattcccttacacttccttgttatctgctcttagagaattcagctgccttttgccataattttcttctgaagttctgcaaacccctggccttctgagaaggtctgcattctctatctataatttttcccaccaccctgaccaatctcctacagaacactattgggaatctgtataaatatgggtctaacttagtgcatttctgtcttttcaagggttcagcttaactatacttttagcaattctctacaactgtcaaatggttttctttttaaaaaatttcccagagattataagtttagtttgatgtaggctactttatcattatgaaacccagaacgattcaaatcattattatagttcacaaaatctctcttaagctgtgttttatgtgttgttatatcaatcctttaaggtttaatttttgcttttgctttttatctttttatttctatgcattctactgggttactactaatttggctcaggagttttgatagtctcttgttctattgtcatactttccattatttcttttttctttaaatacattaaacagccattttattcaataatcccattgttttccatatcttaggtctaatacataaaagggttttttaactttaatttatgatggtttatgtctttatgtttatttgagatatttttattgtaagttccctacccctagggaaattaatctgtaggaattcattgagcatagaccttaaagtgcttgcctacagagaaaaacttattttcttctactgaaatatgggggacgtatccaaaattggattgccttgcattaatgtttgacttgatgttttataggccacacagttagtacaaatggagaccctaaacccagaggtggttagaaataattaccagagacatatatgttttctttttttttttttgaatactctgtagcttattgagactgaagcagacaattatacccacaactccctctgcagaggtgctttcctggttcacctgctgaagatgtcgtccttgctgggttctaacttgggcccttatcttccagccagccccccttattgcttggaaccaggatttgtctcatttcctgatgctccataaaaccctaggtaattctcccatattaactcccattaagccacctatttaagaaagaagaaccggttaatattttatccatcttttttttgaaatgccataaaaactaagttattccaaaagtctatttagcaatttttctggaaatggaagttttcctactggcttttgttccatgtgtttcaaggctgggtttttaagtacatacaaattttgacttttgaaaatgttctttgagaattcttacatcaccaacatgcagtattcttccttgtgcattacattgctatttacttgtattccactttgtttcatatacattttggcaaacctatcttctttttgttaacattttcttagtattttctttacaaacattttcattcctcctgtatcattttaagtgtcttttattgagttaaaaaatcaattaatttgtattctgtgcacaagaatccctctattatttaatagataaatttggacccattcataattattgagaatattaatattttgcatcatattcttgttccattattttgtgcctccttctcatgctttccagttactcatttttcacttttatattattacctgttgccgtataataatattgccaaacttattgccttacaacaacacacattagttttctcagtttctgtggtcgggagtccagacacagcttaggtggctttgctgcttcagggcctcacaaggctgcaatcaagatgccagccaggactgtggccttatcttaggcctggctggggagagatctgcttccacactcctatggctaatggtggcattcacttcctggtggtttgttgggctgaggggctccatctcttattggctggggggtcaccttctttcccatgtgggctctctgtatgacattacacaacatggtagcttgcttctgcagagccagcaagggagcgagtctactgccaagactaatgctacaacttcatgtaatgcaagcatacatacatctgtaacatcttccatattctattggttagaaggaaaccataggtcctattcattctcaaggagaaggtatattagtctgttctcatgctgctaataaagacataccctagattgtgtaatttataaaggaaagaggtttcattgactcacagttccacatggctggggagtcctcacaatcatggcagaaggtgaatgaggagcaaagttgtgtcttacatggtggcaggcaagagcttctgtaggggaactcccagttataataaaaccatcagatttagtgagacttattcactatcacaagaagagtatgggggaaactgcctccatgatttggttatttccacctggcccagcccttgacacatggggcttattagaattcaaggtgagatttgggtggagacacagccaaagcatatcagaagacatcacacaagtgcatatgtcccaggaggtaagaatcctggggctaccttcaagtccatctaccacatttcttatatcctttttaggacagatatcatttttttcctgtcacattctttaatggtttgaaggttatttacttgttaacatttctatttacacctatattttcccgacaatgtctagtgctgatcagattatatattcttcccttgaataaaccatataaccttagcaagcgtggagtttctttctcacctactcccactttcgccatttgccctttgactatttggtatttggaattctaagctgagaatttaaaaaatgtaaacataaacaatcagcaattatttgccttaaaactacattttactaaattacttgctgacttttcattaaacccactcattttctcttgggtttactttgtacatttcaaaatattgctgtcctcctctcattcctggatggtaccctgattaagtatagaattcttgattcaaggttattttttctttttgaatttttgaaatattactcccttcaccttttgtctgaaacattatgtctaacctactccatatgccaatctgatttttgttcctttgtacttaatcggatatttttcacttttgtaactttcaagcattttctttttatctttggctttctgaaatttgacaatttgatattttaagtttttgttttatattacttatatcttggtgtcctgtccatttataaagaataatttcaatataagtagatttattctccaagatctagagaagtttctttggttattctttgaatattctcctccatctttatttgctttttctagacattctttcatatagtactaatatcacaaatcccagatctatcttctatgtttttcatgctttctgaactttttcattgtttgactaagttcttgaggaattccaaagggtaatttcattgctctgtaatttacattttacgtatatcaaatggtatttggctgatacactaaggttttctctcaataaaatttttactctgcatgatttctatttgattttttacatctattattctccctcccatctctctgtgatgctacttatccttacactctgctttgttctttgattgtgtgttattcagcctttggagtttgttatttcatggtggcttctccctttcagtgctagatgaatcttggtaatgcattcagcagcattttctgttaggctcgatgtcagcacagcctggctgggaggagcagtgagatgtgctggagtggttcattctctcttccggcaatcatgctgtactagactgttgcgttgctctaaagaaacacctgagactgggtaatttataaagaaaagaggtttaattgtccccgagttctataggatgtgtggtgctggcatctgcttggcttctggggaggcctcagggaacttagtcatgatggaaggcaaagggggagcaggcatctcatatggccggagcaggagcaagagagtgggagctgccatacacttttaaaccaccagatctcatgagaactgactcactatcacgaggacagtaccaagggggaatggtgttaaaccattcatgagaaactaccctcatgattcaatcaactcccaccaggccccacctccaacactggggatcacaattcaacaggagattttggcagggacacagttccaaaccatatcagatgcacacgaaggacatacagtacacattgtgagccatgacaaacacaggtttatgtctgtgcttatttatgaaaaaaatagtttacttaccaaacacttatttatcctcttgtgaaagttagtattaatcctcttgtgaaatgaactctggtattttctattctgctcaatcgcattgcacttttttcacacacgagttaagtacttttttgattttcacacaccaaaatgcatctcgactgtggttgataaatactattttaggccattttcagtaaaattaaggaagagaacggacaagctatgaagtgaggagtatcaagagctaattttcaacatgtgggcacccctctatctcctggtcaaccccagccatttgtacacaatgccccatctctctgcataacacccaggctaattttacttaaaagagatacagctctgttgtttcagcctaggcacaaaaggaaaagaggaatcacagaggaatcaaatgcatggctataatgtcctcactaacatctttcaatttacccttgacccctcttctctgtctgtctcatcaggaagtgaagcatttcaggcttgctcccatgtctatagctgttctgcctgtgcacgtttgatatcattgcatcttcaacctgatctcgttcacttctgtttcagaagctactagtaatgtctgttctaccaagaattctcccttggattttacagtgttaaactgtatttatttatgtctgttatgtcatttctggggcttgaggcaggatgggtagctataatgtgtttggtttactcccttgaactagaaacctgggctatctttgccaagaaacattgttgtcaaccagaatttttgctgatttaaggagtatgctagtcttttatgatataactaatggaagcttctattaaggaaatacctctgtgacttgtactaggcctggatggaaggccatcccatcagagcttggaagtacgccgtgagacagtgctgatagacagagtgaaagtgctgctcaggaaaggaactcctggatctatgggtctcagtggacatggcagaatcatgcaattcaaattcaacttaacaagaaaacattgtttgctaactttaaaaaaatagttattcttttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtacaagtaccatgctgttttggttactgtagccttgtagtatagtttgaagtcaggtagtgtgatgcctccagctttgttcttttggcttaggattgacttggtgatcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcatccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaacatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtgggttggggggaggggggagggatagcattgggagatatacctaatgctagatgacaagttagtgggtgcagcgcaccagcatggcacatgtatacatatgtaactaacctgcacaatgtgcacatgtaccctaaaacttaaagtataataaaaaaaaagaaataataaaaataatacctataaaaaaaatattctttttcaatattattttgtttattaagttccttgcttttccatatggattttaggatccactcattaacttatacaaacaagggagcggggattctttcctgttcttatttatttgtgtgtctccattttctcccttgaaaattggacatttaaaataatccactgcgtgaactttggaaatcagatttccccctactttttactgtttgctgctgttgttgttctttgtttagaaacttcatgcattaattttggaaattctctattctttttcacatgtggtcatgaaggctttggttagcttagtgatcagctgatgattagacagagatttctagtcttattgatctggaaccaatagggctcccaaatctaccagtgtacttctgtgtgtgtttgggcacacctcaacactcagccagacattggacaactctgccttagctctcccttcctgcttaggaagtgcctcaaggtcagacagaggtgagagcttagagtcttcagtcattctttaccatacctacatctctgcatatgtacttggccttctagattcaaaaaaaaatatgatgtaacttttcaacattcctgtggaaactgcatttcccagtcttaccttttaagctttttggttagtctagggtttctcccaactattatgtagtgccataggtgactcagaagttaaacaattgcctcaatacatccaacagtgtcccccaagtcaaaggctttctgtactgggcaagcaccaaatcacatcatataagcacagctttgtgagcaggccctttcagagaactatcaggcaggtcagatcatgacaattctctggaaatgaggcacctcactgaaggtacctcaccctgttcctgccactccagtggcagctaggttggtggttttcactgtgtttgcagacaactggttacaaagactaccacagagctaggggtacggttgaggatgggaacaggaaaagttaaaacactacaaggtcactggtcttaccaaaatttggccattttcctggagtaaatgttctccagatttgtatgaggctttggttaaattccgtgtttctgaaaagttgattctcacaatttttgtcagtttttccatgacatttaagaggagaaaatattcagaggttcttcctctgccattttcattgacatcctatttacttttatttaattcataatattatgtacaaaaaatatttagtacacatctggggtattggctatgatcaagagaatagcttagtcctaaacataaccataagttaagaggaattctttactgtgggatttcatatctggtcctgccctatggggcagtttactgtgagtttacttacctctgagcctttctataaacacacctgccccatatcccattctcaagggatctgtttgctaacttaccaggtaattaatttagggtcaagtgctaatgactcataatggcataatatgtaatcatccaaatcacattttcaggatcgccaagggcttctgtatcttaatccaaaataataagcaatgtggggattattggctccttaagaagatcaatctctcttacatagaatgagctctgaaccagacacttagcctaagacaagtcagggtgatttgtggagttgaaatgtttttcactgaaaatgccagaatgttacttttttcaaaacgtctgaataatgttggatttcctatcgcctctaattcattgtctctgtttactttgcaagtatagaaaatattgatgaaaatgatcatcaatatgaaagtaaaatgctccaaattaataccttttttctatgacaaagaaacctttacaagtggaaataacttgtatcttcacaaggccacatttttaggtcacaatctggactaaagattttatctaaaatttttaagcatttatctttgcaaaatagttaagcacaatttttaatagttatttagaaaacattggccataaccctaatctatacttattaatatgtgtccttagaactcaaaggttttctctctctctctctctctctctctctctctctctctcagcatgtgtatataaaattgctggtgctagttgctatggtcaacatttaaagtgctaagcacaacacgaaatctaaaattctgtcagaaagaagctatttctaccacttgaaaaatttcctctctgcgcagacactgcttacagctttctggcatgtgacttaggaacaaagccatgattcttttaccggagaaggtttggggatatactttgaatgttaagttatttgggatgatgttttttgtcatttgatgccagctgccactgttcatgcagaattgagatatcagttaaactaaagcagatgcaaaatagatattatatctagactaagtatcatgcttagaatataaacacatatctacagtgcttttttataaagataaggctatgaatattttagtaatgtttggttttcctgatagaatttagatttgatctgcatagtgctaaaacctctttaagaacaccaccacatacttgggttttgtgattatttggatatgatcagggttaggttgtcctttccgtaaatgaagaacaggttgaagaaatcaattgtataaaaatgttataagtggagttctcagttgactccactttcctctagctctaaatttgtgatgatgtgatctttttgcaagcaccatttacatactgatgtacttgttacatttcattctaattagtcattaacatatgtcttctaaggacagttgaggaagcattctcttaccagaatttgttatgagttttttgctttttcttgtttctctttccccttctttcttcaaaatgacaagagagttttctttgcagtcatttgaaagtggctcagttgagttagagtgagctcattaattgtagatttgtggtaaccataactaatttttgaggaaggcatgacacagatgactgtatccaccagaaacaagtttcttattccctgattcaatcacccaggggattggttctgctggggcagggtgaagggaacagttttcagggtgtcaggtaaaaacagagacgctagtaacggtgtaaacacttgtttctccagggaaatatctggacctggctcaagacgggactcttgttcttgactttcctccttcctgtgtcttctcagattctcagcccagtgatgacgctgtcctcccactctgcattccctagatcacacacaaggctgtgaatgcttgtgtacctcatgtgctgggcatttccaagaaccagtggcttcctgtgaaagctgattcacaagtatgttttcagcttactgtgtgagcaattaaatccactgctgtcatccacagtaaaaactctccacatgctgcttcacagacctttttttccctttggctttaaacagagatgtttaatgaagatgagatttttatttccttttccatatataggagctactgaatgtaagggagaaagaacatggcttaatatggtgaaagtaatggaggcagtatataattatcattatctgctacaattaaggcagcatcacgctgtcttgtgacagtttattgtggtgtgtggggatgcagtaaagtgatatttatacccccatgactgccttgccattcagaaatccataactctataaatgcattctgtggctatagagcatatgtcttcagcacttccctattaggctgggtctttacattgagaatgtggcccatgaaatgagaataagctcatagaatagatcagaaagtaaaaagctgttcaacagcaatgatgaacaaaaccttcacctgtgcaataagggtgttgggatctattggtaaaaggcctggggcccgtctggtgataggccaggaccctgaggcagggctggataagatggagagggctgcattgcaccatgcattgcagaagaggcacactcatttcaagaaaggatacgggcttggctgagcgacacatgcaactaaaactcaagacacacattctaactttctctcaagctggagtcgggaggctggcatacaaagaggacaatgtaaggctagttatcacatgccaatgacggtggtgaagaaccacgtgttccatgagacgtggctgtctagaccatgttgtgcagaaaaaaacttgagtgagacatgggagctgaaatcagtgttctgagctggacaggacagaacctctaagacaaccaaggggcatttgagtgctggctttgccagagcaactagtgtgggcatcatcctgtttactgcctgttgcatggagacatgatggtacccactggatatggctgtggctaagtgtattattccgttcctacgctgctatgaagaaatacccagactgggtaatttataaagaaaagaggtttaattgactcacagttctgcatggctggagaggcctcaggaaacttatgatcatggcagaaggcacctcttcacagggtggcaggagagagaatgagtgtaggcagaggaaatgccagatgcttataaaaccatcagatctcgtgagaactcactcaatatcatgagaacagcgtggggaaaaccacccccatggttcaattacctccacctggtcctgcccttgacacagggggataattagaactcatggtgagatttgggtgggaacacggagccaaaccatatcactaaggttcgcttaactaatgtgtagaaagggttcagggcaatgtctataacatagctatcactcaatttaggttgctgttattattatcattttcatgatagagttattattattattccagaacagccaaagcctgcaccatctattccagcatatttcgagatttaaaagtacaccactatttcattctaaaggaatgacttgccaagatttaaatttcaagtactttgacacctaggggaatctccaccatgttggggctgcagggggtacaaggcccctcattgtacccttctggtgcctctccaccctgctcagtgccccaggaggctgactggcagaagctccattgccctttggtgtttgactgtgtttggccagtgggaggcactggaaggagttgcaggatggaagggaagtgaggccagagcgtttgcacccaactccctgcccacccattccctgaaccagagctagaacttccaccaggcagccttgccgttcggccacccttcccgggttgcagggcctgctctccttctgcatcttcctcaagcctagaagggggaatgccttcccaatgacaagccccaggtactgcactatccttgggtggtttccctaaatcttgcccatgccttcaaaaaaaaaaaaaaggggccctgtattaaactttccttcacttcccagtgtgagtgtgcttcctgcctcctgccgtgggtacttcctgttgtcctttaaatcacacctatataattgtttccatgacttcaaaactatttatagcatactttacctcatccctttctgttctcaccaactaaaatagcttatattttaacctttgtcatagagacacacaaatacacacctagtacctaaacaaagcagaggagaggcaagttaatcctctgtgcctacgaatatgttaatttttaaaagcattactgagatgcttagtaaagtagcaggtgttgtgaaattgcatttttattacccttccccatatcaggcaagaaagttatggtctcttcagctattttaccatttgctaaatgttcccagtcagttagcacagataatgcttttttttaaaatcatatttaggcaattagaaacttttgggttaattaattttgcatattagaagacaggactttaatataaatttaaggcaacgggtttaatattgtaaataataacagttatcacaaaccataaacatatttataatttatatgcatgaaaatagagtctgctgttaaaatattgaaaattaagataacacagctttcagcctcaaaatgaaaactttctgcatagctacactctctaagtaagacatatttggccaatgacttaatataaatgaatggcaattctttattcagacataccattattttctaatgcatgtagcatattcaaaagatgcatatgtttccaaaaattataccatcaaatgtgataagaaaggaagttatgatgaagggtaaataggagtgggagaacaaagaagccaggaattgggtttgaaagtaatgtccatgtcctgaaggcctctacaatgagctatgcatcctcccttttttatcatattcaatggtacaatttttggaaagatatgagggaaatgcaattggctaccctatgtttattatctagaagatgaaaataaccacctagtcaggtaatgcagatttcttcccagcaccaagataaagagatgtttactcattaatgagacactgtggcaacggaaggaaaaccaagctccacaggagcattcatctgatttcctaagactattttatttattgagctcctcaatgtagacagatggagtaacccaaacggcaatttagtggtagcaattctttggggggaaaaagctgagaatgttgcaatccaggtaaacatctcgatgatggctctaatgattgcagctgtcaattaactgatactcccacatttttgttgcaatggcagagaatatgaaagtcctaaggacaaaaacagcaaaccgtccttgagaatttacatgtggaagatgagagcctgagcctgtggggcctgactccaggctcccagaggcaacatgtggctccatttggacttcagaaaagcaggggaaaagaatgacgaggaggcacaaaagttattttaaaaccaggatgtagttgtaacaaatacagctggaaaagaggaaatgagatttttaaaatacaagaaaagatagcgaaaaagagcctctgttcccgttaatacctcctactgtgctaccaaagttcagggattgcaaatggctgtaatcatttggccaccgccatggactggcctgttagcagcaaagtcaggtctgatggcaggttccactctgacatctcagctccatattttagggttatttgcctctcaccttgaaaaacacctactgcagttaattattaactgtcaccttcacatcacccagagcgggctgatgttacagaacagcctcagccaactctcatctaaactctgggtttagttttctagtttttgttttgttttattttgtttcaggcatcatacctaaataatgcctaaacatctttctcctagtaggcagattattttttccttctaaatgtaattaaagatacaaactcaggctgtgtttgtgcttgccaagaaaagaacaagctagatttggtggccttcacagtattttttttagtattttaggtttctccattatctcaataaaagtccattttaatacattgaaatatttgaaatatatttataaaaattatgcgttaagtaatttagaactaaacaacaaatcggtaacatataatactatttaaagcaaatatcatcaagggtcaatttccttaatgcaaaaaaaatcatgcaaatcaatacgtgagaaaagaaatagaccaacagggaaaaatagataaatattatgagcagacagtttacaggaaaaatgatatataagaagatgcatatatcttaaaatatattggttgaataatatcctatcttaaacattttatttctacttaaaccatataaatgtatacttgctaaccgatcttttgacatagtttttcatgtttctcttattatataactctacccatcatgtattgccttttatttccaattttgatttcatcaaagcatagcaaaacataaaaaccttgtaagcactgacaatgatggtttccagctttacccatgtccctgcaaaggacatgaactcatccttttttatggctgcatagtattccatggtatatatgtaccacattttctttatccggtctatcattgatgggcattggggttggttccaagtctttgctgttgtgaacatgtatgccaggacttgtagtaaacaacaacaacaacaaaccttccaagtgcaaaatctctgtagatttttccttttttcccctcagtctttttttttaacagctttgctgaggtatagttttcatagcataaatttcactcattcaaaatgtataatcatccagcctgagcaattggttaagactcccatctctaaagaaatttaaatgaaaaaataaatacgacgtggaaatcaatgatttttttagtatgcttacagaattgtacacccatcgactgaatttaattttagaacatttttgtcactccaggaagaaaccttatgcatattagcagtcactccccacaccccttcctcctactccccagaccaagcagctgctgcttcctgtctgtgtagattttcatttccctattctgcacgtttcgtataaaaggaatcatgaactacgtggtctttcatgactggcttctttcatttaggatgaaatgttttcaaagttcatccacgttgtggcatgtatcagtactttattccctttagtggctgaataatcttccactgtatggatgtaccacattttgtttatccgttcattagtcagtggtcatttgggctacttaccctttttgactattgtaaataatgctgctctgaacatttgtgggtgtgcaagtgtttatctgggcatgtgttttcatttctcttgggtatatactcaggattgaaattgctgagtcaaatggtaactccatgtctaacattttgaggaacgccagactgtgtttcacaacaacttcaccattttaacagtcccaccggtaatgtatgggttcgaatttctccacatcctttgcatcacttgttattatctgacttttttattatagcaattttagtggttgtgaaatggcaactcattgtggctttgagttgatactcccttgtagaaaaacaagagtcaaacttacgttttaaaaaatatatgcttggggccgggcgtggtggctcacacttctaatcccagcactttgagaggctgaggcaggtggatcacctgaggtcatgagttcaagaccagactggccaacatggcaaaaccccgtctctactaaaaataccaaaaattagctgggcatggtggtgggcgcctctaatcccagctactcaggaggctgaggcagggacaattgcttgaacccaggaggcagaagtggcagtgagccaagattgcaccactacactccagcctgggcaacagagcaagactctgtctcaaaaaataataataatacacacacacacacacacacacacacacacacacacacacacacacacacgtgcttggggaacttttaacagggaaaatataatgtatgtgttatgtaggcttcagccacagatacatgatgaagcttacaactgtaaacatgcaggctttactcttcttgattactgagatggatggcagtttatcgacacttattcaggtttttgctcctttctgtcaatttaaatctcaggatcagtgaaaagagcccagggagaagacaggagatctgtgtgtccccagccctgtccccaaactgtctgtaagaactttcagcctctgaaactcatcagcagtagaagataacttgtctccaatatttgacagtggtgatgtgaaggtaaagcaaactgattaacacgaatcaactatgaaaaacttaaagcgatttaccagcatcttacatgtagtaaatgtattttacacacacacatatctattatattatatatacaggaccgaaagaataaagaaaaacattttttgggtaggaaaatggcagagacgacagcaatagcagtattttctggcaaaatgttacagaataagatggagtatacagaaaagtaaggttactcattcaaaacaacaaccacagatattttttgttgatattgttaggtttgggatttattttttagattttaatgaagatggtaggttaattgataaccttcttggcaggagaccataatcttggctttcagaatgtgaataaaaggggctctagtttctttcccctttttgtaatatcgttgtcacctcataactacagcttggggttttagctacagtccaaatgacattttaattaataaaatttggccataattaaattacatataaaaatatatcacaagtacctcttatttaacttttacttctttgccaatatataaagtggtcaataagacttctattcaaaaatagtgtattttttaaattttattattactatatttaagttttagggtacatgtgcacaacgtgcacgtttgttacatatgtatacatgtgccatgtttgtgtgctgcaaccattaactcgtcatttagcattaggtatatctcctaatgctatccttcccccctccccccaccccacaacaggccccagagagtgatattccacttcctgtgtccatgtgttctcattctccatttcccacctatgagtgagaacatgtggtgtttagttttttgtccttgcgatagtttgctgagaatgatggtttccagcttcatccatgtccctataaaggacatgaacccatcattttttatggctgcatagtatttcatggtgtatatgtgccacattttcttaatccagtctatcattgttggacatttgggttggttccaagtctttgctgttgtgaatagtgccacaataaacatacgtgtgcatgtgtctttatagcagcatgatttacaatccttagggtatttacccagtaatgggatggctgggtcaaatggtatttctagttctagatccccgaggaatcgccacactgacttccacaatggttgaactagtttacagtcccaccaacagtgtaaaagtgttcctatttctctacatcctctccagcacctgttgtttcctgactttttaatgatcgccgttctacctagtgtgagatggtatctcattgtggttttgatttgcatttctctgatggccagtgatgatgagcattttttcatgtgttttttgtctgcataaatgtcttctcttgagaagtgtctgttcatatcctttgcccactttttgatggggttgtttttttcttgtaaatttgtttgagttcattgtagattctggatattcaccctttgtcagatgagtaggttgcaaaaattttctcccattctgtaggttgcctgttcgctctgatggtagtttcttttgctgtgcagaagctctttagtttaattagatcccatttgtcaattttggcttttgttgccattgcttttggtgttttagacatgaagtccttgcccatgcctatgtcttgaatggtattgcctaggtttccttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattggtcgatatctctgttttggtaccagtaccacgctgtttttgttactgtagccttgtagtatagtttgaagtcaggtagcgtgatgcctccagctttgttcttttggcttacgattgacttggcaatgcgggctcttttttggttccatatgaacattaaggtagctttttccaattctgtgaagaaagtaattggtagcttgagggggatggcattgaatctataaattaccttgggcagtatggccattttcacgatattgattcttcctacccatgagcgtggaatgttcttccatttgttcatatcctcttttatttcattgagtagtggtttgtagttctccttgaagaggtccttcatatcccttgtaaattggattcctaagtattttattctctttgaagcaattgtgaatgggagttcactcatgatttggccctctgtttgtctgttattggtgtataagaatgcttgtgatatttgcacattgattttgtatcctgagactttgctgaagttgcttatcagcttaaggagattttgggctgagacaatggggttttctagatatacaatcatgtcatttgcaaacagggacaatttgacttcctcttttcctaattgaataccctttatttccttctcctgcctgattgccctggccagaacttccaacactatgttgaataggagtggtgagagagggcatccctgtcttgtgccggttttcaaagggaatgcttccagtttttgtccattcagtatgatattggctgtgggtttgacatagatagctcttattattttgagatacgtcccatcaatacctaatttattgcgaatttttagcatgaagggttgttgaattttatcaaaggccttttatgcatctattgagataatcatgtggtttttgtctttggttctgtttatatgctggattacgtttattgattttcgtatgttgaaccagccttgcatcccagggatgaagccgacttgatcatggtggataagctttttgatgtgctgctggattcagtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacctctggtagaatttggctgtgaatccatctggtcatggactttttttggttggtaagctattaattattgcctcaatttcagagcctgttattggtctattcagagattcaaattcttcctggtttagtcttgggagggtgtatgtgtctaggaatttatccatttcttctagattttctagtttatttgcgtagaggtgtttatggtattctctgatggtagtttgtatttctgtgggatcggtggtgatataacctttgtcattttttattgcatctatttgattcttctctcttttcttctttattagtcttgctagcagtctatcaattttgttgatcttttaaaaaaaccagctcctggattcattgattttttgaagggttttgtgtgtctctatttccttcagttctgctctgatcttagttatttcttaccttctgctagcttttgaatgtgtatgctcttgcttctctagttcttttaattgtgatgttagggtgtcaattttagatctttcctgctttctcttgtgggcatttagtgctataaatttccctctacacactgctttgaatgtgtcccagagattctagtatgttttgtctttgttctcgttggtttcaaagaacatctttatttctgctttcatttcgttatgtacccagtagtcattcaggagcaggttgttcagtttccatgtagttgagtgattttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagagctgagttcaattcctggatatccttgttaactttctgtctcattgatctgtctaatgttgacagtggggtgttaaagtctcccattattattgtgtgggagtctaagtctctttgtaggtcactaaggacttgctttattaatctgggtgctcctgtattgggtgcatatgtatttaggatagttagctcttcttgttgaattaatcccctcaccattatgtaatggccttgtttgtctcttttgatctttgttggtttaaagtctgctttatcagagactaagattgcaacccctgcctttttttgttttccatttgcttggtagatcttcctccatccctttatttggagcctatgtgtgtctctgcacatgagatgggtttcctgaatacagcacactgatgggtcttgactctattcaatttgctagtctgtgtcttttaatcggagcatttagcccatttacatttaaggttaatattgttatatgtgaatttgatcctgtcattatgatgttagctggtgattttgctcattagttgatgcagtttcttcctagccttgatggtctttacaatttggcatgtttttgcagtggctggtactggttgttcctttccatttttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccctattctcttctggcttgtagagtttctgctgagagatcaactgttagtctgatgggcttccctttgtgggtaaccctacctttctctctggctgcccttaacattttttccttcatttcaactttggtgaatctgacaattatgtgtcttggagttgctcttctcgaggagcatctttgtggtgttctctgtacttcctgaatctgaatgttggcctgccttgctagattggggaagttctcctggataatatcctgcagagcattttccaacttgattccattctccctgtcactttcaggtacaccaatcagatgtagatttggtcttttcacatagtcccatatttcttggaggacttgtttgtttctttttattcttttttctctaaacttctcttctcgcttcatttcattcattttgtcttccatcgctgatactctttcttgcagttgatcgaatcagctactgaggcttctgcattcatcacataattctcgtgctgtggttttcagctccatcaggtcctttaaggacttctctgcattagttattctagttagccattcatctaatttttcccaaggtttttaacttctttgccattggttcaaacttcctcctttagctcagagtagtttgatcttctgaagccttcttctctcaacttgtcaaagtcattctccatccagctctgttccgttgctggtgaggtgctgcgttcctttggaggaggagaggctctctgatttttagagtttctggtttttctgctctgttttttgcccatctttgtggttttatctacctttagtctttgatgatggtgacgtacagatgggtttttggtgtggatgtcctttctgtttgttagttttcgttctaacagacaggaccctcagctgcaggtctgttggagtttgctagaggtccactccagaccttgtttgcttgggtatcagcagcagtggctgcagaacagcagatattggtgaacctcaaatgctgctgcctgatcattcctctggaagttttgtctcagaggagtacccggccgtgtgaggtgtcagtctgcccctcctaggggatgcctcccagttaggctattcgggggtcaggaacccacgtgaggaggcagtctgcccattctcagatcccaagctgcgtgctgggagaaccactactctctttcaaagctgtcagacagcgacatttaagtctgcagaggttactgttgccttttgtttgtctgtgccctgcccccagaggtggagcctgtagaggcaggcaggcctccttgagctgtggtgggctccacgcagtttgagcttcccggctgctttgtttacctactcaagccttggcaatggtgggcgcccctcccccagcctcactgccaccttgcagtttgatctcagactgctgtgctagtaatgagcgaggctccgtgggcataggaccctccgagccaagtgcgggatataatctcctggtgtatggtttgttaagcccgtttggaaaagcgcagtattagggtgggagtgacccaattttccaggtgccgtctgtcacccctttctttgactaggaaagggagttccctgaccccttgcacttcctgggtgaggcgatgccttgccctgcttcggcttacgcacagtgcgctgcacccactgtcctgcacccactgtctggcactccccagtgagatgaacccagtacctcagttggaaatgcagaaatcacccaccttctgcgtcgctcacgctgggagctatagactggagctcttcctattcggccatcttggctccaccccaaaaatagtgtattttagacagtttagagagtcattattccatggttcagtatgaaccttctttttgctactgtttgtaccttttcgtcactgtgacttcatcaggaacaagaatttcatccctgcagcaaacaccgctgcgaatatggactgcagggtgacaaaatcatcgtcacaatttttacgctttctgaatttctcttgcaaatatccacattaacagtactaatattcttcagccttcaaaactcatgctgttttatttctcacacttgcccttcattctctttgtaatggatccacaatcgttccatctgtaatgttttgccttaaaagagcagtttttttcccaagtgtcttcaagaaccatttgtattagcatcaactgggtacatgtacagaatgcaaattcataggcctgaagctagacctgctggatcagggtatggcctggtaatgtgtattttcataagcatccaggtacctcacaggtgcacttatatcttgtatatactgctatggaaggtgctctgctctaattaatcaaacaagtatgtaatagagtaagcctcatagcataataaataatactgtgggccatggcagtaagaactggctcatttaaatactgttaaattatcaggacaagtattaaatatgtaatttttattaaatataccactggttgccagaagaattctcattgatgtagcagttttcacatttatatatatttataattttaaaatgatagataacatatactgaatgcttactattagccatgccctgtttttcataaattaatccatgtatataagtattttacatttactcatttatacagcatgatgagcgacaaggtgctatcattattatcattatcatcttagatggggaaactgaggcatgggggccccacagcactaagtggcagagccatgattcagcagtaaataatccagtaccaaagctctggtccttagcaattatacctgtactgtctctctatttgtaaagaaagtgtaggtctttaaatgctattttgaacagatttccatatacctatgtatagaataaccaactacaattgaacttttattgtaccttatcatactctacagctagatggctgtctttagtccattttgcactgctacaaagaaatacctgaagctgggcaatttataaggaaaagagttttattgggctcacagtgcccaggctgtacaagtagcatggagccagcatctgcttctggtgaggcctcaggctgcttccactcatggtgaaaggtggagggaagctggtgtgtggcaatcacgtggtgaggaagaacacaaagcagagggggaggtgccaggctctttttaacaaccggctcccatgggaatcatgtgtgagaactcactcactgccccccaccaaggagggcatcaatcttttcaccaggcatctgccctcatgacacaaacacctctcattaagccccacctccaacactggagatcaaattgcaacatgagatttggaggggccaaaacaaaccaaaagatagcaatgtctctggcatttaaacaatatatttaaactatatttggccacttaaaactacgtttgaggcctacctaatttaaaacgaatgaaaatagacaataattctacccttataatgcctaaaatctagttgcggagatttaaaaaaaattctaaccgttccataaataaacataactttgcaactttggcaaataatacaaaatagaattacacagaattgtgagagcttttaaaagatggtttattctcgacaggaaagtctggaggggcttccttgtgaacaggtgaatggatgaacagtcattaacctggtaaagcagggaccagtgatggggagctctgccttcggaaatggaagactgctgttacagaacaaatccgctatcaggaacatccagaaaaggtcaaaggcactgcagagctgccaaggaagtgaggacttgtgtcttcatgtccaaaagatggaagaacagagaggtagagaaatataggggtggcattcactcatttgcacaaggcagctgacaggttgtggatttctatagacttggggtctaaaagtagaagtcctgagaaacacactagagtttgaattggaatccccaaaggctacacactagaaaaaaagaattagagatggaattttcctcaggacgaaagcccagactgtaaagatgttaacccttgtctaaattaagaatatttgccttcttcctaactacctgccagaagcaaaagtgaatccactctggaggaagacaaagcatctagagcttcaaattatctgcacacctagtattggaaatatgaagtattgagccaaaaattaccaagaaagaacaaaataattgaacaaagagcaacagcaacacataagcgcgcgtgcgcacatgcacacacacacacacacacacacacacagacacacacaccagaataacagaagaaccagaaagaacttattagatatggactttagcatgtttgtaaaactaaatcataaaatacagagttattattatttatttatttttgagagggagtcttgctctgtggcccaggctggagtgcagtggtaggatctcagcttgctgcaacctccacctgccgggttcaagcgattctcctgtctcagcctcccaagtagctgggattgcaggtgtgtgccactgtgcccagctaatttttgtatttttagtaaagacagcatttcactgcgttggccaggcttgtctcaaactgctgacctcaagtgatccacccacctaggcctcccagagtgctgggattacaggtgtgagccactgtgtctggcccaaaatgtagaattataccatgaaatggaaaccatttaaaatcaaatgggcatattagaatggaaacaaaataagatatgaaattaagaactcaatgaatggatttaacaaccatttaacacagctgaacagaagaaaagggagcaaacaaaaaaattcaatatctggttacaagtagaaaaatgtagaaaacagtgtaacatgcataatagatgttggaaacctctagtataggtgtaattaaagttgcagaaggagaagacggagagaatagaaagggaactgttacagatgagatcatttcaaaagtaacggaaaaatccaacagatattagctgctgtatgaacttcagatagattacaacaaacagacaaaatgtacctaaggatatcataataaaatttctgaaaactgaagacaagaggaagtctaaaaagcagtcagagacaaaacatatgttatctttaaggggaaatagaaatactaataatgactgtataagagtgcaagtcagaagatggagacatgacattgtcaagtgcggaatgaaaataaatgccaaaatagaactccatatgctctaaagttcttcttcaaaacaaaggaaaaatataaggacatttttttgaaaaacaaaaacctaggaaatttgtcaaacttccagtaaaggaatgactgagagaactcttcatgcaaaaaaacataatcacagatgaaaatagatgacttaagaagagaagaatggaaaagataaatgtgtggctatgtccaagggaatattgattgtacaaaacaatgattagaaaaaaatacctatataaatcttgataaataatagcacaaaagacaggactttgttaaataatatttgattactcaaagttccttattacctggagaattgtagatatattaattaatgcaactatcaactaattgaaattaatatgattatcaatataagattctaattaagaatatattttgaatttatggggtaaacactgaaagaataataattgtttaataacaggctaatttgaagaagatttatcaataaacataattaactcaaaagaggaaaaacgggacaaacagaattagtaagattgattggaatgccaatgtgtcagtgattgcattaatgcaaatggattgaatactcagattaaaaggcaaaattgtcagactgaattagcaaataaagacaggcagctcacaaaaaaagctgcctaaaatatgaggaccaaaaaaaaaaaaaaaccctgaaaaaaagagagtaagttgaatacatgcaagcagtaggcaaaataaaattggcatatataattttgcaaatgacactgaaaggcaagaaatgacacatttctaaatataaatagtgtcattgcattaggattaaagggtctatctgacaagaatttataatcttagactggtatgcacctaataatatagcttcaaaatatataaagcaaaaattaacagaattaaggaggaaaatagacaaatctacaatcttagattttaccatacctctctgagaaactgaaagaacatccaagaaaaaaaatcaataaggatgtagtagatttgaaaatcacaatgagctaacttgatctagttgaaaaatacagaaatactacatctgtcatttcagaatatacatcatattctatccaatatgtatatgcattgcccaaattgaccgtatgtttgaaaacaaatcacacacacacacacacacacacagtatcaccaagtatagggattgaaattctgagtattttttctctaactatagtgagattaagctaaaagttaatattaaaaatatacctcaaacatctttaaatatttgtaaattatttctaaacaactcattggccaaaaataaaaattacaaaggaaattaaaagtgccaattttataacctaacatctcaataatttacccaatagaacagcaaataacacacagtcacacattgcttaatgacaggatactttatgaacccaacattcagtgatgttagtcattgtgtaaacatcaaagagtgtacttacatgaatatagagggtacagcctcctacacacttagcctatatggcatagctcctatactacaaacctgtacagcatgttgctggactgaatacctaattttactgtaccttttctatgtttagatatgccatggtaagtagttgtatatctaaacatagaaaaggtaaagtaaaattatggcataagaaataaataatgttacatctgtacagggaacttaccataaatggagcttctgtaacttagagttgctctgagtgagtctgggagtgagtggtgagtgaatgtgaaggtctaggacattactgtacactactgtagactttcccaacactttacacttaggctatactaaatttgtaaaaacaaaaactaaaactaaaacaaaaaaaacccttttcttttttcaataatatgttaacgttagcctactgtaacttttttactttctaacattttgagtttttaaaaaattatttgattcttttgcaatcacacttaccttaagacacaaataatacaatcatacagatattttctttatattcttatctatatgcttttatctattttcaaatttcttatttcatttgttactttttaaactttttgctaaaaattaagacacacacacaattttgtgtttattattatcaaacattatgtaccatacataattgtatcgctatacttttaaacaagcggtagtgcaataggtttgttcacaccagcatcaccaaaaactcgtgagaactgcattgtgctatggtgttaggacaatgatgatgtcactaggaacaggaatttttcggcttcattataatctgggactactgtggtatatgtggtctgtcatatgttgactgaaatgttatgtcatgcatgattgcataaagaaagtaggaaaaaatagtacgtatgaccaatcttattaattaaattgataaaaagtgcatgacacaactcaaaaagctaaaagttgtttttcaagcaaataattaaataggtaaacaccagggaagattgaatttttaaaaatcaagtattaccctattccaaatgaaaaagaacatcattttaatggaaaccaaaaagaagaagtatttgcaatgcttattaactgacaaaggactcatatcctggatatattaaaaggtttgacaaataaagatattaaaagtcctggacactacaaatgacaaatgggcaaaaacattaacacgcacgtcacaaaagaaaatatccaaattactaagaaacatataaaagctttccttttcactgtcattagtttttgaggcaatgcaagatacccgtataccgtcatcagaaatgttactcaaaagtgaaataaaacaaaatataacctgacaatatcaaatggtaagaagaatgtgaagcaacaggtcactcacatcctacttgtgtgggagtaattttgtgcagcctctgtttatcaggttacacaaggctgaatacacacattctaataaatctactaaggctaaacatataccttctaataaatctatcaagtttctagatatatagccttcagaaattcttacatgtgtaaatcaagactgtaatgagaatggtcataacatcattatttatgttagtgcctatccaagcaaaaaaaaaaaatccaaattgactcaacaatagcatggattgattatgaaatgttcataccatggaatgccatgcagtgatggaagctgactacagctacatacaatatctccgagtctcccaagggagacagagtgaaagaagccattcacattgattccatttatatggagttcagaagtctccccagctaactagcgttagaagtcaggatagtgattttctcaggggagaaatgggattgtaactagaagaatgcaccaagaaatcttttgagacaccgcttatcttgtatgtcttcatctggttgtgattacatggatgtatgcactttgagataagttattaagttgtagacttatgacttaggcacttctctctaaatgtcgtacttcaacaagatgttttggtttgtttttacattaaaagacagaaggaagaggagagtatttaaggtaaagaaaatagcacgaaaaaatctctgtgcaggaattaagtgtgtaccaagattgaataaagccatgtgaatggagtacagaggtaaagaaataaagataaagagaggaggaggggagatgggaaaaaaggaaggaggaaaggagaaagaaaagacaacagaaaaagaaaaaaaatgaagctggaaaagtaagtaatggcggcccctctccaaggtccagaaacttggatacttccctaatagcagtgaacgccagagaaggggtttagctgtggagagtgtggtgatgtgatgagatttgtacttcagatatctctagatgaatgcactggagaagggaaaaaagtagatgtgagtggatgaaaaaagaatgaacagcagttgtccagcagagagaagtgttcgttacctgggtctgagtgttggtggtagggaagctgcaggaatgtataattgtgtggatgctgggggtagagggagagggagctatgcttaaaataccagcccaagcttttctaactccaaaatatcttttatttatttgtttctttctttctttctttttttattttgagatggagtctcgctgtgccacccaggctggagtgcagcagtgccatctcagctcactgcaacctctgcctcctaggttcaagcaattctcctgtctcagcctcccgagtagctgggactgcaggtgcacgccaccacagctggctaatttttgtattttaagtagaggcagggtttcaccacattggtcaggctggtcttgaactcctgacctcaggtgaaccacctgcgtcggccctcaaagtgctgggattacaggcatgagtcactgtgcctggtccaaaatatctcttaaaaagtcatttaaccacgtgtttctcttttctataactcgttgtaaacaatgaattcctatatttaatagtgatgtcctttttgtattctagtttaataacactatttcatgggttaattgttttaataggaatttcctagtcgatatagttttatttattacctcattggaggaagagttttatacatattttatagaggtgggcccaaaagtccccgctatgttggtagacacataataattaaattttaaaaagctatggccttctaaatttttctttcttttgaaataaatatatacagatttttgacttatttatcaacaattgtgccatcttataggaaaattaacaaggttcatttatgaatgtgtcacaaaactgcttttcttgaactgctgatgtttgaatattataattttatgccatctgtgatatgagcatttgttacatataagttctatcataagcaaactaaaatcactccctttgtttaaatgtgtttagtaagtctattgctttcagtttataagtgtttgaccattgctcttctataaaagactctacaagaactctaaaatatatactgtgcttcactgattctgtaaaatagatatgtaaagtaatttcacattgttcaaagatactaggaatcacatacacttaactgcttatattttccaatactttgcttagttacaaagtttctgtataaagatattctcatgtataaaagagcccaacaattgttttgtacttcttacacttccttaagatagtatttaataccaacaaaatactgcttgagtcaggaggccttaatcaatttgttagagtaggaaactgaagagttaaaatagttgtggtattggcctacaccgacatgtgacgtgagacatggctgtggatatgacatccaggctccatcctctgttcctcctcttggaaattcggtctgtagcctaacacatttgttaatgcacagagacaagtatgtggggagaaaagacacactgagctggatacctgtgtattttggttcatacctgagatgaacctgaaatacagtctattacctgaaatagaagaccaacgtgttgtaatgaatttagtctgaattatctcattcctgggaggttcctgttaaattgagcaagtgcgagatagagatgaacataaatcatttctttcactcttagtctactctggcaaagtgaaacattgccaaagataacagtcttttaattaattttggaggttggtttatgtatacccttggaatttcttggatacatgcttcattaataggccaatatgcctaggtttaaagaagatatttattttaaaatttaatatgtcgattcttagttgaaagtatagtggaagaggcagcagcataaatatcctctcatttattgcttcgtttgttcgagaaacatgaattgaacaacctactactcatcagtcagtgtgaaagtaggaggactcaaagaagaacatgcaggcataggccttcaagttgggatgcaaaggcagccgtgccaataagtaaatatgtgtgataagttgttagatgtgcaattctagctataagatgattgatttaatggccaacatagcccttgtaatataacattagcactgaggtgagattaaattccgtttccatctcttggttgcaaagggtcagtggggaaatgggtcatctgtgagcagggttgatattggacttaatagttttgcatggatgatctataaatggctcttctctaatccttactacctacccaaatgatatccttattattccaacccaaaattagtgcaggagcttcctagctgccttgcctgtccctgtctccctgctttggagggtggatttgattttaaagtatggatcatgctatatcaatgtctacctgggggccttggctgcgacattcctgtttttgtaggacacggctcacatggctctcactgctggtctccacatgtccttccaccctcatttccatcacccagctctgcttccaggtgatagtgtactgaactactcaggccatccctctgcaggcattcattttccctggctccaggtcctaatggctaaatttgtattgctcctataaaatgtatttcagctgtcatcacttgctttagctttctttcatatttgcctaaagaccccaggagccctgccatctgtattcctgtatcatatttgtacaattatttttgttgttgtccatattgttaatttgcatatcacccaccagacaccgtgagatcctcaaggacagggactgttttctataataaaatctatcacatgtcatcaagcttggcatatcattagtctctcaacatattttaagttaatttgtctaatttctgaatgattgagagaagctaaaaacattggttatatgctttctccaaacgattattatcatacctgtgtgatttgtaaaataaatgccgacccatctcatactttttctagtagatatcttcctgaaaatttatgggtaaattaaatcatgtgaaatgaataatgtcttcagtgaaataggacagctcacattttaaagaacatcagtaatgaactaatctgtgtaaaagaatagttttagtctcttttcttatgtcacgttgactgtcgcttttacaaattgggaattttacaggttgagttgccttatgttggggttcctctaggtaaaggtattcatgcagttaaacttctagtaataagcaacaagaaaataacactgataaagtgacatgaggaatctgctcctgtgctgtaactatttcctgatgtcaaatgtgaaactgaacattttgccaaaagtctcaacttaaatcaaagccactttaatcaaagcagttgctaatgccagcagtacataaattgaggatggagcaaaaggatcgacaccaccaatggctgcattgtgataggtgtggacagagcctgccagaattaaacacatgccaggagtcaacactaggcaaaggtaaatgggataggtgctgtgaaacatggcagatcctatgggacttaggtgctcccaaacatggcagaccctatggggcttaggtgctgaaaaacacggcagattctatggggcttaggtgctgtgaaacatggcagcttctatgggatttaggtgctgtgaaacacggaagattccatggggcttaggtgctatggaacagggcagattctatgtgaccaaacctaacagaaacagtgcggtgagaatcgtaagataaacatgctattcctgtgatctgggtgaacaaacaaacaaaaacaggaaatacaactgcaaaacctagacagagaagagccaaaactgttgataaatataggaccaccttcgcatccccgtttgcgaaaatgttgataaatataggaccaccttcgcatccctgtttgtgaaactgttgataaatataggaccaccttcacatccctgtttgtgaatgcaatagcacaagaaaaagtcattttgaggatgggatagggaatgaacttctgatggtaatgctgtcttcaaatggttccgaattgaattttatcagaaatttaaatacccaaaattaatatagaaattgagaaccatcttatgttaagcactttttccttacacttactttccttcttttccttttttttgttctttttttttgagacagagtttcgctcttgttgcccaggccggagtgcaatggcacaatctcggctcaccacaacctccgcctcccgggttcaagcaattctgcctcagcctcctgagtagcttggattacaggtgtccaccaccatgcccagctaatttttgtaattttagtagagacgggattttaccatgttggccaggctggtcttgaactcctgacctcaggtggtccacccgcctcggcctcccaaagtgctgggattataggcgtgagccaccgcacctggacctgtctttcttacagagacctcttagcctcattcttttcctctccagtattccatatggcagtggctcaaggtagacacgttgcaaagaatgaacaggcattacctggatattcaggattgctttgctgttttattctgtgcagtgtttccttttatgcctgcttttcagccctatcctttctgcagggctctgggtcacaagctgggcaggaggagcagaacacagcgcctctaacaagtagcaggactggacgctgttggttaagtgttaggagaaaatgtgtctgctaatagggttatttgtttctttttttgggggaatttttattttttattttttatatataaactttaagttctagggtacatgtgcacaacgtgcaggtttgttacatatgtacacatgtgccatgttggtgtactgcacccattaactcgtcatttacattaggtatatctcctaatgctatccctccccaattcccgcaccccacaacaggccccagtgtgtgatgttccccttcctgtgaccaagtgttctcattgttcagttcccacctatgagtgaaaacatgcgttgtttggttttttgtcctcgcaatagtttgctgagaatgatggtttccagcttcatccatgtccctacaaaggacatgaactcatcgttttttatggctgcatagtattccatggtgtatatgtgccacattttcttaatccagtctatcatgttggacatttgggttgtgggactgtaaactagttcaaccattgtggaagacagtatggcgattcctcagggatctagaactagaaataccatttgacccagccatcccattactgggtatatacccaaaggaatataaatcatgctgctataaagacacatgcacacatatgtttattgtggttgtttcttaacataaaggtttaatccgtatgattccacttctgatttccagggataatttgaaggaaactataaaaatagaaggttaaaaaatatgtttgtcggccgggcgcagtggctcacgcctgtaattccagcactttggggaggccgaggtgggcaggtcctctgaggtcaggagtttgggaccagcatgaccaatatggtgaaaccccgtctctattaaaaatacaaaaattagctgggcgtggtggtgggcacctgtagtcccagctacttgggaggctgaggcaggagaatcacttgaacctgggaggcggaggttgcagtgagccgagatcacgccactggactccagcctagtgacaaagcaagactccgtctcaaaacaaaaatatatatatatatatatatatatatatatatatgtttgtcttcttgatttttcctctcctccatcatgtggtgatgggatgggaaaaggcaggttgtggggagcagtttggaggcccatgcttggtgggaaagagagggaggaaaattctagatgaacgaatgccgcttcaaaggaagaagcaaaagaaccatattaaccctgcttacaatcggatttagattggtgatatattctgtccacactcaactgggtttatcctgacattcaacagtgtaagtgacctgtactctaagtgttcccttcttgagaaaaggtgtgattgagcagcctgctgttgtctgaatttttgtctctcccttttccagaattcatatgtgaaacctaaccccagggtgatggtgttaggggctgaggactttgggaggtgatgaggtgatgagggaggagccatcaccctgataaaagggaccccagagaggtgcctttcctcacaccatgtgatgcacactgagaaggcgccatctgtgaaccagaaatcagattctcaccacacaaagcatctgcttgcaccttggtcttggacttccagcctccagaactgtgagaaataaattcctgttgtttataacccacgcattttacactattttgttatcacagccagaagacagtaagacaaatcccaacagagaagagtgcttctagaacctaaagtgcacctaccactttctagcaaagcctgatccacattactttaaaagtgacttttcaagcattttgctttggtttacctatttcttccacttacctctctcaagcccaaatcattagtttacacttgtaaccaattgctcgtgcacatgtcctaatgtttttgaatatacatatattaatacataatgtatcattcgtgtttgcatgtgggcattgtggataacttacatgtaattacagttgcaattacttagaatcatctacttcttcatgagctcgaaagtgacctcttattcttttttacaaacggagatttttttgtgaatgtaaataatggaaaagcttcccaaacccctcccagactccagctcccgccatgcccttcccctcaggcgctggcacgcccttacacacacacacacacacacacacacacacacacacacacagcctgatgtgtctatcagctctgaatctggtttttcaagtggcttgggtgggtctgcatatgaatttgaccaacctctgcgcgcgctcctgggagcgcgcatctgtgtgtggtccagggagccaaccgcgtttgtgaatggatgattgatgggaacagcgcccaggggcagcaggtggagacgggaacccaggtcgcggtcactggtcaacccgcctcttggggtggaggttagagaaatgggcgctgggatttggccccggccagtgctggggttccagggtagggagagccgtgggcgccagactgggctgcgggaggtcttcggggtcagatcccgcaggcagccaagagcgagccaaagaaacaaagccgccgagggacgcggctggggcggaggcccggagggaagtggaggccgggaagccaggtgtgcggcggggagagcggcccctgccacccgcgctggtagccgggcgctgccattcactgcaaggtcctctgcgccctggaattgccgcggcggcggatgcagaggccaacccagagtgcaaccatggagacgcgacgtgtgtcccatagtaacctgttacaacattatttataagctgccatccctagccttcccccgcttcccctccgctccctcgccagacttgcgggcgacgggcacagccgcgtctggctcttcccggcctctcccttctctcgcgggcgcagccgatcaatagttaacacccggctgcggacggcggctccatccgcggcaatcaccgtagtgcttgtttgtggaagccgagcgtgcgtgcgccgcgcgcgcacccagtccagcgcggagtgggcgtctacccgaggaggggtgtctggggaggggctgccctcgttacccaaacagtttgcgctcgcttaaccttgatgcagctcgaggcttcccagtccagctcagttcagacagaaaacctggcgcgcgcgcgcgcacacacacacgcctcccctggcgtcgccgcccggccgggtccctgcccttagggaccagagcggcgaccgctgcaccccgcaccgcctgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgctgaccgcgggtcggtccgagccccaagcagacccccagggctcttctggggaaacgcggggagaggtggtcacttcggccagggaagggccactgggccctggcgcccgcgccggcctcggtgctccgagtccccggaactcgagacctgttgggtctgcggagccttcggtgctctcggggcaggcgccagtcgctccgctccgttccagacgccgccgccgggcgggaccctgctccctggattggggacgctgactcccccaaaagcttgactgtgccggaggaggtcaggggcacttcgtcccccaggagggccgcgtgcctggaaacgcggctggtccgcggaaggctccgggcagctggccaggggacagttctgcacggataactttctaagtggaggacccggcgatccgcctccccagcgagcccacccgcctcgccgctccccgctgacccgcgcggcctgggcgcgcctgctctcgggctcacgttagtccggggcacggggccgaggggtcagggcgctggagtctctggcgaggacgagagagttgccatcttgttctgttgaaattgtttgtgtgccttcgtgtgtttattttaacccattaggtcatggtctgagaagaatcctctgacggtcccttattttaagttgctggctggcactttttttttttttttttttttttttggcgacagacaaggagatggggattgccttgctacttttgaaggttctgcagatttgcagatgctacttttgagggttccgtaagaattgaagaaattctttcaggggcaaggtccagagttgtttacagaagtgggttgggtccaagtgatgggggtgcagaggcacctttgcgggaacccaggcagtggtgcattttgagatctcgctttaagcaaaacaggcaataagtgaaaaattctacattaattgaacaaatacccagctggcttaaccacacccacggcagacacctgttgcctggcagagagaagcgccgtgggttcagaacttgactctggacggaggtgtgagtctctgggttcaagacacctcgcagggaagtaatcgccgcatggaggggcttactcttcaggaccctccccactcccgagacgacaagcccccatctaggggcggttcgcagtcctcggtccgtgggttctctgactgacctaattgcttgtttatgaaaatgcatctgcttccctcatttttcccactctttttcttttttagccattgtgttgttcagcataatttcttgcataaacaggatagaaacgtgtatggagtaatgctttttcattaaatgcccaaccacatccatcattcctaacttacgtgatgccatcatgtgctagggaaacctgtatatttagggctgaggctgaagttaaggattgaggttaattatactgataaggcaacattattgactcattacatcaatctaccgccaaataagtttctacttataacttgcatggcatgaaagagccaaatcttcatattacacctttattagaaaccttatggtctttgccctccccctaacccctctctgcgttttacttcagaaaataaagaatgaaaggattgctaattacatttctctcttctgctctgaataaggatattccatgtgatactcattgcatcccttcccctgtgtctaatgttaagaagtgtcatcggagcaaggtgaacctgagcctagagaattctacagcaacccatattttcagagttatttgtgggcccaagaaaacaatgagatgcacacttactcaaactttgaatgttcttatcaattcttgaattgataattatggctccacagcctgctgtgtaacttatttgaattttcatgttccaaggaaatccacgtggcttcagttgagtgatcatttaggacttacccatgcctaatctctcaagttgctttggaagactcttgctaatcacagcctctcttggattagatgactggcaaattctttgcactcacaacttgattgaaattcaggtgatattttacattcaagatgaggactgaatgatttactcctattactgacagctgagctgccgcacatctgacagctacaaaaagtggcagaatgttttctactttgcagtaacagtgaacccacatacacacagagaccagatctcagttcaggggactcaaagatctctgagctgtctggactcgcatttgaggtttgatatttaaaaaagagaaagacactttgcactgcccaaatggtcacggaaatgtcaaatccagttcagccatgcctgtaaactgctttctaatccagcccctgctcgctgacatccacattgtatgattgttctggacctgcagcctgttgtttcaccgggagttctacaagaatggtgacaatagcctcccggctggtccttgccatgccacattgcttagttgaaagtatgttcttataaaatctttaaaaaatgttttattcctcacatattgctttaggaatttatttctgagtacagctagaggattaagagaaggcagatgcaccagcatactatctgatcttgttttgttttagtaaatgggtaaaagaaataccacaggtggaatcagtttagaacttttttttttttttttttttttttttggagacagagtctcactctgtcacccaggctggagtgcagtgcagtagcgcaatctcagttcactcctcccccagggttcaagccattctcctgcctcagcctctcgagtagctggggactacaggcgtgcaccaccatgcctggcttttttttttttttgcatttttagtagagacggggtttcatcatgttggccaggctggtcttgaacccctgacctcaggtaatctgcctgtctcggcctcccaaagtgctgggattacaggtgtgagccaccatgactggccagtttagaacttctattttaatttttttttttttttttttttgagatggagtctcactctgtcacccaggctggagtgcagtggtgctatctcggctcactgcaagctccgcctcccgggttcatgccattctcctgcctcagcctccccagtagctaggactacaggcgcccaccaccatgcccggctaatttttttgtatttttcgtagagacggggtttcgccatgttagccaggatggtctcgatctcttgacctcatgatccacccgcctcggcctcccaaagtgctgggattacaggcgtgagccaccttgcctggcccctagaacttctattttaattcttgagaagagtctatttcataaacttataatactgtgagaattcacagactaaccatgccatattcaatctgtaatttaatatactaagagataaatattttttacttgctcgaaacaaaaattatttttttaaaaatagctgttattttttccataaaatctacatttcagagttccaagggaggctgatgtgcactttttcaacctaatcttcctttattgctgtttggttgatattctgcttgtttaacagaggtatatactcttgcaataggttctgaggttaatgggaaatgtcatcagaagggtgttgcttcgtgctgaattcccctactctgtccatatgagcttttttcagacattgagttgcttaatgaagttggagtaaagattaaagactaaacatcttggggactgtcctgtgacccttggcgtctcccccttccttggtgtgtgcattggtggctccaccagtatgtggtgggtaagtgagggctgtgcaggcccatggtgactacagcagtatcagaggaggttcagacctaggacacaaagcatcagaggtctgcaagccatgttgatccttgagaatcccactgttgattgttgttggttttaaatgaaagtggctgtcttgagttccctgtatagggaaagctggagttcttccttgtgctcactgacactggttttaggcctttggtcactggttgatgtatctatggcatgacgagcctaggatcttttcagaactattgtcttctcttttctatgttggataaaacatctgaatgtgaactttccacagtaagagttctctttcgggcatttgaccgttttgctgattcagttaaataaagcagaatggcattccagcgatgatgctgtacttgtaattagcccaggtgagcagaggctcgttgaggtttttagataagtcatgagagctcgtgtgggacacaaagcttctattatttttttttttctgagatggagtctcactctgtctcccaggctggaatgcagtggcacagtctcagctcactgcagccttcacctcccaggttcaagcaatcctcttacctcagcctcccaagtagctaggattacaggcatgtgccaccacacccagttaatttttgtatttttagtagagacgaggttttgccacgttggtcaggctggtctcaaactcctgacgtcaggtggtctgcccgtctcggccccccaaagtgctgtgagccacctctccctgccaaatcttctattattgaagtctgtggggacagcatttctaggagtgtggccttcagtaatgcaatatttttcctctgtctgagggtacttggtatcagattggtcacttggtaacaaaatgcttggtgctggttctaaatgggagcagtgtagcacagattttgagggaatttgccttctcaaaatgggttccaaaaattctaaggtcacagttttctgagagttgtcaccatgtgtcccagtggtgtgatacttaggttggtctttctctgcttgctagttgttcaacatcccttcataaaatcatcacccttataactagacgtttcttgaaatattgattaatcccatctgtgcaggaaacagtagctaggcatgggtctgtttcataatcctccttgcaggatttataggaatggggatactttaaacatgtttatggcccattaaaaaatgcagatttccagaaagaagatcccaaagccagaggtgatcagcacaggatgttttataaaatttcttcaataaaactgtagtgaagagggctgtgctgttttttcacagagctctgtttagttctttagttcatatatccactgggtctgagtttttcaacatataaatgtactaaattggctcttccctgttgcacagccatcatctccttttctgtaacctgtcctggtcagtaatcacaatactgctaacttgatcatcatttggactttgaaccctctgtgctattaccaagaggtgtggtgcttattgaaatatgaacatctagtattcattcgtccccatggacaagggctttgcacaggaagcatttgagcggatgaattcgttaaatgaatggatatttgttccttgcttaggactgcttagcataggctgtgcatttgtgagaaaggctcatggttttagttgaacgtttaagaactccttcaagtcctaatacatcaggtaacaggagagagaattccctgcatagagtattttccactttcagctacaaatggaaacttaggctcagtttagattgtaaacagctgatgcatcaatcttctttatttgaggaggcgtagaagtcaaataaaatatagagagcaatctctcaacttaaaatgttttacttgggaagcaagaattgcaatctgaggcatacacagaccagtggtcttcagtatgtctgaagaacaaagacgagattgtggattttattaggaaaggaaatgttacttactgttttggaagaaaactcattggccctggagaagcttttgagagctggcaagctctgattggtgagttgactgtggtaggtaaagctagagtcactgcaggttgtttcagcagttactaggtaaaactggtcttagaggtacagcaggctgtttcagcagctgagcttgtgggaaatttaattcttggagcaggtgctatgtgtccccagtactttttccctggccccgcaactcacacattgagttgcttaatgaaaatggagtaaagactacagactaaacttcttggggactgccctgtgacccttggtttccaaggaccacaaggattttattgggtatgacaagaatgacccaatttgtataatcagcttttgcagaggtaaatacatttagtccagatcattttaaaattttctgtttattaaactaaaataaattcagcaacatagaagaattccatgacctcttttggttgtgggagccaattttatttgatagcaagaccacattttagaactcaagagcgtgcctcagatcttctaggtcccttgaacatactaagctcagaacagacaggcaggcagaaccaagcagaattccccctttaccattgtggcttcctgggatgatgggagaaagggttccattcgggaagtagaagtttcaaaaacccatcttggacagtggctcttggcaatggctgaacagtagaatcagctggaatgttttgaaaaacccagtcatctatgggtgttgtggagttgggaatgtttggttaagtgtagaggttctcaacattgcctggagccactggttcctcctgcccccgacctcttccccagtacccacccctggcctagagatacccaggggattctgattccactgcttcaaaatgcagtctgtgcactcatatgtttaatagtgcttctgttgtgcagccaagatgcagaaccagtggatcagaggcaaattttttgaataaatattgccatcaaagcctaaggaaataattataacatttataagggagcttcttgaaaaatatgcaatcaagtcttgttccctgggttgtggaggccgccaaatacatggaaagatgggcagagaacacagaataaggagaaaaatgaagtgaaacatgcatgagagagaaaagtaaatagtcaccagggaaaagatgaggaaacatgctgtgtttttaagttttctaacctcagttatagactgaatttggggaaaaacaagaatctttaaagaaattcaattgtcctcctttcctttttcttcacgcccagaaaaaattaatcttcttgactgaaagatactctattatgtgtctgaggtccccccgaaaagttattacaaacccaacagggcaagtagaaacaaggagggtgatagaagaaagctgaaggctgccctcgaccagcagaagttgttctgggatttgcaatggcctctgaggggcctctgcaggcagctccctggactgctgtttcctcatgtgtcgaataaggaaatttgaatagattgattattcttgaagtccctttcaactccctctcccagttaagggtagcctcattactgtctcctcaacattgctcttaggacatgctttagaagtcaccttccatgccagaacaaatattttgttggcatcatgatttcttctgcattgacttatgtggcatctctcagctcgccagtcttgtctcagcaagcatgccactgtatacggggaaaacaaatagatggcatcaatgtatagtcctattggacacaaaatctagagcattcatgcaccagccttgatgacccaggaagactgtatatgtgtgtgtgtagcacaccatatacatgcatgtgcatgcgtgcacacacacacacacacacacacacacacacacacaatgttcatacatctcagatgtaaaatactggcaccattgtccagcatagctgaagatctgttggataagagctcctgtgggtgcaatcactttgactgcttggctttcttggatattaaaaaaataaccacactgtaataaaacaggagtgccaaggatgttctggtttccagtgtggtgttactcgtctgtgaaaataaaagtgaattgctggctagccaggccggccacaaggcctgttttgcaaggcaccaattggatgggatgggactgcactgggtctcactacgagaggtctaaggctgagcacattttcttcactgatattggtatttgaaaagtgggattttcttctctttttccctctcctactggactaatgcccctattaagccacacatagttttattttaaataattctcattttatggtattggtcctatataaacaacttttagtaaaacctccactgacagaaactcaactacaaacttgagcaaactggactaacagtctcatacgtttcattacattaatctaaaaaatggtacttctagggtatgttctgacttcattatacattcagcttaatattctataccttcttgtcctatatttttgggaagtgagaattaataattttcaagcctaaaggccaaatttttttttcattcttataaaaattattttgattgtggactacattttctatgatgaggtaaaaatgaattaacacatgaacaatttatctttaacaggctgggcacagtggctcacacctgtaatctcagcactttgggaggctgaggtgggaggatcacttgaggccaggaatttgataccagcctgtgcaacatagacagcatctctacaaaaaaatttttaaaaataattatccagaagttgatattatattatgtggctgtcatcctagctactgaggaggctgaggcaggaggatcttttgagcccatgagattgaggctgccgtgggccaagattgtgccaatgcacttcagcctgggtggcaaagcaagaccccgtttctttaaaaagtaatacataaataaatatacttatttataacagaaaatcaaagattatcttgttaaatggtagttttctagaaaattgcatttatcagaccaaatcatatcttgagcaaactttttataagagggttctgttttgttatttttcttcctatgactctgtaaattgtgcatctatttttttaagatctccaccctttcatttcaaacttaattatattgataacttatagttgtagagaacttacacagcttccaaaataattttgtctgtgctatgttattatgttagaacaacccattgtgttggaaagacagatattagttctttttttatggttgaaagagctaagattttgagagagtatatagtggggctggttatttgaggaggagctgaggtgctgacccatttccagcccaggttctttgcacaccacaatgtattctttcagaaattatcttctttccagttgcaactgaaaagaaacatagtgcctggaagatgggggagaaaaataagagatcaagtgggagagtatgtcttctgctctatcctcataggatttctagcctctgctggaacacatccaaggactggaaacttgtgccattgttgacaagttctgtttgttaaaatggtatttcttaagttcggaagatacatatacatacctccattgaactttcacctacagttttagcttgaagccttttaactacaaaaattttcttatccctacttcacatgacaacctttcaagtaagttccaacagttgccatgtgaccccttcatagtctcttttctagggaaaatgtctctatttctttcaacttatatatgaaagtttgatcagggtaactgtgaatttaacaacaagacaccatattttttattcaatcattgccatcgttatctgtttcttagcttccacaaatttcttcctatttattgttgttgatttgatagtcttcatactgttttccacagtggctgtactaatttaattcccaccagcagtgcacaagtgttcccctttctccacatcctcaccaataaatgctacttgtttttgagccattagtgaactgatagaaaacagcattctggaccgaaaaagtagattgtctccaaaagctgtgtggataaggagcaatgaaagaaagataataccaaggcaaatacctggaggatgtgaagccaagagcatcagaggagaaaaggaaccatcaagaggttggttagtgggtacaaacagacagatagaaggaataagttctcatgttcaatagcacagtagggtgactgcaattactaataatttattgtatatttcaaaacagctaaaagagtctgggtgcagtggctcacacctgtaatctcagcactttgggaggtcgaggtgggagaattacttgagtctaggagtttaagaccagcctgggccacacaacaagacgccatctctaaaaaaaatttaaaatatgccaggcttggtggcatccacctgtagtcccagctacttgggaggcttaggtgcaaggattgcttgaggccaggagttcaaggttaaagtgagctgtgatggtgccacggcactccagcctgggtgacagagtgagaccttgtctgtaaaaaaataataataattagaagagaagatttgaaatgttcccaacgtgaaaaaatgatcactgtttgaggtgatgaatatcctaagtaaacatacatcaaaatatcacatgtacctcataaatatgtataattattatgtatcaacaagaaaatgaaaacgagaatgttgaaacaggtggaaagatattcatatagagcctttgggaaatgctagtcactggacatgggaggaaaatggccgtcttcagttgcggtatcagaggccttccacaataagcagtgttaattggcaaacaggggctatgagaaacacacaagtgatgaaaaccagccttatttctactggaatctcaggtcttacctgacttaccaccatctaagtttgcatagtcacctctaaaagtgtgagcatcttttctgtgctttgctggtttgtatataacttttattcagatatctttcactctaataagtagttctttgcattctgattagttggctttatgaaataagtcaccattattcaagaagggaaaggcgagagacaaaggcattcggcttccattagtgtttggaattacagccacacacaaattaagggtgaatgaaaacaaatgccctcctgtagctgctgctggtattcctccccacctcctcttcactctctctcctcctcctcctttttctccttctcttatttatcctcctcctcttcttccttctcctcttcctcttccttctcctcctcctcctcctccttctcctcctcctcctttgattatcttaagccagatgtgtattcttacccaggtttgtgatatgtctacccttgcctttatgttgggaaacgtgaggaagctgagcccagctcccaggacagtttggtcgcctctaatcataccatccagccataatctcaggctgaaggaaatcattcattggcactaaagagagctggggagatagctgacagaggaatgcaatggatcgtctcgctcatccaccttttgccatttgtttgattttttcctgcaatgtgttttcttctcgtcaacttggccggaatggtggtaaatgctgtttttatatgtggacttacttgaaaaactgatctatcttagtcttggactttgaatatcattaaagttctccaaggaccttgcaaatagctgcttgccaaacacaatagtttaatataatttgatctctcactgctgcttagcttctgagaaatgtgttgtgctcaaagtgttcaagcattaattaaaattgagagcactgaaattgtcagcgcccactgactccatgtgagtgtgtaggtgagtgtgaatgtgtgtgcacaggcaggtgcaggtgtgtactcacatgcgtattaacgcttaggaagctgaactttgcttctttctcattaagagttgaaggctattatctaatcatgaaaataaaaactctgatggaattaacttgatgttgactctcagtttgatttctgaagataaaccagagtcatctctactctgaaatattaacgtattctagagagtggttcccaacatgatgtgacgctggacctgcgttatcagcatcagctgggagctttagaagaacaaaatcttgagcccacccagacctactgaatcagaagctcagagggtgggtgattctgatctgcattaaaatttagttctaagtgtacccattcgcaaactctttgtggtgaagtgccagtgatttcatttttgtttttaaaatttcgtggctcagtactttctcccatctttctgttttttttttttttctgagccctacaaactttttcaacctctgccctaaagctgctttcagattttcaggtatctttgtagcaatgccccattccttggtatgtgttgctataaaggcatacctgaggctgggtaatctttaaggaaaagaggtttattttgctcacggttctgcaagctgtacaagaagcacaggcaccagcatctgcttctggtgaagtcctcaagctgtttccactcatggcagaaggtggaggggagccagtgtgtagaaatcacatggccatagagggaacaagagagagaggaaggaggtgccaagctctttttaacaatcagttacccagggaatgagtaacgggatgactaactcattatctcgagggtaacaccaagccattcatgaggcgtctgcctccatgacccaaatacctctcagtagattccacctccacctccaaccttggggatcaaatttgaacatgaggtttggggggtggataaacatccaaactatagcagcacccaaaagctgaaagtgccatgtcttattttttattttcagccttatccgtagcacgctttatggtagcaaagaggtctacaagctgtggccccaaaataatttaactttcttactgtaacctttccattttaaatttgattcactgtagagcatttccatgggtagaactgggtcaaagagaagtctttcattttagagttttgttattaaggaagaattgggtattttcatactttttaaagtttatttttggctatgattacttacagtggttcattttttatagacatctaggaaatgttaattactgcagataagattcccaattcagaagccaaccacaaaggcttttcttcttcttcttctatatatatataaaggagataatgctaaaatgctcttatgcaaattttaaaattccctagtacattaacaatgctaatgacagttaatgcattcctgaagcttctgtgtgatccaaaatattcaaaatgcttagaaatgttttaggtccaccctgcaaatatatgggaagtggaattttgttcatggaaattagttccttgaaaatagattcagtgccaagtttaagagatgaagaagagctgaaaagtcagtgtagtgcaatatagagtcttctgcggataaaggtcgaaaccctcttttcccagaccaccatagtgggtaggtacagaatctcagataatcactgcagtttggttagaagaggaaattgcccttcataaagcaacacagaagaaggtaaggagaaagtggtattagattgataggtcaactaatgataatgaagaaactttctcttgctgacggtgatgtcagcttctaccaggactaacttcagtgagcacaggaatggcattgctgttcaatagggttataccctcaggtgggatgacagaagacagaccctcgttgtttctttgctgacctagggaattctgcaaagcagaaatatgaagaatgaagatgctgactctttacagacagctttatttaggtgaattcaggttgttacatggtcttgccacaagtgcatcttattctagaagttgtctgactacttcaacatgcatttctttccttctttcttccttgagctccttaatattaaatgcaaatgaggggaggcgtgttgaagttacactaaggtttagttgtagcaaaaatgtgctttgtgcacctactggaaattcccttgtggaatctttatagtaaagcctattggggaaatataattgaaaacaaaatcttcttccaacctagaaatcctctccacaaaggtagtagagaaagagaacacttttcttatttgaataagcattaaaccagaatggtgatgcacatcacagacaagatgctaaaagatcacaaagacagaattctcttatatagccaggcagatgcaacccattaaatacatgttttcaagataaacagtagctcaccctgaagtaagaggatttgacagcatcatttgtcaaatagttcatcctaactttactagctgcttactggctttatttagaggggggaaaagcctctcatatcttcatgatagaaggtagttttgcatattagagcaaagtgtccaccgatgttaggctccagaaactgggagacaggggttctgtctcccttgatgtttgcattttaaaaagatggttccagatctttgggaacaagatccccgggtcataaagctaacaaaagccctccctatctagtcttcacaaggatgcacttccaagagatgaaaaagtgcttataggccgggcgtggtggctcacacctgtaatcccagcactttgggaggctgaggcgggtggatcacctgaggtcaggagttcgagaccagcctggccaacatggtgaaaccctgtctctactaaaaatacaaaaaattagctgggtgtggtggcaggtgcctgtaatcccagctgtttgggaggttgaggcaggagtatcgcttgaacctgggaaggggaggttgcagtgagccgagcttacaccattgcactccagcctgggtaacaagagtgaaaccccgtcaaaaaaaaaagtgcttataattacaagttttcttaggtaaagctctaagaaaaaggagaagaaaacactttcctcctgattttcaacaggaagaagtaagtgtcttatttctagcttgtattagtccttacaagccagagcattcaaatgagtaaccgctacaatagccagcaaagctacagacacccagtaagaggaactggagcctgtcccaggcttgcagatgctgagtgctcgagatgttgacacaatttagccaaaattgaggatcaggagactgccaaggacaccggtgcttgatggaactattccctcttccaagaatttaagagcaagaaaaaaactcagccatatacttggagcagtggctttcatattcaggactaggagcatttgggttctgcaggatgtgggatggaggcatggctaaggagcagccataggggtgatcggagtggccacaggggtgatcaggcctgaaaagcctgccactcagaagcctttcttccaagagttgtttattcactgcttagcaatgagatcagcactttgcctgctgcatctcacaaagccctctgacaaccctggatgaaggtactaatatctttagttttcaaatgaggctcaaagaagttcaatgagaaaactgcccagggtcacctaggtagtaggtagaaaattagtatcccacttagatgtgtgtcactgtgtcatctgaagagaagagattaagcattgggcttgctagacaacaaggatactcttcaacatataaacaatcttattcaataaaatcttattaatgccctgttgactgaggttgcattaagagcatgtggaagcttatccgatgtttccattctctggtctctacttgtgactttgctttttattttctcttctgtgctggaagtgctggaaagcacctcatcttttgtcttttcagttgttggatttaggttccatgattaagggttgtgttgctattgttttcagtactttgttctctttctgtatcccaggaagtcagcaactgggccctgtctcctacagaagcaggaagaggactgagggttgagggacttttggtggttttctaaaactgtcaatcatcctatgtgtgacaagcagagagtttcctgtatctctgttgcctaagcaaaggagcaggtgggaaagtattttgctaactagcgatctaagatgaggtttttgttgttgttgttgtcatttttgagatggactctcactgtgttgcctaagctggacggcagtggcatgatcttgactcactgcagcttccacctcccaagctcaagcaattctcctgcctcagcctcccaagtagctgggactacaggcacgcaccactatgcctggctaatttttgtattcttagtaaagacggggtttcactgtgttggccaggctggtctcgaactcctgagctcaagtgatatgcccgcctcagcctcccaaaatgctgggattacaggcgtgagtcaccacacctggccagttattctttgattctcctgcaccatctttcaattttttacacttggggcattttccctgttctcagcaccctcatcagtgtggaccaggacaacgggagagggtaaacctgaattcctccaactctaatgactttattaaaaggcttgagggggagggcagaaagggtatagtggtaacagtgagcactttgaatctcacttaccctaatcatttcttgaatgattgaaggagtaatgggaccctccttattccttactcctaaattctcactattgattgaacgtctcatacgcaggcactgagacacctcagtgaataaaatatagtcctcgccttccttcttggggcttccattctagtggcagaaatagacagtgattacacagctaattatttaattacaagtctgatgcattctgcaaaaacattgtaagggccaagggaaagcttctcctttgccttctgaaggttcactgaaaatcaactgatgaaagacaggtgaacaggagaagaggcttacaaatttgatcacagttttacacaggagctttcggaatgaagacgcaaagatagacaggaagctgtccatttttatgcttaggttcaacaaactgtggacagctgtgtggaaataggattggcacaaagggtctgatctaatgccaatacagtgagggggaaagcccagtaagatctgcccatctagattcttcttggcctctctgcagaattccttccttctgggcatggggcagcaccctctctgtaatgggaggtcttatgacccacagtcgaacaaggcaggtcaggtgatttcgttatggtcagtttttacacagaaaggtggggaaagttggagtagtagttttaggttttatggctggcttttgggaacagaggatctggttcgtatgattatgttgggagagaggatcctagtttctctggccagcctcgggagaaaatgaggggccagaaacagaagagcaggagggggagtggggagaaatgtttgcttctgaggccttcattttgggttatcattttctgggcctcagcaaaagcagattgagattattattatattaacataagcattgtggtctaggtttggatgtttctacaaggtgtttcgaagcgaatgactcagtgaaagatacaatgggtgagaaagatggttctctcacattgtcaatccaaggcagaataaaaaagtcataattaaaaatatttcttaaaggggataaaatgagtatgtattggcaatttgctactacagtgaggtgtttaaaaagagaaaaaaaattaaatgaaatgtaaaatgaaacctgggtatctataacttgtgaaggctgaggaatagaagatacttcactgagaaaaggcagaggactcccttgactaggtgtaaggatgtgctcttgagatgctgggaacaaggaagtccgtgggagcaatggggaggaccaacacacgagcagcatctgctttgaaaagtggagactgaattgcggtttgatcctgggagcaaacaccaaagaacttagagctaataatagcgaagccataggaagagcagcaacagagaagcttgggtggaaggacttcgaatacataaaagttggaacaaaataaaccaaggagacaaacggaagtgttacacaggtatttttctttataagagaaatatattttaagagcactaaagggcctttgagctcagcttttatgaagaaatctgtttcaagatagaagagatatattgtaggtttctgttaaattaatggcaaataccactagctaagacaaagctagtgcttaagagctaagcattctttattttaattagtttattcttatggatttaggggtacaagtgcagttgtgttacgcggatatagtgtgtggtggtgaagtctgggctttttgtgtgctcatcgctcatagactgtacattgtacccactgggtagtatgtgacaccccacactcctcccaccctccaatctttggaatctacagtgtctattattgcactctatacgttgctgtgtatccattgtttaactcccagttataagtgaggatgtgtggcttttaagtttttaatttctgagttagggtctcactctgtctcccaggctggggtgcacttgcatgatcttggctcgctgcagcctcggcctcccaggctcaggtaatcctcccacctcagcctcctgagtagctgggaccacaggcacatcttaccatgtctagttaatttttgtatttttttgtagagacagggtttctccatgttgcccaggctggtctcaaactctcagactcaagcaatccacccgcttcaggcagctagggtgtgaggattacaggcgtgagccattgctcccaaccccagtttttaactttttgttgtcgagcaatttcactaaggataatagcctccatttctacccctcctggaaaagacaagttttcattctttcatatggccgagtagtattccatcgtgtatacgtaccacattttaaaaatccagtcatccattaatagacgcttagattgcttctgtgactttgctgttgtgaatagtgctgcaataaacatgtaagtcagatgtctttttgataaaataagttattttcctttgcatagatacccagtagtgttattggtagatcaaagtgtagttccatttttagttctttgagaaatttccatactgtttcccatagaggttgtattaatttacatttctaccaatagtatataaccattcccttttctctgcatccttgccaacatctgttgtttttttgactttcaaataatggctttctgagtgctgtaagatggtatctcattgtggctttaatttgcacttctctgatgatgagtgatgatgagcattttttcctgtgtttgttggccaagagctaagcattctgatggcttcgtgtggatcaaatcacagctggattgttcagttttggatgccaaatataaagagggacagacaaactggcattcatccagaagagaggaatcaggatcacgagagattagaagttgtattggtaaagggaatttgaataaatgatattatctaatctaggtgtgatagctaaatttatgtgtccacttggctgggctgcagtgcccaggtacgttgtgagacatcattctggatatttccatgagggtgttttggatgagatgaacatttaaatcagtggactttgagtaaagcagattgccttccctggtgcagtgggccttgtccaatcagttggaggtctggatagaacaagaggctgacctccccagagtaatggggaattctgcagcaaatggcctctggacttgaactgcagcattgacttttctctgggtttccagcctgctggtctgtccacattttggacttgccagctcctataatcacatgagctcattccttagtataaatctttctatatacgtatgtgtacgtcctattccttctgtttctcctgggaacgctgactgatacactaggaaagcagagatgtgggatggaggcatggtaagtgtttttagatatctggagggcttttatggaaatagacacagatttgttttctatgaatttgagagacccagatccctggattgaaatttagaggctggaagttttttttttttttttttttgcttaattgaaagaagacaacaagaattgatacattgatacaattcttttttagctgattgtgagtcagcaaaattcaaaacattgagttctttatagcttccgtgcatcaccacttgtgcaaggtactgtagaatggattcaatgtgcctgttgggaattagaattataaagaattttggaagtttctagtctgtcattgtttctggtaatgcatgctgtgaagggctaagaaatgtgttcatcccacagaggatgaaacaacagacttggtcaaaaaagtatagttatggtccttttaaatggaaaaattcagaccacagctggataggaacaaaatcctgaaaacagtgacagattcagtgtctggttattttaatactactcatgtgtagacatggatagaaaaatgcagatagtagagtaccaaaaaatacctattggaagtataaaaagaatggtaattaaatgatttctataggcacacagtctgataagagagagacctcattttatgtagctcttttactgaaaatgtggcatttatttttctgtattaattcaatgtatttcaaatgaactaaaaacctgccatcttcaaggatttcattatacgattccttatgaacactgtcataaaatgagtagttaactcatttaattttttgtgaatgaaaatatgaatggtcacatgttgaatttatttttatttttttacttttttgagacagagtcttgctctgtcgcccaggctggagtcagtggtgcaatcttggctcactgcaacctccgcctcccagattcaagcgattctcctgcctcagcctcctgagtacctgggactacaggcacgtgccaccatgccgggctaatttttgtatttttagtagagatggggtttcactatattggccaggccggtctcgaactcctaacctcatgatctgcccgcctcagccttccaaagtgctgggattacaggcatgagccactgtgctcagccctaaatttactttaaaagggttatacatgtgttggtaaatagcatcaagaaatacattccttctatgttatcgttattttaattctttatttttgtccccaaaagatttacttacagatcttggatgatcttgggtcttgaatgggcatgctgaggttctacctctgggcaggaagataggtgtgaagcaacctctaacagcttgtgcggaaaattacccccaggttagcaccagtgaggcacagttgttcagcagagcaggggctgggcattgttgtagagcagagccacgcccttccattccagagcacttggagcagttggtgtttatgctgctgggttgtttttattgaggacaaacatgcttttacatttatctatcttaaaaaaaacttaaaaactcacaagacaacttccctgatatgccctgtccccctccagctaccagtctttcccttgaataactcaatactataatgccactatttttaactcctcctcatttcctcttaaaaatctcccatctgactttggttcttaccactgcatggaagaattacctgtccacatcgcaaacgacctccttcccactatattcagtggtcagttcccacttaagtctctgaaggagctcaggaaatgacaccccaaaatacaccgctttggacttcaaacttccccagtcacttggtgaacagcaaattctgagaggagctttctgagtaccttttacctaccagacggatcctccagaggggacacaattgtcatgaatcccctccctagaacttcatcaaccagggactgctggctgatatcacaggagaggatattggagctgacactgcacccagacaggttttgtctcaggctgtcttctgtcctgctaaggggccattcacccgccctagaaatcatttactctcccctaagttgcctacatccaccctctctctcctatggagagggtatataagctttcggatgtctctgggtttcgagtattcatttttctttcatgtgatgctccgtgaatgtaatacacatgtatactttttctcttgttaatctgtcttaagtcaatttaatttgtagcccagccaaggaacttccaagagtggaaggaggccattttcacccttccagggcctggcagcacttttttgaccactttctttctttctttttttttttttgagatggagtctcgctctgtcacacaggctggagtgcagtggtgcaatctcggctcactgcaacctctgcctcctgcgttcaagcacttctcctgcctcagacccctgagtagctgggactataggcacgagcccacacccagataattttgaccactttctttattgagcttccaggtcacccttccctccatctcaggggctgcttatttccttttcctggctgcctctccagcccagggctcaagcatcattcttctgccttttcctagatggcctcattcatctacatagctttaagcagaatctgtgttctgaagacttctaaatttgcatgtcagcctctgagctttaggcttttacaccaaatttcccccagacttcacctctcacgtgcctaatgggtcataaaaaccagcagagccaaaacagaactggatttacctcttccacccctttctccctgggcttcctgaccttggtgcacagaaccattgttcatcctaatattcaggctctgaagcttgcagcgacctttggtttcgttctcacttcatagctcacagccaatccccacatcaacaagcagctcgggtttcagatgcatcacatctgaccacgtctcccctccctcaggggtcccagttcagtcagtgccatcatcctctcctacctggactgcaagtggactcttacttggcttccctgcttccactttgggtcagagacacatcatgtgtcctcagagacaaattatgagtccagagtgatcgttttagacacgggtcagattacttcactcactagctctgcactctgctaggataaaaccatatttcttactgagacactggctggctgatgtagaggcctccagcctgacccctagccttgctggggtctcaggggcacattgagtcttattgagtcccagctcctttgcacctgcttctccttccctgaaaccgtcttcacccagatgttggcttgctctttgcagagtgctcttcctgtagaccttcatgctcaaatcgttgtccacactctgtgccccttccccagtatcatgatccctgctcagtcactcgctgtccacaccctttcctttcactgagatcatagtgtatgtttattggttggcatgactattatctgtctccacagctaggatgtaggcttcactctcagggatcttgtcttgtcttgttcactttttgtatccctagtagatgctctcccaaatttagatggaatgaattaatgtgggggaggagttgttcagaatgtgatttaatacataaaaaacttttggctccccactcccttcctctctcagtttgcaatggaaagtgattgcaaagtaaagatagtacagattggtaatttggtaatcactgtgtcagtgtggctcacagtggcaacattatcacatgcagattaataaattgaggtcaacagaaactgcttctgcatgcagagaatataggaggacagagaggacagagatacatatagtgttatattactatcaccaattcagttacaatgctgttaggttttgtcacctatttttaaataattgtcctgttacatctttttctttttgcggaaggcaccagtttagcatagtttgtgcaatggctgtccattaaaatcttagtaaggtgataatccaaatcagatgctgtatagcctatgctggtttaagtcctgaagtacttatctgaaaacttcgggttaaattaggaattcagaacttttcagaattcaagaagctaacacaaattgtctttattatgtattaggtaacatccccagtggtgtctgaggcaccatcccacaaacccattgtaatttctgccaaaaaaaaatatgtacactaagtagaatcaataaatttaccagtggcttcatatcagttcctgtaatttttgccactgaagaagttcagagaagaaaagattttgtctccaaatgagtttttaaggagctttattggatgaaattactgaaacattgaaacatatacacactcaaataaaacgaactggaaccgtcgcaaaggatgcagaggaggtggcctgacatcagctgagaggggaggtcagagagaacccagggagcgagagcttcatgaaagagatgcagctggagttgcactttagttgaaggactcctctgcaaaaagctgaatcctccccagcctggatccaaattctctttcctattacatttcagctgccaaaatagctctttgaatttggtgcttagaaggatttagagatactaaaaattgcagcatttcctacagagctatttgtaagaggaaagcaatggaggtagagaagtgggttgttgagaataatagggtgaacttgaaagaggaaaagatgaggattaaaataggggcaatcttcctcatgttgaaatttctgaaattcagtattctctaaggagttgcactctaatttttcttaagggggagaaaatgaaagttttcaaatcatacacgtgcacagacacacacacctatgttttgcagggaggaatagctgagctgttagagccccacacagcaggtaatctctttggcctcctcattaacactctaatcagcccttttgcagccattctaacttaagaaaaatagtaaacctctgaaatagccttaaaaaagatgagtgtaaaccacttcagtctagcttttgaacatggtgtctattgaaaaccctattatgttagctggtaaccaacgatggaggtttcttctccagtagtaactgtgtgtaaaggtttttatgcttaggactgtgtttaggagttgtgatacattttatttagttttgagatggaatctcactctgtcgcccagactggagtgcggtggcacgatctcaactcactgcaacctctgcctcccaggttcaagcaattctcatgcctcagcctcctaagtagccgggattacaggcaagcaccaccatgctcagctaatttttgtacttttagtagagacagggtatcaccatgtcagccagcaggtctcaaactcctgacctcaagtcatcacccaccatgacctcccaaagtgctgggattacaggcgtgagccactgcacccggccaacatatcaattatttggtttgagctagcttacaataaaatcactcttacaacagagattcattgtttcttcatgtttctgtaagctgcatttaagtatcataaagtctaaaaattggataaaaatatgatgactgaccttaatttctacctccctgggacttggttctagagctgtagtttggaccagcactaagtctgtcttaccttttttcccctgataaatattcagtatttgaggaaatcatcacatctccctttagcattcttttggcaaggtaaaagactactgaatccagttttggggaccattgttaaactttgctttttcagaccttagaaacatgttaaagtcttgcaaaggagcccttggcataactgtgtgactagatatgctccaaagctctagaacatgatgatgttccatgtacgtctccatctgagtaagggggggaagagggcttggctggtgctggatgggtctcattcaatgcaatgccaaactcttaacatttgaaaattatatagtagaaatacggactttcttatgaatgccaagaaactgcttgcttctcctattgtctgaatagccagagagaatacttgcacttactattcactgaaaactgacttatttggtgataacggtttggctgtatccccacccaaatctcatcttgaattgtagctcccataattcccacgtgttgtgggagggacctggcaggaggtaattgaatcatgggggtgggtctttcccatgctgttctcgtcatactgaataagtcccacaaggtctgatgattttataagggcagagtttccctgcacaagttctgtcttccctgccaccatggaagacgtgccttttgccttctgccatgattgtgagccctccccagccatgtggaactgtgagttcataaaacctctttttctgtataattaccccagtcttaaatatgtctttttcagtagcatgagaacagactaatacatatggctaagtcagatcctaagtccaggaattccccagttctccataccttccctggagctgtatgtttataagaattttctcttcagtaggagcccttttaaattgcagaagtgctttcttctgaccacagccctatctttgagggaatagctttattgagttattgtttgcatagcatatttaagagtacagttcaataaattttagcatatttagagttgtgctaccatcaccacaatctaattttataacattcactgcatttggaaaggaaacttcatctcatctcatgagtttattttgaatgtggatcttcttggaaaagtaactgattcctcttctttacagataaagacatcagcgttcggagagattgagactgcctttgttctttattccacagggcccagagtgcatcacccaagaaagctctctgaccatgcatggtcaagtataaaacagtgtacgaatgttaaactagtgttagatgatttttgtctatgctgtggggctcacctctcccatctctcccagtctcatccataactgggtctgaactcttgcttttatttattatttaaaatttcaaactatcttgtccttgtctagctaaaattgctaatgccctttttaagctttccttaaagggatttaattgttcagcagtagaatcttttctgctgtacgtgtgatttctcttggaggaagtgaattctttcttataagtgagtgtcaaggggaaagcacagaacatcaggcttaaagcttgagttgtggccctatgatttcagttccatatacagaaatccatccgcccaacaaagaaccttctaaacattctacagacttgtccaaagtgactctactgtgtagcagagcagagaaaccaagtttgtgacccattttctggcatcctaaaggatatctaagaacctagtgatgacacccccagtccctagctcctacccccatgccaagctgtctcccactcattgcctctggatcatggtgcaacttgccactccaagaagatccacatgcaaataagctcatgaaatggaacgaggtttcctagggccatgtcctactcacatttgaatgaccatagttttagcaagatcatctttttaagaatagtttgcttctttctaacaccgaagtgaaattggtagaaacagagagaatcaggatcagaattaaagagacgagatagctctggaggcctttgaggacagtcactcccatgtgaagtgaaaacaaaccaagggtagcagtggcccctaccactgggggcagagatgctggttgctagaatggcaccaggggtacagaaagtcaccttctgctcctgtgacttgcttatcccatgctgcatgggtgtgaaaggttctgatgctactctttgtatttttggtagagagacaatgaatcagcatttcaagctacaggcaaaataaataatatgtttagacatgtcttaaaggattaatacttcagaatctgagaaagcaaagttagtaaacccaacctgggccagtggtggacacactaagataaatagctcctctgatttttatttatttatttatttatttatttatttatttattttcgagacagagtctcgctctgtcgcccaggctggagtgcagtggcgcgatctctgctcactgcaagctctgcctcccaggttcacgccattctcctgcctcagcctcccgagtagctgggactacaggcgcccgccactgcgcctggctaatgtttttttttttgtatttttagtagagatggggtttcaccatgttagccaggatagtctcgatctcctgacctcttgatcctcccaccttggcctcacaaagtgctgggattacaggcgtgagccactgtgcccggccctctgatttttaaataacatgttcttggagaaagtggggcctgaacagtcagtcacattttcttcccctatctccccttccctcctgtcccctcctatctcctcccctctcctcccctcccctctcctcccctcctctctcctcccctcccctcccctcttcgaagtctatctctgtcacccagactggagtgcagtggcacgatctcggctcactgcaacctctgcctcccaggttcaagcaattctgcctcagcctcccgagtaggtaggattacaggtgcccaccatcacgcccagctaatttttgtatttttagtagaaacggggtttcactgtgttggctaggctggtctcgaactcctgacctcatgatctgcccgcctcggcctcccaaagtgctgggattacaagcgtgagctactgcacccggccttcttttttatttttacatatccttaaggactaggaaacatttgggtcacactggtgcttacattcaaacctataaacaggaattaatgtatttctttgccatttattttataaattttattactctgtgtgtgtattttaaagaagaatttctggtgagttttctattcttatttgtatctattacttacctcaatggcttgttccaacatgattgttgtgtgtaaaagtaatttgtgaatagagcatcgctgattagtgttgtcacaattgagcgagtgtgtcccagagctttgcttttcacactcgcacactcatatggatcatctgaaaatcttgtgaaaatgtagattccattcagtgggtctggggtgggacctgggattctgcatttctaacaaactccagagagatgtggatgctgcatctgtgagctgtgctttaagtagcaagttcttatagggtctacagtgtgatgaaccagacagggccaagcaatgcaggtttccccagagatgagcacttcctgcccctcagtctgtagggattaggacacagtgcctatcacagttggcttgtgggaatatattctgggagcagaggcctgcttggagaacaaatgtcctctttgctacgtttttccagcatttaaattgatccagtatgggactgtacagatagcaagaaatgcagatgaacttgggcagtgttaaaacctggatatcctccatgaagcagattgggtctggcccatgctggtggcagtttacctcctcccgctgttccctcttccctggccactgagggtttataaacttgtgaaggcgtggagactctcaggaagttgctgccacatttctctctcttacagacgctaagattccctttcagtaattgaaagtggtctgaaggctctggaaagacagaaatgaaggaccttctttaaaaacaaacgtttacagcaccttctcgaagattcaaatttcgtggattatatgtggttattctagtgtgacatgcgaagggtggataggtacctgtttttaaaaggtatttttgttttgacatttcgtatttccattatttcaaattgcatcagactgaagtcctagcaaaagtatacattacttttatctttccattcatgggaaaatgaaagaaaatgtttcagagacttttctaaaaagatttgatctcctcagtgttaatatccttagctacccaattcagaaaattacagatttccttataattggtttacttgattatttaggatgttttctgtcatcctgggggatgtagaatgtgtgtctgatacagtgattgttagttttaaacaaataagaacatgctatatgtgacacatgcacacctcgtgagctgaactggtactttaactaccacatggcacatttattcccaaagctattgggtcagataccattttctggaaataaccgagtcataaatgatggcgtcttattggtctctacaacatgaccctaggacactttgactgctgtgaaactggcacttaaaatagagtgaaatataattgaaaattgcacattgaagatttcttattcattccttattattagctgcagaaatcatgtgtttatagacctttttcagttggatatcttttgctattttaaaatgattgaatacgttagtcagtttgactatttctgccaaggcaaaaagaagagttaattaaaacacacacacacacacacacacacacacacacacacacactctctctctctctctctctctctttttctgccaaggcaaaaagaagaggtaattaaaacacacacacacacacacacacacacacacacacacacacagtctctctctctctctctctctctctctctctctctctctctctctctctctctgtctctctcactactggtgatatcatctctgtgtagccaagcagaccactacagatcattgcttttcttagaaattacagccgggcatggtggctcaagcctgtaatcccagcactttgagaggcccacctgggcagatcacttgaggccaggagttcaggatcaacctggccaacatggtgaaaccccgtctctactaaaatacaaaaattagctgggcatggtggtgcatgcctgtaattccagctacttgggaggctgaggcatgagaattgcttgaacctgggaggcagaggttgcagtgagccgagatcatgccactgcactccagtctgggtgacagagcaagactctgtctcaaaaaaaaaaaaaaaaaaagaaaatttgagtaataaaatcagaactatcctgtgtgcctcggtacagtggagtaagaatgtctgttcctcatgctgtaccccattcaaaacagttgaatgcatggcttgagaatgggttgtaaaccacagctggatttccttggccttattcttgaactgtttgtaattggtgagaaagcagtgagcccagcagatggagaatttgctacctgaggacactcggtgtcatccaggtgctaggtgatctgactctatgtcatccttgcaccagtggaagattgggttatgcctttcccctagcaaactctcatgcagcctcctggggcaccagtgcattcatcgtccgaatgcctggctggggacaagaccagagggcctgaaggaaagctggttccaggaggaacccaggctcattcttggcctcatgcatgtgagtccttaaacaccagtttgcacatattcagtgctacactaaactctacctctgcctaagttgaatggttgtctactttgatgaaaaaaaatgtgtttaatagaggacttcctcatgtaggaaagcagaaatggtaatttacagaggataagaaaaagtacacgttaatccaagaaatacaaactcaggtggatgaactgcagaggccaggagtcagggggaaataagaattagccccaataggtctgttttataagcacagagaacaacatgcatgtaatattgtgtcaaatacttctaaaaaatgaaagcttcggcctctgtttcatgaatttctccgttaaattattcagtctgatttatgagctactgtttaatgtattttagattggggaaatcaaataggagtggggtggatgtaattgtatttattacaaatgtgagttgcttgttcattgagattattataaagttggccagagaatggattgacttttcaggtcctagacacacctgcccaggaagtaacgtcactaatagtaatagtacctggaggtagcatgagcttattgatttagttttacttctgcctgaggccaaaatgtcctgcagtagtaatgattcaaatgtacctcatggaaatcaagtgaggtaatgcaaagaacatgaaatccacatacttgctgctgttgacagaaaactgttccatgccaggcaggatctagccaacaggctgttgtagattgctgataattagcttccctgaaagtcgagggggtgacctgcagacatgtcactgggttaataatttctgtttttgtttttataacttcccttgaagcaaagttctttcctgtgtccgggtcttcccagaattggctgagagaaccgacaagcaactggcttgctatccaaagtgctaaagaatcttttgcgatgctgtgtggcaacaatgttgcaatcattaatagaactgatctaaaaggaagaaagagagaaagacaagaggcctcaaagcagcgagaaaggttgctggaggtactgttccagaatgggttgtagaactcccagctggtggacccttcacttacttcctgtgtaggtagtcaacctttttcttttatctctctctttttttttttttttttgagatggagtctcactctgtcccaggctggagtgcagtggcgggatctcggctcactgcaacctccgcctcctgggttcaagctgttctcctaccttagcctcctgagtagctgggattacaaacgtgtgccaccatgcctggctaatttttgtatttttagcagagatggggtttcaccatgttggccaggctggtctcgaactcctgacctcatgatctgcccacctcagcctcccaaagtgctgggattacaggcgtgagccaccgcgcctggccctttcttacacgttattaatattaatacaaatgtgtcaccaatttcactatcatcatgcaccaaataagtcacttcctagattaaaatactaagtctcagaaggcttaaataagggcatctacccacacgatcctgaagttctgtgggaggttgtatttatctttcacaattattgaattccttgctctatagcgagaagatctggccacatgactttccctggccaatgatatgtaggagaaagcgagtgttaggagccacttgtggctgtgtctctctttttctgctgttagatcagcatgtattttaggtacaggctgtgctgtcagcctggatcccagagggaagaagacacagagcagggtacccttggtggatgctcggcaagagccgggagcaagcctctcctcctcaggcctctagggttctggaattgattgttatcacagcataactcagcccagcctgactgataacagacatcttaagtattaggatcttcagtttatatttatttaaaatgatgttatcttgtcacattgttccaaaaactattaaatgctgcttacaaaatacatccaattcagtggaattaaaatgaataaagcacataactcataacatttttgagtaaaagaaaatgagggtagagaaatcaatcaaggccaaggctgacaccgtttgatccagtaaagtgtgtgacgtgtctgcccaaggccagccacagtgccactgtaaagagggaacacattgttcacagcctaaatatacctgactgttttcatctccagcaagctctgcacacagtgagtaatagcagagtgagaattaaagtgtgctactttatcagtagctgaacaggtacataatggccctttaaataaaatgctggattaggacacatcacttaggtctccagacttagtagagtgtcttaccttccgctgtttcttctcaacccccaagtctaaattttgattcaagcaaacttgaaagtatctgcaaggcgagaaagttagctgggtctgaggagcaggctctggccaagctgacacacccagctgtgcattttggagagtgctgcaaagcaaagtctcaccagggcctgcctctctgcctactgcatgggaacaggaagcctatcagagccgacggctttgcacgtcaggcccagcaacccaagggcactattgatctggttcaaccgatacggtcctgagtgggagtctagaggtaaggacacggtgtgtagagtcagtgatgatgactcgatggcaaggtagaaacacttcccacgctcatacaaactgtaaacccaagtgggtgtacttttctttgtttaaaataaaaagaataattggctgggtgaggtggctgatgcctgtaatcctagcactttgggaggctgaggcaggcagattgcttgagtccaggagtctgagaccaggctgggcaacatagtgagaccccgtctctataaaaaattcagattagctgggcatagtggcatgcttttgtattcccagctgcttgggaggctaaggtaggaggatcacctgagcctgggaggtcaaggctgcagtgagccgtggtagcaccactgtactccagcctgggtgacagagtgagaccttgtctctaaaaacaagatgaagcaaaatgataatctcagccacctgtcaccagcttaactgcatttctccaggtctgagaaacaaattctatacatatttttatgtctctgatatcattgtatatcttataaataatggtataccatattttaattgggagtaatttttctttataaagtggtccataaaacagtgttacatattacaatcaataatctcttagatttgatgaaatgtggtaaaagaacatttaccatggcaaaaataccaccttgcatcaggagagaaagggttctatcctgaatagcccacgctgggtttaaggagaggccttagcgagcccccagcactctgacgtgtctgacatccagtctttggacaacaatcaaaaaagggacatccaaagctggcccatttcagaaaaggcaacgcagacacctgcagtccctgacatcagtgattccaaatgggttgggactctttgatcatttttaataaacccaaagtttgcagctcaaaatggccagagccacgtagtgagtgatttgcagaagcaaatgcaatgcttggaccttcaatccccagaaagcaaggatggaatggtgaaaccagctgccgccaaacagccaggcagtgggcgtcctagcgggaaagaggaatagaaggatttgagattaagcaggcactgaacacctaggagaccatccttagaatcccagtctctttatgttgaaaattattgcctgttagaaagacctgtttcctaaggcaaagggcaaggtgaacataacatccatggcattaagatgcctaatgccaggtttattatggtatgtgtatgtgcacgtattttctatcctgcatgctaagtatttgaagtggaacttgcagacaaccatgtggagtgatggattaaatttcccctttcttaggaagttcagaagtccaaggaggcagtgttcatgaatagaaggttccttcatcttggcccggcgtggtggctcatgcctgtagtcccagcactttgggaggccaaggcgggcagatcatgaggtcaggagatcgagaccatcctggctaatatggtgaaacctcgtctctactaaaaatacaaaaaattagccgggcatggtggcgggcacctgtagtcccagctacttgggaggctgaggcagaagaatggcgtgaacccaggaggcacagcttgcagtgagctgagatcgtgccactgcactccagcctgggcaacagagcgagactccatctcaaaaaaaaaaaaaaaaaaaaaagaagattccttcatcttagcggggaggatctgaaggagtcaccctggttacatctttgtatctcaccctcacaatgctcatttagtcatcggtggatccctttaaatatcaagtatgggatacaaaaggataatactagaaaataaatactaactcagccatgctatggtttaaatatcaccaggcacacaagactcaagaactgcttttcaaatccatgaacatacgtgtctacagtcattttctagctgggtaaccctgagctggttatgcagtctctctgttagtttccttatatgtgtaacataaaataacagtaatgtgtattattgaggatttttttttttttttcgagacggagtcttgctctgtcaccaggctggagtgcaatggcgcgatccctgtgatctccgcctcctgagttcaagcgattctcctgcctcagcctcccgagtagctgggattataggcacatgtcaccacgctcaactaattttttgtattttagtagagacgaggtttcaccattttggccaggatggtctcgatctcctgaccttgtgatctgcctgcctcagcctccccaaagtgctgggattacaggcgtgagccactgtgcccggcctcattgagggttttgaggaggtttaaatgaattgatattggtgtttgatgatgatgacaatgatgatgaaagttgttattaaaccatcgctccctccctgtggccagccttcccaccttctgggagatcttattcaatcttttaactctccccttttctagagctttccttctgctttctggatcacagcactgggaatgtggatctgcttttagatcagtgctttgagaagtaggagaacaactgtggtcgtggcggttggtctttgatgccagtaagcaacagaccatctgccttgttgttgatctgagtcattgatggccagattgaaagagcagagggttcctgagtcccaggtgttgcaggacgttgtgtgtgcccacaagccaggctacatggcttagagcagcagcccaagtgctccgttggttcagggggtagcaggggtccatggagaagtcagagtcctgactgccagtgtttggaggcatggtttctgtaagcttgttgcgcagcagtcaagaaagatctggactcgaggacattggtgtcagtgtcacctacctagctacacttggtctggttgttgacattgtacttcagggctgtgggtcttccagggccaggtcagaagcctgctgatcgacccaaagtgtggatgatggaagctgtggagcagggctgagggtgaggagagaaggagcccattaaccacaagctcagagtatactctgattccctaagaaggctggtccaggaccttctgagtcaagtctgaggttctgatgaagggagaccatccgcatagtagaaggtccccaagattctgatgaagggagactatctgcatggtggaaggtccccaaggttctgatgaagggagatcatcccgcatggtggagggtccccgaggttctgatgaagagagatcatcctgcatggttgagggtccctgcagttctgatgaagggagatcatcccgcatcgtggagggtccctgaggttctgatgaggggagatcatcctgcatggtggaaggtccccgaggttctgatgaagggatatcctgcatgatcgagggtccctgtggttctgatgaggggagatcatcctgcatggtggagggtccccgaggttctgatgaggggagaccactccatatggtggagggtctctgcagttctgataatgggagatcatcctgcatggtagaaggtccctgaggttctgataaagggagatcatcccacatggtggagggtccctgaggttctgatgaagggagatcatcccacatggtagagggtccccaaggtttggatgaacggagatcatcccacatggtggaaggtccagcctggcagtgtgacccaaagtggcttccctaatctttctgagcctctgtttctacaaactctaaagtgcccactcaccaggggtaactgttgatttttactttggctccacaatgtgagtgtctggtatatttccagttacatcgtaggaactcctgtgatggcatgaggagggtgagggtgatggcatcccttgatgattcctgccgaccacagcaggtacctgcagtccctgtagttcctcagggacactcctcacacccgttagggaacagttcaccacagcatccttccacgtcctctctccaggtgaactcagagatctgttcattcaacaagaattgatggggcacctgagtcattcttctaaggtagttgacattcccagtcctgattcatggttgttccatccttatctcatctgttacctgtcaccgatcatgtacacctttctatctttgagtctgttttgcacatatatacaagtaaatcacatcgaagtttaaattgtctcattaatttgtgaaatgtgattacaaaattcttgaaatcacatttctatcctattaggaaagcaaaaaggagaaaacaattttgaagcctaactcctaagagaattgctgtattacaaggagacagggatgctgtgaattcgttacaggaaagaggatgtcagccctcatgcctttgtctcccaagggcctggactttcctccacttgatttgtagagagtgcttttggaagatgggtgtgttttatttagatggtacaggtgtcagaaggtaagaggtgtgatggaagttgataggtgactgttacttgaaggaagggggaatgaagtctaaaaggttagctacacattttatctccctgatctccctatgatgcaaagaacccaagaatgtgtctttgtaacaaaaactggttgttacatggacagtgatcagagaaatcacttgccgattagaatttctccctatgtagcattccatgaaataaacagacagctgctcctggttcccccagaaaaatacagatttgtaaaaaaaagaaaaaaaaaaatactacttgttaccaaaatgttttctgagtatattcttttatcttacagaaaacatctacgtattttaaattattgttgtggaaaatgtatacacacacctacacattcattgtaagaaattccaaagtaaaagtttacctgaaattctgtcatgctgatatttattttttaagttaaatttttttttttttttactgaaagtaataattggctgggcatggtgacttatgcctgtaatcactttggaagacgaaggcaggaggattgcttgaggccaggagtttgagaccaatctgggcaacagagttagaccgtgtctctaaaaaatattgacaagttggctgggcgtggtgctgtactcctgtagctctaactactcagaaggctgaggtgggaggatcacttgagtgccggagttcgagtctgcagtgagctgtggtcgtgccactgcactctagcctgggcgacagagcaagacccattctctaaaatcaatgagtaaataaatcataaaaataaaaataattgtagatatctgtggggtacaatgtgatgttgtgatacatgtatactttgtaaaatgtgatatatcagctttaatattttggtggacaccctttaattcatctctgttacaatatacatatactgtatggaattgtgtgtgtcataaatgaaaccatggcttctacttcagtgatatccattgtaacatctactgggaaggttggatgcccagaagatatggccaactaaattactcagtgtatgaacaagaagcacatcatgtcgtcttaaaagtgattgtgttcttatacatttttattgtggatgagttagaaaatatggagaagatagaaaaggtgctaagagtataatccaaccaccctaggaagactttgtcttagtccctcagggctgctattaaaatgccatggatcttctggatagctaaacgatgggggctcctggagggtggggctttcaggtaaggcatggataccttgccctacccatctcttcctttggtgttcatcagtatcctttgtagtatcctttattaaaaacagtaaacatcagtgcacacttaaaagcatgataattgccaaaagaatagcttctgaagaccatgggttcagaggtctgaaacttggaaatcactcaagggaccctccgcctctctttctcttgcgctgtctcccagatgctgccacaaccagttgaatggtataacattaacaataacaattaattaaataaaagatatcatacactgggtagcttaaaaacagcagaaatttatttctcacagttctggaagctggaagtccaagatcaaggtgccaatagatttggtgtctactgagggccagttttcttttctttttttcttttttttttttgagatggagtttcatgctgctgcccaggctggagttcagtggcacgatcttggctcactgcaacctccgtctcccaagttcaagtgattctcctgccttagcctcccaagtagctgggattacaggcgtgcaccaccatacctggctaatttttttcttttctttcatttttttttttttttttttttttttggtagagacagagtttcaccatgttggccaggctggtcttgaactcccaacctcaggtgatctgcccacctcagcctcccaaagcactggcattacaggtgggagccattgcgcccacgagggccacttttctgagtcaaagagggtgacttcttgctatgtcttcacatggtacaggggacgaagaagatcctttgggctcttttatcagggcaacaatcccattatgacatctccacctccacagcctgatcatcctggaaggccccaccttttaataccatcacgttggtgattacatttcaaggtacaaattttgggggacacagacatttgcaccatagcagacttacattgattttgtgctgtatttttttcctaggcctttaacttatatatttcaaaacctaattagaagggtatagttgagagacaggatagccaagtggacaagagtccatgccgagggagcaactcgtgtggagaccctggacgggaagtctccccgcacgtcgattcagagaaaggtaacggaataaacatgggagatcttggtgggagaggtcagagagagcgcggagggccagaccctggcaccttacagcatcctacatacttgggctttacctccagagagatgacgtgactggaaggtttgagtcgaggagtgaggtggcctgaccaaggtttgatgggactgccctgtctgctgtgttgggaagagaccacaggtgaccaagggctgaagcagggacacccttcaggaggctgtttctctaattcagccaacaagtggctgatgttcctgcacactagggaggtggtgatcagatatgaaaaaacagcattccaggtcagataagatgtggggaatgagacatgaggatgggccaaggatgagaccaagatctgggcctgagcaactggaagaatgcagttgcttcgtgttgtgattgggaaagctgtgggagaagcggtttggggttgaagttttctgttttgcagatgttgggtttgatgtcctgggaagttgaataaatgagtttaagagcaggctagaagttgggctatcttcttaggagtcatcagcaactagatgatgtttacagccttaagatggatgagctgagaaagggagtgaatacagatagaggagagagcagccctggggaaagtacagacttgtcaagctattgatagcatatttgcaaatggctttgaagaaagacccagggcactttcccaccagcagtgggtgggaatgagtgccgtactgcacacttgtctgttctctgtattactaattttttaatcatgaccaccttgaaagaaaagcttttcttgctaaattactgtttgaattgtaatttatttgattgtcagacagggtgaattttcataaaggtattagtcatttgcattacttgaagtgaattatgttcattttccataattctaagtcaaagagattatgttttattctgacatcgtggaagccactgaacatttttaaagagcacagcatgatgcagatggctatttgggaatattaatgggaaagttcctatccttgcatcctcttttattcattcatcagtgagtctgactccagagcttcaattttctgaaaagtttggaaaaactagctttggataattattagtcacgtgcaaatgagttaactgggtattaatggaatgaaaccactgccatttcttgctggctacagtgtgaagcaaccacttagggtcatccgtcagccttgaatcaagacacagagtacagaagacagatttccatcctcttctttgcctttcttcttaaagctaattatcagctcaatcctttatttcaccccttcctacaacaaaatgggatgcactagcattattcatatccagccttctctcagtgtgtagtcagggtagtcactggtgggtcattgtcttcatggaagatggtgtgacttccatacttagaaaccagcatcctctgatgttctcagcaggatatggctcctattgtattgtattgtattgtattatatttttcaattgacaaaattgtgtgtatttttcatgtacaacatgatgttttgaaatatacatacactgtgtaatggctccatctggctaattaacatactgcacaccatggcaactacagttaataacaatgttttgtattttgaaaatctctgagagagtagactttgtgttcttaccgaaagactttttaaaggcataaaacatgagtggttcacctgctggctctcactaaatcctctcatgcaattggctcaaaaatcatggaatagacagttcagggaggcagagtttggcttttggaattgctttcaggacctgggatatgttgtaaggacatggtctcttgaatatctggaatctgcaaaaaatgagtagtggcaactggagggactgggtttggggaaacatctcttgagcttggctctcaactaagccaacagtgccaactctgcttcataggcgcagcttgttttagaacaatgtgactaatttttttacacagttctgaaagcaattctctaaaaggaattccaaaaatattttgaacagcagcattattaagattagctgtgttccatcccaaggtgactcctgtataggaaatgacgctcactgggatgtatctgtctttcttggcctttcagaagcagtctcgggagattatggtcacacttgtgtacttgcagctttcccatagaattaaaaaccctgactaattaccagaaactcagcatttaaaatcactgtggataagagtcaggctagaactataagatcatgttacccactttctgtagggaagtataattcagcatttcaaatcagaatggaggtgcttcaaagatttgccattttaagaagaaaaaaaaaaggataacattcatcagagcatttgccaagagacagtcttagcactaaggcagctctcatccttctggaagcttgacagtcttaccatgatggtgaatgagacaagttttactatcatttcaggctcattgctgtaaatgtaacctttcttcaggtgaatgtcctaggaagaaaaatattgttccttacagaaaaaacaaacaaaaaaactagttaaagtatttcatgggaaaaaaactatttaaattcattattctgtcagattccgtggagggcctccgaggctgccagaaacagccctttctttgagcacttatttctgtgataccctgagtacacaaattccttttacaagtgacttttcctcagacaacaattgaattctaatgtgtttatcttgaacttgtattatggctggtagcctaagcattgtatttcaacagcctcttaaaagtgtccataatagatgtggaaaatcaaagtgccacacatccagttgtttttcagcttttggtgccttaatttgcatcgcctgatcagctgaggatctgctgagtgcagaaacaatcttcgtgcaccggctaatttatagcatggcagaacagttgttttctagacaacttgtaaggaaactgcttctcctcatttgtcttctgatcagagctgcacaagaactcttgatcatttacaaatgacgaaagtgagacttgtaaaaggtgagagtaaatcttctatcttattctcttattgtttgctacttggctttgatttatcattttgtgcctttttttttttttttttaacagaatctcattctgtcacccaggctggagtacaatggcgccatcttggctcaccacaacctccacctcccgggttcaagcaattctcctgcctcggcctcctgtgtagctgggattataggcatgtgccaccacgcctggctaatttttgtatttttagtagacacggggtttcaccatgttgaccagggtggtcccaaactcctgacctcaggtgatctacccactcctcggcctcccaaagtgctgggattacaggtgtaggccactgtgcccagcctatcattttgtttatatgaactataagccactagcatccacaaagggggaaatgtcttctgattgatagagcttccttttcttttttgaacaaatgctaagaagtagcaacagccaaaggacaagagctgtattgtcttctctcatgtgtggcaagaacaaacaagattgagaatctgattgcattgaagaggcattgttcattaaacttcctccagacctggggaagaggataaacttcctccagacctggggaagaagataatctgttccacagaaaatacagaatgcataacattcaatgaactttgcacagggatcccagaagtcttggctgtgatccaggacctaccatgactttctttgtttccacctcctgatgatcttaacccgtgtcatatagtttggctgtgtccccacccaaatctcatcgtgaattgtagctcccataatccccacgtgttatgggcgggacgtggcgggaggtatttgaatcctgggggcagatttttcccatgctattcttgtggtagtgaataagtctcgcaagatctgatggttttataaaggggagttcccctgcacacgctctcttgcctgccgccatgtaagatgtatctttgctcctccttcaccttctgccgtgattttgaggccccctcagccacatgaaactgtgagtccattaaacctctttttctttataaattacccagtctcaagtatttcttcatagcagtatgaaaatggactaatacactgtgtaacctctaagtttcctcaacggtaaacaagattttttttttgaccaatgatctctaaaattgcatttggctttaatattctgtgatttcatgaaaatttatattaaatttgccttatgttccatacagctctaagctgtctctggctaaaatagggaaacattgtacaggcactcccaggaagggaaggacgctccccttttgttctgtccaatttgggtaaacctttgtctatgtttatttataataactagaaggaaaaacagtacaagaatattctgtgtctttatcaacagcacgaacacttctgccatcttaaataagttaatttctctggatgcttcactatctggcgttgcaccagctgctgtgtggctctttaataggcatagaggaaacaagactataagcctttcagatcatgcaatgatttctctctaccaccccatcctttaccttttgttaaaatatttgcaatgcccttcacattgccacattctctctctctctctctctctctcacacacacacacctgcatagaaacacacaccacaggtcgtctccccttcccttttagttcccccccagcaggcagatttctctccctagccatgtcctgtgcagcctacactgtgccgcatcctgggttgtttagagtcccatagggcatggattggccagccacagcctgcaggccgagcaggcccccaatgtgtttttataaatcatgtatcgtggatcgcgtgggaacacagatgctgtttgtgttcatgctttgtcagtggctggtgcaacaacagcagagttcagttgtgagggacaaccatgtgtttgctgcagagcctaggctatttactttctgggcctttgcagatgaaagaggacagccctgctgtagggtgacgccatcatcatctctaaggactgctctcagggacaccatccctgaagtgtgagggattcaggggctcccctcatctaatttgaagcaccttttgtttttccctgtggggcctggcgacagggtacttctgtggctcagcaggcagcaggcaggtgagcgagctgtggccaggtgctgggaggcctccctgtggccacatgtagccttcgagggaatgtactctgcaggggtgtgaaagcgccccttctccttttttttttccatcaaggctgttcttgtttattttgaccagataataaaataacagtgtggaataaaataatagttgtgtaaaggaagatagttgaggttctaaggccagcatttgaggttctcttccacattttggggtaactcatgtaaatacaatataagcataacttctggaagctcattaccctaaatttgacctgctctttcccaacttattatagttctagagtgtctatttctgtaaaatatagggatatgcccaagatattcatctgaaggatcactgcacctgtgtgtgtacacactcacgtacatacaaacacgagcagacactcacagctgtcatctggaagaggagagtttctaggaccacagagacagcagtgcagaccttgttttgctacaaaacccacttgcaggaaacgaggaagcagaacactgcccagatgctttgctgagtcagggcagcgggagactgtctgtgagctgcacagtctcagcatatggtgaccaggatggatcctggtctgcaggtcacatgagccgacactgccagtaccagggaggaggctcagtgccagcacgtttggatggaaatgaaaacaaggcttcggcactgaggtagcggagggtccgtcatagcccagggtgccatcctggctggaggtgcagggacagaaggcccgggggaggagctcagggaccagccccagggatggcgaatgtcctgacataacgctgtgcccatcccagtgggtgctgaggaagctgaacggcagtgctgactctgggcacagtgatagccaaacaaactcctcacttgctgggctctgcggggcagacagtgaaggggagctgcaggtcagcagacagagagggaccagtgtcccgtgcatgccagagaaggggggggacgtgcccggtaggagggggagtgagtcatgaggggccctgtccgagagggatgccggtcaccacaccgggctcctctaaccctagcgttagtcatgtgccctcagctggaaagtagacaacttctcatgtcagcgtggcacatcccagcattgaaatcccacgtacaccggcctaacctcccacccaggcttctctccctaacctgccgcacagagtggaacctgcccctggctcagctggtctccctgccgtccgaggccccgttggcccctctcgattatgatccaggcttagtggatggcagcacagtgcatggtacataaagaaatggcatcatgcttggtacatgtcattttgtttatcctttacagcagccctgggaggtgtgcgaccttggtcccctctacaaatgaggagactcaggctccgttgcagaggcacaggggcccctgggctcacagcctggctcagaccccaatctgcagacttccccaccaccacgcgctgctctcccgttcacctgactccaagcttccagtcaaagtcggctttacaaggctttggtgggctccccagcccacacctgtgccccctgatattctaagggcggttatcacttgtagctaagacctggggctggttacatgttgcatcactctccaaaggcctggcccggagctgtgctcatgatcatcaacatgcatgtgatgatctaatcagcagtctgaaatgttatttaattttcttttatttccaagaaatctaatgtcacgtgaagcccttagtccagcacggggctgggtgcagttcccttaagggggaatgtaaagctattctgtctgtaccggcatctgcgctctaatactccctagaaaataagtaggaatcacagcaaagtgcaataggatgcaagttttgtctcctaagaagcttataaactggtgggtggagacaaggcattaatatctggatgggacaagcagggcagtgatgcagaaaaaaacacctctcagtatatgaaatgttctccaggaggtcagatgatccctgtcaggagctgaggaactgaagacaggccagcaggatggctggagcggccaggatggggctggggtggggaacgtcctgcagctgttctggggagaccgcgagctcgtcaccccacggcctccacctcttttcagtgcatagatagacggtgttcccatcttcccgcacgtagacagagtctgggactgagttaatgccactgaaatgtgagaggaatagccgggcgtggtggctcatgcctgtaatcccagcactttgggaggccgagacagccggatcacaaggtcagaagatcgagaccatcctggctaacacggtgaaaccccgtctctactaaaaatacaaaaaaaaaaattagctgggcggggtggtgggcgcctgtggtcccagctactcgggaggctgaggcaggaaaatggcgtgaacctgggaggtggagcttgcagtgagccgagatcaagccactgcactccagcctgggtgacagagtgagactccgtctcaaaaaaaaaaagaaatgtgagaggaagtgacgcgtgacccttcagtactgcctccagagccagggatggtacgcttctgtcgtttatgccaacagtgtttgtgggactttgtatggcagccagagtggactcacccacaaccagagttccacagggagagaaaaactcaaggtcaggactcagaaatcttgatcaacggacttacttgcaattggcctctaggcaggtgtggtcgctggtggacttagggtcccatggaggaccttggggaggctcagatcccaggaaagcagctggggaaccagggcggctatgaggagaaccccttgactcaggaaagtagtctggtctcaagttctagggccacccttaggatagccagaggaaggctagaaagccctgtgggcctccagcttccagccttccaaaagtgaggaggtggggctgtaagattacgctggctgatggctgtcgcaaaacactaagtttattacataaaagcctcaattccctcctaactatcaccaaaacagatgagttgtggtgtccagctcatcatcattgaagaaagaacacctcctttcttcaatttgttcttttgtgttttcttccctcttcagagctaactttttttttttttttttttttttttttttttgagacagtctcacttggttgcccaggctggagcacagtggcgcgatctcgcccactgcaacctctccctcccgggttcaagtgattctccttcctcagcctcccaagtagctgggataacaggcgcccgccaccatgcctaactaatttttgtatttttaatagagatggggtttcaccatgttggccaggctggtctcaagctcctgacctcaagtgaccatctgcctcgccctcccagagtgctggaattacaggcatgagccactgtgcccagcccagagctacctttgatgcccattttcatcatgttcagcttggtgttggggaaagcacaccaggagattcctgcccagggatggccctaggacaggtcctggagctgcccctcagagtggcccactgcatcacgtgaagcaagaacgcaccctttggttaagcctgttggaattacacatgccagatcccattcaactgagggaaaggatgacataggttcaaaaaaatatatgacaggtgctacgagggctgtcctagttctctcttagtaaggagaacctctgagacaggggcaagaagctccttcctgcagtgtattacatcctattcagagtccctttctctctgaagaatatgatgagctccctgcaaaatctgatctcctccctggttggaaggaatgagtggaacctgaaaagtgtggcatttttattgtccctggaatctgatctattaccttttctgtcctctgcctttcatcttcgttctactcatgcgtttgccccagatgagcaggtaagcttttcagatctggggattggggacttcccattttagatggaagtcctgccattgggttggctgaaaaggtgcgtaaggaatctgtcagatttatcacatggaagtctagggcaggcactgaaatccttttaggaaaaatgagtttccagggtagagaccaaacctctaagtcttaaagagagcaaagcaaagaagttgacatttagatctttcagcaaaccatgaagattctctgcctgtaggtgactagatgctagaaagagcctaatggatgagttgagaaagaaaacagccgagtcaagattgctaatgcgttcattacatgcatgtgagtgctttgctgtagaaagttatcgacgtccaaccccatgagaccattactgtcccatttagcctgacttctctcacacggcctcctctcgccttccctgcaacttcatttttagtttcgtattcctcaagacctatcccttaaagaaggaaagcaaagaatggtggaaaaattcacatccataaaagggtttctaaagctaggagccttgctaagctgcctgagttgtcacattgcagagtgcacggaatggccggctgagtctcatcagtgtggtggtggttacacacgctcattttgcctgatcaaatcgtttcattaaaaattcttaagctgtagacacaaaagtactttttcaaatacatcagtggcaatacagaagtagactgtaattcatttgtgtgcacttataatacaacacacctccccaaataaaatgcattttttttctgggtgttcactgcaatttgctacaatcagaaaaatcataaagggtagaatgatgtcattttttaatatattattttcatttttcaatgcctcgaagaaggtgcattaagatcatccattaccttagcgatagtactgttagtcccatacttcatatacagtacaaattcgttattatcagttaatattgacttagtgctcaaagtgttctagataacacacagtctataaagtacaagcgttaagtcacagccatttgcaatttctcttctgactgccaagaattaatctcttattcaacaaatattgttaagtgcctgctctgtgccacagttgggagcaaaacagacatggcctcggggctcagagagtgcacagctttccagtctagcaacaaagtcagacgttaaaccaacaattactgaaattagtcttaaattatagttgtgacagagacacaaaggtgagtgtggggcactgtgaggagtctgaaaaaaaaggacctcactcaggctggggttagggattcctccccaaagactggtttctttgaatggtttcattcatttgcttgccatttatttgaatgtgtcaagtcttgtgctagatttaagaagataagaaggtgaataagacagaattctgattctcagggaactccatgctctcatatgaaagacagctatgaaagcaaataattgcacagactttcatcatatcactttattgcattttgctatgaaagatactatgctgacatgcctcctggaaagaggaaccagatggaagctacacagattagataaaccagctggatcttagaagatcagttgataacatggcagttcatacagcatgaagttttctcttactaagctaaagtcgagaaacatgcccgatcgtaaggagcatcatcaaagtggcagaaggtgtaaagggaggttagtgttttgactgtatgctgggccagccaggacaagacatggcatggctccttctcacaagtaaaatcatgctaacaatgcactgtggccctctagcttcctcctccctcttttgagtctgtctgcagggaacaggcttttacagttccaggacataggatgcagaaagcacccagaaggaaagagggaaaactcattttgtcagtccaccgaaaagctggtgctgacctagccatgacagcacttccttccaaaccagaggatctatttgaatattggccaagggtcacagacatggagttcccatatatgaaccctccgttttggctttggtgggattgatatggacaaaacacgccgcaacttaagtgttgaagtcaagtgttgaagtcaagtgcagagtcacttgactctgtagcaatattgtctcaacaatagactaagaattacttgtgagtggttttgcactgaaatagtctctatgaggttgtactaggtgggccctaattttatagctaggggaactaaggtcccagagaggtgagctgatttactccatgtttcatgacacacagaaacggggatgggaccacggtctacccaccccagctgcagtgactgcaccatgggaactatttccccttgcatctccctgtaggactctgatgattcatgttgacatgtgttaaatgccagaggtgaagactttgacccatagagaagagagcccacctggggactaagcaggacttagttaccactccagctgccacctggagtaatcttcctgtctctactctttaagccccaattcatgtaagatctgaataaaagcggtgtgttcgccaagcatatgcgcagcttcaagacaaggtgtctggccttttctttcaaccagattgcagctccgaaatctctcctgtagcgaaacctggaacttccatagacattggtgctcccatctctgcacatgggagagggcacagtctgttttccaggagtgactgattgccttcaatagatcaggaaactaaccgcggacagaatcagttctacactgattttatactgtgaatgtttaaagtgaggcgttgtccctaacggaagggttagagaaatgtgcattgcttaatgggtttcttatgaagattaaatgagttcgtgcatagcaggcatggaacacacagcagtggctagcacaaaaatgagcccttgatgtgttggaatgtgttgtcattgtaaaccagccactgttggcaccagacagcctcggggtgctagagctgcctgtgacccacgaatgccatgtgaacaaactgacacagccatggcattttctctaaagcaaacacatgaactcagcaggtccctgaccacagatgtccatggtgggaggtggtgctgggtgatgtctgtaatgaagcagagattcctgggcccctctggggtttggtggttaacaattcatcccagtagtccaggcctggatcccacagccatggaatgattccctggcaggacactgctggagagagagggccccacagactccatcacttgggtgacctttggtataaaaggaaggaagaaacaggaaacaggaggtgactgcatttatctacagcagcctcagctgtctcttggcctctggggtccatgctgcagctctgagtctttttcagaaacgggaattcaaaggataaggttttaaatcattgaccatagagctgaaggtgtatcaggtacacagcaaggtaagaaatgcagtcccaatcttttcactggagtttctgcatggataatcagaggagttttcagaacatgctagataagaaacaatctctcttgcactcctctctccctctctctgtttctgtttgtctctctctcctttcctacacacttccccaggaaagttcgatttccataagctcttgtagctgcatattttacctgtggctgggaaaaaaaaggaatgggtagcaagccaagcacctctgaagcgtttctgcaatggcaacttaaatcttctgtgaaaagatgctggatagagaatactggatgagctgctccagtgtggaatggtgcctgaggaattgctattccccacctctattcaatttagcaccaccgttgtgcatgtttcgattaaaaagaggaacaaaacatttatgtactcattcaattcaccgctgcctttttatcacgcatcttctgtgtgccaggcaccaccccacgcctggcatcctgccaatggccatccttcccagggctggattttgcctctcctctccttgcgacttacaagaatttgcatttaaactgcacacttcacctgttggttgatacccaaaaccttcttaagagggaagaaagcttcttcatgacatcctcaatgacacgtaagtgccagttccctgtgagatcttgagggtgtggacaggtggccctcagaggcattggctggaattggatcctttgctgaatgctgcatactttaggaatggacggaggagcttcctgaggtggagaggaggtcagtaatggggaggagagagggcaggaagggaggcaggagaccggtctgtaaaatcaattttcccaactaaaaatgtaatgtcaggaggtagctgtgctccaggctgctcagatgtacatctaggcctgtctgtgtgacactcttgccagagcgggctgtgtcttgtgcagtgggcacaggaaggtgggatccctgggctgctcacgaggccgccccacactctgttcaggagacctagttatgagacggctgcctgtggttgcctaccattctgcctcttccctgccacctcatcagcacttttacctgtcgcctgcttatttaaacacgtggtccagcaatcacagtgagtgtggtgctgactgttgaatgcccatgctcagggaggcccttcacaaattctcagcaaggacttctctctgatgcatggttgacctgatgctaatggtcagctggccccagcgacactctggcattattttaccccctctacactttccctagattcgcctttccatcccctttttgaccgttctgattttgtaaaagccttgtttttcaggaaataccaatatacccttaataaagttttattaataaggtgtttaaaaaggacccagagtcaatgatttcatcaattagagcacgaaatacaaaagtctgaagatccaaaggaatgaatctctaatggccagctcatgacactatgtggcagctagggagatattttcgggcagaggtcttcccttgcctctcaaattctagaagtaaacatctgttgattttgtaatcaacaaaatgtattatatgtccgagagagtgacttgtcttggaaatttcagacatcagatcaattcggtacttgagtcctataccagggccactaaaggacttccagtccaaattccatcaaatcatgtagagccctcttttttgtccttctccatttgctcagctgtttttcctcccaagtagggagggcagggctgggaagcttcatcaagatttcctttgacacgctctggcttcagatagtgatttactttctaatgacgtgcctctgttttcattccctttccagtgtcaatctcagttgcaaacacccccaggaagccacacactcagctccattcagctccagccgtggtgtgaatgaacaaggaagtgagaagagtttttcattgcttattgccagaaaaatgtgtctgccagcttcagtgtttataaaaagcaattttgcctccccctaagctagcagtgtttaataaacatgtaatagagaatgtaggtttaatatttaagcatctctatgccccgagtctgagtgatgctctgctacattctttctgcaaaagggaatttaaaagaatgatgagatccagccccggcctgaaacaaaggcagttccagtggagtctgcagggttcactctttccttccctctctcctcagatagctgctccacggtttccccacttaggcaaatgagcatctgctgtgttcatggaaatcggtccaagtaacacaatagaggctgctgctcctggtgtgtgaaatcatcccccgaattatcaattgaaggaagattgcatcgtaaagccctggagcacgagcctcgttagcacgctccttccagcacagccggggctcggtccgtctggccatgtatttggcaaccagtgtgtgctccggcccaccctcaactaatgggtgtttgcatgggtgtgcgtttgtgcatgtgtgttcaccgccactagagtgagttcttttttggcagtttgtttgaacatatactcacccgaggcgtgtgcttggacctgtagatggacaaaagaggaaggcagcagggccctgccgggtcatgtgatgttgcagcggtgttctggaggacaccaggagggatgggaaggcagcgagaagagcgtgttggggactgcggtggtgacttctcagccaccttcctcgaaggggtggccttctccttagagggatagccagtcttgctgtgacgtggactgggagggtagtgccagcacacaaggaggaggcgggtgtggtgggaggcctcacaacacacggggccttgcaggccataactaggagggaccatcagtttcttatttttgtgtgggttttttttttttttttttttttgagacagaatttcggcccactgcaacctctgcctcccgtgttcaagcaattctcccacctcaacctcttgagtagctgggattacaggcacacaccaccacgcctggctaatttttgtatttttagtagagatggggtttcaccatgttaaccaggctggtctcaaactcctgacctcagtttcttgtttttgaaagatactcaggatgaggctgcagacacaggaactgtctttctcttctttgaacaaaccaagctgttttttgcctcaagcgctttgcgttctctgttcctgctgctgggagcaccgctgtgctttgccctgtccaagatgtgttctttcccacaggtgttggcttagggtaactgactcaggagggtcttcccggcagactgcaggctctgaagggtcacccacccttgcgtacactcatgttgtaaatgagttttgaccctgctggtgccaacaactgctgctctgtgtgttcttttagaatgctgcctggcttggaatgatcttgtttctgtttacttgttgattgtgcatctgctttcttctctttttgtattttttgtgagaagacaggtccatctccctagtttttccctctacggaagttcccagccatgcctggtacagagcatgctaccaattaatatatttctaatggaagccagaagctgggagtccaatcagaaggcgaattgaggtatcacagagcaggaagaatggctgcttggactacatagaggcagtggagatggaatgaagaggatgggtatgttttgagaggaaatggatgacttgtgagactagaaatttgggaagttagaaggatagaggaaatggtctctagagagcacctcgtataagaataagaggcacagggttggcggtggaggcgcttggaggcacagaagggtgctcttcctacttttttcttatcgtaattctcctctgaggatacaagtaaaggtcttattcatgtggataaaattgccaaattttatgtttctcagaagcagttttgtgaatcagtaagtgtgaaggaaatagcccaggtattaaagggaggaatctggaaaggtttgggccgagcagcttccaggggctttgtggccttgggttatccttgtcctcgtctaacctgcatgccgtgttgactgagtatggaattttccccaaatctttgtttttattgacgtagaacacgattgattttcaatcagttgatcaaattcctaagtggagcacactggaatgtgtgtggccaccttctgagggttcatgaaaaagaagtggaaggattccaagagcagccaggctttcaccttcattgaagctgcagcctcgtccatcagaggcacagacacaagaaacatagctctgagcagaaaacacagaatacagctgttactggaaaggggtccagtccagacctgaagagaaggttcttggacctcacgcaagaaggaattcagggcaagtctatagagtaaagtgaaacttgattagagaaataaagaaacaaaagaatggctactccgtaggcagagcagtggcataggctgctcaattgagttagttatttctggatcatatgctaaacaagggctggatcattcatgagttttccaggttggggcagagatttcacggaactgagagttcctccccatcttagaccatatagggtaatttctggatgttggcgtggcatttgtaaactgtcatggtgccggtgggagtgtctttcagcatgcgaatgcattataattcaagcagtgaggggtcactttcattgacatcttggtttcgatgggttttagacggcttctttactatatctcattttatcagcaggacctttgtgacttgtatcttgtgctgacctcctatctcatcctgtgactaagagcacctaacctcctgggaatgcagcccagtaggtctcagccttgttttacccagcccctattcaagatggagtcactttggttcaaacgcctctgacatagctgagcattaagtaccatagcagtttggataagtgggaagtaattgatatggatgggcacaccaggtggggaggactttctggaaatagtgatacattgatggtaaatacgatttggctgtgccaaaaagatggagaattttaggcagagggagcaatttggtcaagtgtgaagacagagctgaccatggagcagtttaacttttcccgacataaaatgcgaatttccaagctgaagaggagcggatctagagcccaaggtggctaacgctgccataagctagtttcagtcccgtctttgctgacggtgtgatattcctgaggccaccggggatgattcacaagggtgtgccgtgattccctttcacagaagcagtttaaaaataaaatctcttgcactccctcttagccaaaggaatccattgaaagccaccaatgtacttcgctagcagtagaagcgtcccatttggtggatgatgcctttcaaaccaggatcacttactgcattcctttcccagagctgccgtaaccagggacctagacctggcaattttaacagcggaaacctactggctcacagtcttgggagcctgtaggtctgaagtcagagcatcggctgggttcattccagggctgcgagggagggtctgtctcaggcctgtcttctcggcttgtagctggctgtctttgtgttcacccagcattctgctttgtagaggagtaaaaataaaatttacctctatcttcttaagttctctagccaggccctataaactagactggcaaaaaataataataataataagagaaaattacacagatttacttaataagtcccatgtgatatggaagccttcctaaggcagtggagacctgaagagacagtgaagacctgaagggacagtggggacccgaagagacagtgatgcctcagcgctttctgtagtatgctggatgaggacgcagaggtcatggggaagcgtgacaggacaaagggagtgagctgagggtgatcggtgggaaccgcagcaaggtctgtgtgctcagcctcctcccggctgcctctgcctttggagatggggatgctgtctccagtggggcatttggagggtgccgctcacaggtgggtcctaggacctccttctggggaggcggggaagtcggatggtccttcctgcgcctgacactgctcacattcttccagcttataatattcagtatgccaaggtagcatctttgtggtagtgtgtcctgaatcacaccagcctctgtgccagtctgtgtccacatttccccttctcataaagacactggcatgttggattagagccataccggtgacctcatggtaacctagttgcctttggaaagaccttgtcttcaaataagctcatattctgaggtattgggcattgggacttcagcatatgaatttgaagggatacaatcaactcataaaattgccatgattttttttcaaataagctgctatttacttttaaaaaataaagtccaatactgtggccatattgctttctgtcaccagcaggtggcatttctatagtccagggatggcaaaggaagagccgagtgctttcctgttgttttatttggaaaatgaagcattgttatgtacgggtgagagagagagcacagattaaactttggaaatgatagtcaatggtacatgatgatgcatggagacttttgccataaattctagacatattacaggaaaaccagcaagcccacaccggttcccatggaagtcaggaatcacactggcttctgggcttgaccctgtcaataaccagcttccaggctccgaccaaaacacttagaaataggaatgttaatactgagataattgtggcccagagacattttcttctctaccttcctcactgtttttttatttttattttttttaggatcagatgagataaaatatgtagacttattcaaaaatgaacaaaatataatacaacttaaacaaaggtcccacttacctgtcctctataatatagactaccttcccttcaaaacaccctccccgagaacagtaactgcgaggaggaactttatttccttcaagcagtaatcaagcctggcccatacgagatattaaacaggcatgaaataaacaggcacaggtaaagatgactgaagaagttattctgattcacatttaaggattgacattacttcaagcaaaattgggaaagaatatgaaacaaaagacgtgtggtctctactctttaaaagctcacagttaattttgctgtatttttaagagaaaagcaaaatggatatatataaaacagattaatagacgactgaattgctccaaaatcattcattcgtttatgacacagtgcggtcctgagactcctcctgcaggcagctggggtggtctctgcccggagcatcggcatgagccgcactgcagtggagtgagtgttgcctggtgttgcccacactgatggatgtctggaagtgcagctaagtgcagccacagagattcactgtaagagcactggatcctttactctgagaaggagatgtggcagtagcgcctggtagcataggccccgtggccccttgtccctgaagcttcttccgttaacagacctcacagagcccagccctcatttccttgcagctcaatccatttctttccagtctcggagatgcttttcttatgactcaatcaagggcttgcatggtgtgtggtgctggcactgctttcagaggctgcctgatgattccgagatccctctgctactttttcgtgcctcatgcgtcttagggaaggtgtttgcaggtgaaggaaaaggtgggtagggtagacgttcaaagggaatcatgaacttgttttgtgtctcttcaaaaaaactgagcaagctgattctcacacacctaaacacgaaagcattttgttactaagctctggactgtaacaccccaaactgcatatgtccctgataaactttattttcctctaatcacttggaagaaccgagtttactgtgtgtaactgcaaggggcaaagagacattggtgagtagaaggtagaaaattcctccttgcatgaaagggaagctggcttctctgtaacaattgttgctatctaaagctagtgggaaccagctggtgggaataaactaagcgccccttgaaaggctgaaacagggtctggagggtgagtggctactctagggggatcccagcactgggttagaggccaagctggattaatctagtcaacacatctctaatgttttcctagcttgagtcagcactgagtcgatttggtataagaaagaaaggaaacatattcctgtggggagacagacagggcaagagcacttcttataaaaattagcatacagagggatcattaggctcagcctcaggtggaacaggtgcctactggaaggagcacctcggtttacctggggacagggtaggaaaggtttcaagggacaggaggcatttaagaattaaaattaaacactgaggcttctgggttgaataggagtttgtcaggtagacatggtaggaagggagtccaggcagagatggcggcatgtagaaaaataacaaggcccaagagagccgctgaaacttcatggaatgttaggtgtgagacaagaggaggtagagctggactaggaattggaagcctggttttgaagatccctgtacgttatgcgccgggagtttgtaggtgatgaggaggtatgacataagtctcagcaggggactgccacgatcacatatgcttgttagaaatatgtttgcaggtggagaagagactggtgagaagtgagggtggataaagaagcggtattgagaggtaataccacagcccaggaaggaacgcctgaagtggaaataaggaaagattggcagccccttaggcggtggactcagatggactgtagcattgcttacagagagaggagctgtgagaaaataagtgtcctatttcttaccttgccagttgggtggatgctgacctcattcaaggaaaataagaaggagcagagggcagagaagatggagatgcagacatggacatgtacaatggcaaggaacatatcggtggtggatgcagtaaagagttggctctctaggtctggaacatagaggtcgaacctgaagatcaagctgggggtcaacatgtctcgtggaatgcaagccacgtaggtgtgcgtgcggtgccctagggagagaagacaggatggagcacagggagcggccaacacctaggtgagcagatagtcttccctaggacagctcacggcagggagagaaaccatgagacttgagaagcaacagaagggaatgcagtgagggaaacatttcaagtaagagggaagaaataaaaaaaccggaggtcaaagacaggccaaagttcccattgtctatccactgcactttggtggccctggcgagagctactctgcagaaaagtgagaagtgaaaatcagagccctggggctgagaagcgcattggaggttaaaaaaacccgggggagtgagcgtggaactcgccaacacgcacagttgctcaccctagcacaggtgcatctggacgcaaagcaagggggagagtgagggagaatatctgacctgctcctgtttcagctgagattccagcgggttagaagcgctcgaggtcagtcaggcaggagctggtgagatacacgtatgggggcaaggaaacgctacgagactgaggattgagctccactcttttccactctgtcaccgaatgtgtcaccctcctcaaatggagtgacccaggtgtcggggactctgtctcagtctggatccctccccctggcagtcgccactgacatgctgcagctgctggatgtgcaaataactgatcagccttgctgtccaggaatttacaggcgtggtgagattattttattttattttatttctggatactatcctaaaccttcccacaccaaacacaagaagttttcccttgctttcttcccccactccttgccttggaacatgataatcaagaaaaactgaccaggtgcagtggcttacacctctaatcctggcactttgggaggctgaggtgtggggatcacctgagctcaggagttcaataccagcctggtcaacatggtgaaaccccgtctctactaaaaatacaaaaattacttgggcgtggtggtgcatgcctgtagtcccagctactcgggaggctgaggcaggagaatcacatgaacccgggaagcggaggttgcagtgagccgagatcgtgccactgcactccagcctcggtgacagagctagattctgtctcaaaaaagaaagaaagaaagaaaaaactactgaatgaatctcattaaccttttgaacaatcctgtcactgtgggaagtttgtcctcgtgggttgtggtagaatgtagacctcttaaatacaagacccagctcctgttagcctttgtgaaaagaatagtgttttaacacttagtatatgctcaattaatgtgatatcaaaagcaattttctaccatttgtgttatttcagcatagctgcctttcatgtgtaccctgcaaccacattgtgaaatagacattttcattcccatttcacagaggattaaactaaggccagaaagattaagaaactgtttcaaagctatataggctgctgatacatcacttatatcactaggtaaatctcactcagattcaaatccagattttaattctatcaagtatatgcaaattaaagaaagtgttttattatttttttcctggaggggattccaagaagaagggtaatcgcattttccaaattcagactgtgatgagcacagtttattacggagcatccatccccacatggggtgaaatgtggagaaccaatgtcttatgagcacctttgaatgaaaatcttgagtccttccagcagagaaaggactttttgaaaggtttatttattcctttactacattccattcttatcttattaatagttcataagtctcagctaaatctctaggtcatagtaaatcacatccttcactatgagaacttgagatgacacaagcattcagttatagcaatttatagcaaatgcttaaaattggtatacccacaatctttcaaagccctgtcaaatacaggagtcagtcagatacaattttaaaaggcttaccatagaaagctctaaatctttgcatagtcaagcatatcttaatccaggagaaaattatttttgtaaacctttcctagaagaattttatgtcctgtattacaatcttataatgtggcagagggaaggtgggaggaagggagataaatacccatgtttatctccagcctgcagcagtgaaatgagatagttcaccatgtattccttgaaaaccactgaaaataaatatcaatactaccattatcttttaaaaaaattcagtagtctttcccacttgtcaaaacacttttttaaaatcttcctttaaatttccagagtgtcctcatatctagtttgcattttatcctcaacaccacaagaattaaataagggttggtattatcactgccatttatagataaggaaacggaagccaaagaagttgggtaatttgcctaagatcacacagctatttagagatggaactaaggaaatgacacagatctccaagcatttctgtaaattttttctaagtaaaagatgtttccttcttttcccaccaaccctcaaaattccgtgtgctgtctgtggaattcatgcacagattgctgtggttcggggaaagatcatgcccaggacgtaggggataaagagggaccagacctgcctcatctgtgccctcgctgcatgggcctgggcaagtcggtgatctgtcagtatcccactttcctctccataaaatgataaagctgggaaggaaatggtaaatatcacctgatcacctggattaaactctgacttggaggtttcttggctatactgttagtcagcattctccagagaaaaggaactaataggatgcatgtgtgtgtatatgtgtgtgcacgtagacacacacatacacacaaagaaacaggatagatgagtgcatgtgcgtctacaggcacacatacaaagacatttatttcagggaatttgctcacctcatggtggtgctggcaagtctgaaatctggagggcagcctggcaggagggaaatgcaggcaggtcttccatgttacagtcttgaggcagcactccttccttcccagaagtcctcagtttttgctcttaaggccttctgcaaatcaggggaagcccacccatattctagagagtcaatctccttcacgtaaatgtcagctaattacagatctccatcgcttctataaaatgccttcacttgaacacccagacaagtgtttgaccaaacagctgggcaccatcgcccagccaagttgacatctacaattagcccttacaagaaaatgtcctttggactataatgtttgtctgtaaagtgtcactatcgcaactatgatgtgtgtttctttggacaaaatatacattagttgaatagtaaactctgaccaaagatgtttagtattaaataactttcttaatagtcaaactgcagaactaaaatttaaatttctactaaattttgtgtgtgtctacccataattatctgctgattctcatactttacatttgaaggactctaagctcctgaatacagtacagatattcataatttttggagacggtttaccagattggcacctcatgaaaatggaatcaaactgtgatgggtaattttatgcatccacttgggtaggccttggtgccttgatgtgtgttcaaacattattctgggtgttttgtgtgagtatttttggaagagagattaaatttacatcagtgaacttcaaataaagcaggttaccctccatcatgtgggtgggcctcatccaatcagttgaaggcccaaatagagcaaaagactgaccgccccagttaagagggaattctccagcagacggcctttggacttgatgcacctctttcctgtgactccaacctgttggtctctcccatgcaattttggactagccaagcctccacgatcatgtgaaccaataccttaaaataaatttcttcgtctttctaaatgcatatatcctcttggttctgttcttgggagaatgctgattcgtgcataaacaaggctgaaaggcaatccttactatcgggaaggtaagaaaaatgaatgcaaggtgtcagaagtgatggttggtgggtgtgtagcattggggcaaattgatatttaaaaattaaactctgttcggctagccagccttcttcagtcttcagactgcgagaatgtagcatctctgaattttaacagggcatcatcaagttctgtcataatgttgttatagataagatggaggaaaatcttctgggaggtaggaaaacaaggggtagattaatgtaaacctagagggaaagtcctagtaggtttttagggaccactgttctttattgtgtcctagtgaatatttgtctagatggcttcatggagaaataaaatcttcgtggataaagaaatcatcatcattatcaccgtcatcattaatgggtatgagtacttaacatggcctattttgtgctttatatgtgttaccttatttaatttttataataatacttgttagaataggcattattgttgttatttatttatgtatttattttgagatggagtcttgctctgtcacccaggctggagtgcagtggtgcaatctcggctcactgcaacctctgcctcccaggttcaagcaattctcctgcctcagcctcccgagtagctgggattacaggcacccgccaccacgcctggttaatttttgtatttttagtagagatgagattttgccatgttggtcaggctggtcttgaactcctgagctcaggcgatccacccacctcggcctccaaaagtgctgggattacaggcgtgagtcactgcgcccggcccgttgttgttattttagaattaagaatttgaaacacagaagatgttaacttgggaaaggtcacacagtggtaaatgggagagcagggatttgaactcagtaagtatgatttcagagtctacactcttaacccatgtgcactctcagatatagctactgaatcagaagatgatataaagaaggaggaagtagtgattgtgtggagtgacagatgtggcccttcatcccatcccaccaggattcctttggattgtggtcctataaaggtgcgtgagaagcagatggatgttcagtaccgcccctgggcccagttcacagctgcaaaagtaccggatggagcagacattaaccaagagtcctgtgaccgagccaagggtagacccaatacaacctggtgtaggaggcagtgaagttgacgaacacttcggctgtatcatcagggaagcaacacttagatgtgggcaggtgggggctggtccagtccatgctgctcagaccccacctgcaggggtgctcagtgtagaatcaccattcagaagggagactgggctgaccacggagaggcaggagacaaggcaggacatggaggatggacagtagtgcggtttgaggaaggcctgaaagaattggcagtgtttgctccagaaaagagacagcgaaactcagggctggggataggagatggacgagcatcatgatagcatctcggcttacagagcatagaaagcccaggtgataggtcttcctcttacctctgcagcaagttcatggtgtgactgagggggtggccacagtctcaaatagcttccccaggtgggtctctgtgtcacaggccatgtgacttcaggatcccaagatgctcattctggcacatttttcagcaggacccaaaggatcaggctgtcttcagctgctaagaggaccagtcttttgcgagtctttcttactttcagcctgtcattgggcagatttctgaagcggaacccagtcctggcagcaatctttcttctgtctcagctaatcccagcctcagcacacagtgcaacattttcagtggtcttgtgtctgtaattatctttcactgtttctagaagcaacttcattgtgcaacaccattgctgtctggaagggtcattatctggaatcggttagttctaaccagctccttacaaactgcctttggtagcaaggctcttaggatttttagagtgttaaaaaaaattccgaaacccagatatgttcttagttgtaaattctgactaataataagttataagaaagaagacttcggaaaagtgtgtttgtaaattctttatattgtttctaaatggggtcgattacctgaggagagatgagttcctgccactggtgatgttctatcagagagacaagcaaaacatggaaagctgaagtaaaataacctcagggtaagagggagaaaaacagtaaatggcatgggtgtggggttcagggtactgagatgtcagaaaaatcagtacagaatgtgagggagaaggtgtgaagagtccaaggacgccacctgctcttgcactccgaaccctccccgctcactagcaagtccacagactgtctgctgaatttgtctacaaacagaaaacaaggcactgtggtgcctgttgtatagatgagagagcataggcttggggatggtgaaatgagccttctccggcctctcagactcaggctttcggagtttttgaataaacctaagttagtccacttcccggccacatagaagttggagcagtaaagctgatgggactgtttttcatatgagatgcaaactcctcaggttatggcaagtgagggcgagaaggaggcctgggcaagagaaaggacttgctttattttacatcgctagtttatggaagtaccagccaacactgaaacttcctggcctccaatccagtggggttattcatcctactctccactctctctgttttctgatgtttggaaataaaaaaaatcagaactacctcattaacgctctctttcctctttcatctgaagcagtgtgttagttaactttctcaacaagtttacatgccctttggctaataattgtggagaggacctatgactcactgtcattagtgtagactagctgccctagaaaaattgctcgggcgcggtggctcacacctgtaatcccagcacttggggaggccaaggtgggtggatcacctgaggtcaggagctcaagaccagcctggccaacatagtaaaaccccatctctactaaaaatacaaaacttagctgggtgtggtggtgggcgtctgtaatcccagctacccaggaggctaaggcaggagaatcgcttgaacccgggaggcggaggttgcagtgagctgagatcacaccactgcgctccagcctgggcgacggagtgagactccatcttaaaaacaaacaaaaaaacaagcagatagaccacaaaatagacaatggcttgaacacaataactgcttctgttttcctgtgtaagaggttagtgaggcaggcgcagggctgggggagtgcacttgtaagtgggctttgtcatcttcacagtatttttccaatgttgtcctgaagcgttgcctcattccctccacccgagcaggtagagaacagggaggaccccatgcaggagctgttgcggttctaacacgcatcctattctcttgggcagagctcagtcactcgaccatgcccagctgcaaggcaggctgggaatgtagactaactaggtgggtgagccagggaggaggaggagacctcaccctagccccagctacacttgcaggtcgagccaagagctgagggttttgcatatactgggtacactgattcctgttgagtctgcagcctgatttattttgtgaaactctagaatcatcggaggcggggttgcatccttggtacagccctctttatcattgccccatggctggggctggaggacagcaggaacagacactacaacaaaatcagctctcttggctccaatccctgaaagcccattgctatttctccctgaacatctggcctgtttcctggggtgtgtagagagaggccttctgttccttcagggcctcagctcagcacctgcgaacacagacattaaaaaaaccctcaagaactgcttggcaagcgcttggaacacagtctgctcagtatgcaccttcccacaccccctgcttgtagtaataatctttacctgcttggcagagcacgccgttgaggggatacatcacttcacctgctgagatgagtgcagagattttctaatgagaggcatttggtggcaaaaattaattatgacatatttcaaaggcaggccaagaacctggcctcctctccgttcccatccgatgcttctggtcactaagggaaagagaatgacaataacaataagtcaggacttttttttttctgttgtataaatagcagggaaggctggggcttctgacttcagcaccacagaatttttctgcagtgcctctttccctggcacatagcatgctcgttactaatgggtcctaaatgaaccccaggtgtcctggtgctcacctgtgggttgaatctcccttgctcagtaagtgtagaatccctctagggtccacctattttggagggactcaaactaggagtcccctaattgcattcttaggagaaggatatgacttcttgagatgataaaggagacattacctgcagacatttcaggtggaaagccaaattgtgaactttttcttgtgcagcttctccatcagcacttgctgcttcaccttgcactatgttatggagatggttttgctccttaaacctcatgagccaatctttgctagcttccagcttttcttctgcagcttcctcatttttctcagcctccatagaattgaattgaagagaggtagggccttgccctggattaggctttgtcttaagggaatgtggtggctggtttcaccttctatgcagaccactcaaagtttcttcatgtcagcaataaggctgttttgctttcttatcattcatgtgttcactggagtagcacttttaatttccttcaagaactttgcctttgcactcacaacttggctaactgtttagcacaagaggcctagctttcagccgatctcagctttcaacatgccttcctcactcagcataatcatttctaatttttttttttatttaaagtgagagatgtgtgactcttcctttcactttgacactttgaagctattgttggttgattagctggcctaagttcaatatcagtgttgctttttgaaaagagtaaaaaaccatttggagccaaatcaagcaaatgaggtgtgtgatcaaactctaatcacttagatatctgatatcacttagatatctgatatcataaagtaaaactttatgaagtttggggtacctgtggccatttcttaaaataagacaacagtgaggtttgccccactgattgactcttactttcataaaaggttctctgtggcacgtcatgctattttataacattttacccacagtagaacttctttaaaattggagtcaatcctctccagttgacttccttgtgtacgcataattttataattcaaaggcctagttttagttggacaaaaacacattggtcacattcttaatagccgcaccccaagtgagccaggaaaaatgcttgtaggaaaaagctgtaggaatgtgctcttcaccttcctgcaaaagattagggatggttgatatgtgagggaaggtgaaagctggaaagagtgagtgataccgaactttattttttcataggaaatacaatatttccttcactgagctgactggtcatctgttggaccccagcccagctcagcttagcagcctgtctgtgtgtgcacgtgtgtgtgtgcatgtgtgtgcgggtgtgtatgtgtgtacatgcgtgtgcatgtgtgtgtgaatgtgtgtgcatgcgtgtgtgtgtgtgcatatttgtgtgtgatttctccaggtgccctcatactgtgtggggacaatgagttgattgctcccctgctgtgtcactgggtgatctaggattatatcactgcctgaggacatgagtaccttttcctttgctgtcccctcaggaaaaagcccagtgtttcacagttggctgtccaaagggaggactgttctccaaccttcctaaaggcccatgtgtggggaaggatggcagtgcttctgacattgggcatggcaggtatgttaatgaggcagctggaaagccatgcccggctttgggcttccatacatgtgattatccctaacaccttcttttatgattattaggctttgaaaattgctctgagctatttttaagaagtctcagaataaaaagagatgatctgggaaggtgagaggagccgatgcccagccactgttaagaacaatggtgtttggcatttatctaggtctctcatcatggttcaggcaggaactccctagccaggtggaacctgtggcaggaatccacaagctgtgagttcaagcctcatgccagctgcctaagctcctatgagaagttggtagatggttcatgtcctttttcctcatttttttattttatttttttttaccagggccagtcttctgtgtaggcagagtgggcagaggcacagatcgtgtgattctaggtttatggagagcacgctcttttcaaagagcttccctcgctgctgtctgtgagtttatctgtgacctgctacagcagcagtccccagactttttggcaccagggactggtttcatggaagacaatttttccatggaccggggagtggggtggggtgggatggtttcaggatgattcaagcacattgcacttattgtgcactttatttcttattcttattacattgtaacgtataatgaaataactgtacaactccccataatatagaatcagtgggagccctgaacttgttttcctgcaactagacagtcgcatctggggatgatgggagacagtgacagatcatcaggcattggattctcataaggagctgacaacctagatccctcagttcacagtagggtttgcactcctatgaggatctgatgctgcagctgatctgacgggaggcagagctcaggcagtaatgcgagcgatggggagcggctgtaagtacagatgaagccatcattcatggctcaagttggggacccctgtgctagagcacacacacagccattatatgtcccctcttgtggctgatttgtttactgtgggagcacagactacactgcagaggagagcagagctggggggaaagaaatggcggtggcatcactttgctgggaaaggctgtcttgttctggaggcaggataaaggcagcatgaatgcttctccagaagactttatcttacaagagcctgaatggatgactagctctccaaaagtaaagcactggaagggaagtgaggtgccaggagataatagttttgaagactagtcctgtgaaacggtgtttctttgtactccaatggcctattttaaatccttatcctatttgatactgtctgcagaatctgatgctagtgactccttcttcctttctgaagctcacttcctccttcgctcctgtggtaatagccttccttgccttctctgcaaagttttcaagttctcgtcttttgtgcttctcttcctctgcctgaactttcaatattgacgtttctggttaacaatctaagatcatatggtcactgtgtgatttatgttgtctactccttggtgtcacaaccacccaccatcatgccgtacagtcggtcccagccccttacgtgagctgggtttttattttggaacttcctaacaaacgtttctagatgaagcccacagagacccgatgctcaggaagtaaacctgtcaagaagccaacacattatttgctcctccaaatgttcttgtttctctgtgtttcatgtcttggttactggtactatcatccacccatgtggaaccatctagaagcctaagaatcaccttcagacaccaccttcccaccccacaaatactctacattttagcagtataagactgtagcagtttcttgaatgtaacatgacatttctcatttccataccttcatttatgttgtttattcttggaatgctcttccttcattttgatgcttcacacgctaatacacatccttcaagacccaattccaatgtgttttctattttggggcctttttgactctcctacgaagactaaattaactgttccttcatttgtattctctaaagggtttgtactattttctatacatttattaaagacccctgagctaagacaacctcctaagaaccctcattgtttcaaggaatataccatatggaaaagtagaaaatgagagtaaaagggaagctaatgtgagggtaggagggaaggtgaggcagaagaggtgaaaagaaagaacagagtaaagtccaagggtaggggagttgagtggccacgctcataaggagctttgccacccctcggtttcccgagcacctgccacgtgccaggcactatgggggctttagtgtagatgatttctccctcgtcttgctccttcatagcaagaggaaggaagcaccaaagtaaaaaacccgagaaaacctggagaaggtgcccaggttgtctcactggtatttagtgctcctagggtggctggaaaaagcatcccgcttcaagaggccaccatctgacacagagcacccaggtactctttcctgtaaagcagaagtccccaacccctgggctgtgaatcaatatgtgtctacagcctgtgaggaacagggctgcacaggaggtgagcagcaggtgagtgagcatgactgcccaagccccacctcctgtcagatcagaggtggcattcgattctcataggagtgggaaccctattgtgaactgcatgtgcaagagatctgggttgcatgctccttatgagaatctgatgcctaatatctgaggtggaacagtttcatcccgaagccatccccaccccgtgtcccatccatggacaaactgtcttccacaaaaccagcccctggtgccagaaaatttggggactgctgctgtaaagcatgcacagtgcacgaggcctggttgagctctgagacttggctgagcccttgcagcagaggtgactgatgaggacacagcatcaggtcgtctactgcttcctgaacttgtactgactttcaggtctttttaccttttatttatttatttatgagatggagtctcactctgttgcccaacctggattgcagtggtgcgatctcagctcactgcaatctccatctcccgggctcaagtgattctcctgcctcagcctcctgagtagctaggattgcagacaccccccaccacgcctggccaatttttgtatttttagtacagacggggtttcaccatgttgatcaagctgatctcgaactcctgacctcaagtgatccacctgcctcggcctcccaaagtgctgagattacaggcgtgagccactgtgcccagcctgagtttcaggtcttcaaacaaaagttcacctgctccagagttgttgaaatgtaatgcattttctggaaaacgtgtgtctcattcatctcttgttggcgtttctgaaaataccacaggttctggagacgctaccgcttcatgtctcctagcagcactggccatctacctgggcacaccagggctccgtgaaaatgtgttcctgggatgccagtgtttccaccctgggatccaggaggcctggctccaaaccccaagtctgcacccactacctgggagatgtaggggcatgacagctgctcagaggtctcagtgtcctcacatatattccaggaacagtaggctggttgggccaccggcgccaacatcctgtggtgatttcttcatcatgacagggtttcgtgtctgtgagatgcctggcgagaatctgtagcaggttgcatgagagctggcttggctctgatgctccacattcttctccgtggctcctttcctttcctttcctttcctttcctttcctttcctttcctttccttttccttttccttttccttttccttttccctttcctttcctttcctttttttctttcttccctttctttcccttcttttcttttcctttctttctttctttctttctttctttttctttctttctctctttctttctttcatttcttttcccttccttccttccttcctttcttccttccttccttccttccttccttccttcctttctttctctcagaattcagactttggttaattgtgacaaacctattaataatttctgctctattagtttcctcatacaatacagtgctttatctgtcagccagagtttccttggtgtgtaaccgtggctcttatccagtgtatctcataatatttattttctgaaataatcgagagcatatgcttgttaatgcttttattagttcacatttgagaatgggttgccagtttgcagtctagataatattatggtgtctctgcatctgcctgtcagctgcatctactacttgaatgtttggttatttctccagcctcccctcattaaccattccggttcctccttaggcagcgctcctcatggccactgagcatgaagccaaggtccctgcagtgatatcctacacagacaagggtgtaaatagcttagtttcatcaggctgttgaaaatgacaccattctccatgcaccaattctttttattttattttttattttttgagatggagtctcgctgtgtcccccaggttggagcacagtggcgcgatttcagctcactgcaagctccacctcctgggttcacgccattctcctgcctcagcctcccgagtagctgggactacaggcgcccaccaccacgcctggctaattttttgtatttttagtaaaaacggggtttcacctgtgcggtggctcacacctgtaatcccagcactttgcgaggcccagacaggcggatcacgaggtcaggagatctcccatgcaccatttccatcatatttttgttactctgagtggtaacagaacctgtagctgctctgttaacctggaaacgggcttgctttgtacaaaaaaagttacctgctttcagatggggccggtgttcatttaatttttctgatgacacaaacttgatgatgatgaagttccctacagagaaagtcacactagaaagactgataagttttcagacccttgaggttggccagaactctaaagaagaggtagatatggagagacttggtaaaaggaatcatcctgacgtagtgacagatgggatgtggaagatgaaggagagggtggaatcaaagacgaatcatgaaagcgacccctctcgtggcgttgaaaagcttctcagttgttggagaatctttcacattgtgagctgattagattgaaaaacacacatatatggggctgtgacctgaactatatctgacgaagtcagcaattgctttgtgtgtttgtgcacgtgttcatgtttgtgcatgtgttcatgtgtgtgtaaatgggcctggtgtttgtgactcagtaactttttctaagagaaaacacgcatcctcacccttgcaggggaggcaccagctgtcagtggtgaaagagagagaagggtcttcattcccctcgtcttccctctgctgtctccccagccctttacctcccgccttggccccttctcccgttcatcttcctctcctcctgctccagagaaggaagtaattaaacggtctgtcctgtgttggctttttttttttttttttttttttttttttttttactgcatatagccctttttttttaaaaaattatactttaatttttacagtatatgtgcacaacgtgcaggtttgttacatatgtatacatgtgttggctttttaaggatgtgagacttgtaaaaacaaaatactatgagtagaagtatggaacaaaatgacaagcctcatttaccttaaaataagaaatctcttggccaggcttggtggtggctcatgcctgtaatcccagcactttgggaggctgagacaggcagatcacttgagctcgcaaattcaagtccagcctgagcaacatggaaaagccccatctctaccaaaaatagaaaaatgagctgagcttagtgtcatctgcctgtagtcccagctacttgggaggctgaggtgggaagatcactgagcccatggaggtcaagactgcagtgtgccctgatggtgccacagcactccggtctgagtgacagggcaagaccctgtctcacaaacaaacaaacaaacacaaaagataaaaaaaaaatctctaggtcagaagcagatgctaaagagatccagtagtcaaaggtgaggggaaatgttagagtgtggtcagggttcatcctgcctgcatgacactgcccatcctgtgctggggatgctggtggctttgggcttgtgtttagatttgcagttggggtcatattccaggtccaatgcattttcccatccctgataagctcagcacgatatgtgacttagctctcagtttctctgaaggagatggccttgcagtttgaactccaggagctcctaggagccactgtggaaaagaggccggagcatgaacaaggagcatctaacttcagcctgacaggacagcagcttgcagtgcagtagttacaacaactccgtagaattaccaagcctgccttgtagtgattggggagggagagttggtccgttgtcacattgttgctgtgactagtccattagctgacctcgggggtgtttctctggctcgtcgaacacagggctgttcagctgttacaaagctcgtgtccaacctaacatcagtgtctctctctgatttccttttgcgagcttgagagctgcctgtgatacactgttggtggtgcttcatggaatttgtcctgtgtgcatgcgagatagttttaattctctttcacaaactattaatgagctcacgtctagggttgctagagtttaggaacaggaatcagatgaggaataatgaatttaaagatatagatagaggactctgagaaaaacagctgagttagtgagtcctatctgtaaagggtatggtttcattctttttttatggccgtgtagtattccatggtgtatatgtaccacattttctttatccagttcaccattggtgggcacctgggttgattccatgtttttgctattgtgagtagtgctgcaaggaacatatgcatacacgtatcttttggtagaattatttattttcctttggatatatacccagtagtgggattgctgggtcgaatggtatttcaactcttagttctttgagcctgctcttcacagtggctgggattatcatacactcccactgacagtgtgtgagctttgctctgtagccttgacagcatttgttgttatttgactttttaaaaaaaccatcgagttggtatctcattgtgcatgagacggtatgtcattgtggttttgatttgcatttccctgatgatgagtgatgttcagcattttttcatatgtttgttggctgcttgtatgtcttcttttgagacatgtctgttcatattctttgtccactttttaatgtggttatttgctttttgcttgtttattttaaattccttgtagattgtggatatcagaccttttgtgaaaaatggacatttttaaagctacaatattttggtttttagcatatccagagagctatgcaacctatatcatgacctaagtttagaatatttttatcacctcagaagagaaacttcaaacctattagcagttattccccgtctaccctgtcccctagctcctgaaaaccactattgttttagtttctatgaatttcctaccaccactccatcatactctgccacccaccaaactaatgccacttccattgctaagcccactaggacactccctaaaacttcaatgcctgaccctcatgcctccgtgtattcctaaatagccatcgctgtagtataaccaaaaacaactatcattccgcgcaactatcattccatataagtggaatcgtacatggtgtcatctttcatggctggcttctttcacacagcgtgatgttttcaaggttcattcatgtagtagcatgtcagtacttcattgctttttatgactgagccatcccattgggtgtatttaccacattttatttatctgttgatcaatggtggacattggggttctttccactttgtggctattatgagtagtgctactatgaatatttgtgtacgtgcttttgtgtggacatgtttttgtttctcttgggtagatatctaagagtggaattcctgagtcatgtggtaactccatgtttaacctgatgaactagagggagaaggttggtaccttgccacgttagaatgacacaaatctctcccaggtggtgagtatagctcccaagtggtgtagctcctgtcctggctaagattcagccattttttttttcttgaataaatactcctcagattcttgtaagcctttggttattttgcagagttctgaggagggtgattttgacagttttgttcgagctgctttaacagaagagcggctttttgggataaatttctcatcctattgcttatttttaaaattactttctttgcttttaagctttaatagtgttacttgaactttgcttctaacagatgcatcatatttcagagataaactcattaaatcacatcatattccccaaaactttgacagaaagttacctaagtcaggataccttggtgactggactttcccctgagattgttttccttcattgcacagtaagttcatattctactgctctccctctctttcttaaatttttctatacttttttgtgtcctctttattgagatacagtatgcattcattcacattctctaatttaagagtgcagtttaatgagctttgaaaaaatgtgtagtcatgtaagcacgattatgatacaaaacaatttcatccttaaaaacagcttccctctatctttttacagtcagtccattcctttacaccccagcccttggaaatcagtgctctgctttctaacactgtggttaagtccctttctagaatttcatataaatggaatcatggagtacctatcatttgggtctggcctccttctcagtacaataccttcaagattcatccgtgttgttgcatgcttatcagtagttcaattctttgttattattatgtagaatttcgttatatggacataactcagcgtgttgatccattcaacagttgatggacatttgggttgtttcctgttcttagctaatttgaataaagctatgaacactcatgcataggcaattctgtgaaaatttttattcttttagcaaaatatttagtagaattactggtcatatgataagtttatgtttaacgttattagaaactggcagattgtgacaaatgatgagtatctttttgtgtatttatttgccacctgtaacttcactgacaaaaggatcacccagctccttgaccagtttattattggacattgccttcctattattgaattgtaagatctctaaatatatactgtcaaataaatgtttttcagatagcttattccaatatgtggcttgctgtcatttctttaacaatcttaatagtgccttttgaagagccgagtcttttaattttcaccaagtctaatttatcaacttttttcttttgtgattttgactgtcatactctatttaagaaagttttgtctcagccaaggtcattaagctttattttgtttgtttctagaaattttgtagttttaatttgcacatttagctctgtaatacagttcatgttaaattttgtagatggtataaagtaaagatcaaggatcatttctgctggtatgtggatgtccagtttgttcatgttatgttgaaatggtgattgtctccatggagttgcttttacttgcacttttattgaaaatgaatttgctactgatggatgggtctgtttctggactctattctgttccattgatctatttgactacctttgcaacattattacagtcttgattactgtaacttttaaaaagacttaaaatcaggtcgtttaagtcttcagattttcttcctctttaaaattgttttggctattctagattacttatgtttcaatataaattttagaataagtttgacgatttctgcagaaaatccacttagaatattaagattgcattaactctatacatcaattttgggagaattggcatgttagtaacattaagtgtatttgcgtgtagatctctttatttaggtattttaaatttttaccaatatcacatattttttaaagtttatcactgagattatatttttaagattattcaaaatgtgttatgaatttttaacttactatttccaattgttagtatacagaaatattatttatttttgtaaattgactttttatcctacaaatttgctgaactgttttattgattttgtagtttttccatacatttcttaggattttctacatagctgttcattttatctgcaaatcaagccagttttacttactaatttctgatttttactgcttttatttccttttcctaccttgttacactggctaggactgccagtaaaatgatgactagaagtgtgagagattaaatctctgcctgggttctagatctaaggggaaaagtgttcagtattcatccattcagtatgttacttgtcagtttctcatagatatcatttggcagatatcttttggcaggttatgagagttcctgggttatggaaaatgccataaatttcctcttagcacttccttgcatgcgttctatgaattttgacgtgtgattatttagtgtttgttcatttcacactcacatttttacacagataagtattgagctaaaggtcccataggactgtgctgcaggtctctagagctcaggtcttctgtgaagcacctcctctccaacaccctgctccataacgtctagctttaccgaactcctggaactctgggctttgtgtcctcagttcattaggccaccaggtcttatctcaatctcctttcttaggctgtggtctggaagctttctctaggcagtgagctggggccctcgtaagctcaaatgtttgtttcctgtctattacagatgactctcttgtactgcctgttgtccaaagtctaaaacacatcattcgtgtatttttcctatgttcttattgtagaaaggagagtaaatctagtccctgttattcctttatgctgagaaacagaaatctgtaggtttactatcacactgatcttgtgtctctgatttcatgaaggaagcgtgcatgagagaaactcccagaggcagatgtgctctaggaggagtgaaggacagaaatggcaagccctaggtagcgcatgaggctgggaccaccattctggggttgatgtttctccatcacacattaggttgacctggggagtgtctaggaaaacactgatgctgttttgcctcacaaacactaagtcaaaatcccaggcaccagtgttctgtgaaagctatgcttgggaaactgacgtgaacctatttgtgtgaagcatggggctagctcctctaagctgattctgacctgtcttatgtgaggtcactgagctggctctgagatgcctaccaatattgaagtatttacagactgaagcaatttaggcagcatgctctagtacttccagtatcttcagacaagctgcaattcttctaaggagctgaggggcaggagggtttgatctcacttggtagtacagtggcagttgggaagtgcccgtggacatgtgctatgttcagaattgtcagaattgtggacagtcactccaggcactaatactgggaactgccaatcaaggcacatggtagcaacttagtaaattgcaactttttttttttttggaatgaatttgatcaggtaatttgttatctctgagcctcagtattgtattagtattgccatgtgtaaaatagtctacttctgttatcttccaggattttgtgaaactcacataaaatagaccacgtgaagacatttaggaatttatttaaaaagagggaggactataaatctacttagtatgttttatgtcttaataatttaatttagtctaaaagtgggttagatgtaacggtgcctttagaaattaggtcttgtgtaaataggcattgttttggtttgaattagttcatagaggaaagtaggtttactttaataaataattgaaaacatattaatacaagtcgcaaaaattttttagtgaaaagtgtggaaagaaaaaaaaactacaataaaacggatatggttttctgctttctcgttgttggtattttatttaagcattcattctttatataaggctcactctccttggcttttcttcctctctgaaataaacagacattagtcacatgcagaattaaacgctgctgcagaattttgtggtgtggcatgagacactcagagctgatggaagtctagaaaggttaagccgttgtccgacctgaatcaagcaattcttttcaaacattcagtaaaatgcggccaagtaggcataatctaaaatggactatgtggaggtcccgtgggcaagattggggaggaattcctgggcagtcttcatccattttctttttcctattatggtaagctaactcacagcttaagtcaatccatgaatccatctctagtcctgggtcaagcaacaggggtgggagtctggtggggaatccggcacttagagtaacgtgttcaccatcgctcgtgtgtgtgtgtgtgtgtgtgtgtgtgtgtgtgtgtgtgtgtgtctaatggtaggatgtttcagtctcttctcgtattgctccagagagagcgctgtggtctcacaagtcttctgaggattcttcctggtggttcagaacagagtgtggactacagaaactttaatgtataatgtgttcaggaaagagtacctgtaatattttgcactgttcatttttagtatagaagctgcaactcttgtcttaatctacatctggttttagaaggcaggagttcttagggaaaggctggtgtagcttcattttggcaattttaaaagttttacccgatgaacccttagccatccttgttagtcctgcagacaaccgtgaacataccacagacaaggtgctcagaagggggacttacctatgcaggtccaatcatctgcaaaggatcgggcacattggagcctgaccgtcttaaaaaagcctttctttatgagaatccgtgggctttttctgtccaaggcaaagcacaaagcacttgttgggcctatttaaggcactgcaggatggcatccttgatggggtgtttcaggtaagccacttgcaccttttgtagtaactttcttatagacagtgggctcattcagtgtgtggcagatgcccggcaagcatgcttcatcttgctctgcagtggcaactctctcgtttcccatgtggaattgtgaccatggagcttcgtattttcagagatttagttcctaatgaataaagtattttaaatgtacttatttatttgtgaccccaaaaaagaagggtttgggttagatgatctctttcagctttcagagcctgcagtccctttcctgattccgaatcataaatgtatgggaatgtgtcaatgtgcaagagaaagaggggaacagaaaaagtcaaatacaaacacaagagtattccagttaacttaagcgagaaaatcttccacaattcctctttcttttggattctctcctgttgtctccaaggctcactgactccaacacagggccctgagggtcggttgcaaagtgcttgaacattctgtcctttgtttcacatctagtctcatttcagggtccgtttgttgacacttgaagtcaagcgctgtgtcatcagagagactctggtgcaaggcagtcagctgtttactttgctgcacaatctctgtgcccagttcagccagagagagcagccctgcatgcagcaaaccagaaccaagcctgcagcaggactcaactaagttgtcactctggagtgtttttctggctggaaatgaagctaatccttcctaatgcgctggcttcttcgaccatgtccaagcgagggctcacatttggctaaggcttcgaatcctgtttcagggaatccaattcaattaattcaatgttcctctttacttagcaaatactaaatacctactacgtaccagccagagcagtaggcactggagtacccatgagacgtaaatctaggtacatagtgggaatcttaaatttgctaggactggggaattcgggtgtatagccaaacaaagaaaatgtagtggaagaaatatcaaatgcaaaaaaagcaagaattcttagtttaaaaaaaaaaaattatttcacttatgaaaggagtcttctgtgaaaccacccctaggtgtaagccctggggatagatcgttagaaacaggaccccccacccacccccacagagtacctgggaacttaagcctacaaagattttctagactctctattagagaaattttaccaaaacagttatgtttcaggaaagtggggatcattttacccagtggccttgcaagtttcacagcaagtctccttgttatgggtctacagggaattaaggcaacttgaactaagagagaaaactatggtatattttctaaaaaaaaaaaagaaaatactgcaatgagagttctattttttttttttacttggtagagtaagtcatacctaaaatttccctgtaagaccttggtcaaaataagaatgttattactttggcttaatatcaaaatggtaaaacatgaactggaagtcaagataatagttttctttacatcttaattgcaaatccttcaagaaaaaaggaaaatatgacaaaagcaatatagcatagacattgaatagagactttgaagtcaaaaagcttgaaatcaaataatggctctagccgtcactcaatgtgaggtcggaggcaacttatgaaacctctcttagcctcagtctttccatgtgtaggatggggatgataatatctatttcacatggttattattacaattaaatgagtggctaattgaaaagctctttaacaagtgcctggcatgtagaaaatgctcagtaaatttcatttactatcattcttgttgctactgttactgttattattacctgcagtgtgtgaggtcttaggctgtgcttggacttggacatgaactgggaagggtgaaggggagggtgaactgcaaacctgagtaagggtgaaggagagggtgtactgcaaacctgtaataaaagaagtctgtattgaaagaaaaagaagccaggatccccagagatacaggggagagtgtagaatgtgagggaaccagcaaacccagtgttctctagtcttaaacactgaaacgtctgagacagctttatacatctccttgggcgcatttctctaacagacaacagtgtggaaatctgatccagctaacaacagaaacacgaagaaccaactgcataccactccatcaagagccaaccctggtttaaagtaaagcttcctgtggtgtttcagtcttattatccctccagggatccagaagtcatcatgaagatatttcgctaaaactgcactcgtacgtttaaacactgataatggaaaaatgtattttgccaaaaacagtaagaactgcaacttctattgaaacatactgagaaatagtgttatagtgaaagtcaaagatctgatgttgaatcaggttgggagggcaagaaatgattttcatgaagaaggaagaaaatgaatattttcaaaagctcacctgcctggaagtcacaatgaagcattaaggaacatctgacataaaaggagggagtgtaattcatcaagaggatgcccatggggacttgattgctggactttatttctaagtcaggggaggcatgatcctaagcattctgaagagatggaagggacatcggggctgccactgggcccctccctcacacctcatgctccaccaggagagctcagccttgccacgcggctctgtggcctgggacctcagggtcggggtgagccgtggtcctgctcaggggatagcaccctctgctctgctgtgcacggtagccccacttttcattctgcacacttcttctaagctgcaggagctcctggctctttttcatgtcaccaaagagccttaaatacagaaatcttcatgttttctttcttttttttctctttaggagtctctagactcctcttggcccaaaggttaacatggtaggtggcatttgcattaagtaggtaccaataggggtgtgtgtgtgtgtgtgtgtgtgttgacctttgctttgatcagcttttattacaaaatttgaccatgactacgtttgtgtgcaagagatgccgctggaagtatagtcccaggctgggaagctgctacctagcagcaaagttacactagggaagaggaggtgcacagctgtggctgacagcagcggcctttgccacaatcagtactgggcttcagtggtctttctccctctattatatcacatttattataacagctttatgtgcatgtgtctctaggtcaccagctccttatgagaagtacccgagctgtttatctttctttctccaggccccagcctcattctttctttttgtcctgattttactttttttattatactttaagttctgggatacatgttgcagaatgtgcagtttgttatgtaggtatacatgtgccatggtggtttgcttcacccatcaacccgtcatctacattaggtatttctcctaatgctatccctccccttgtcccccacccccgacagaccccagtgtgtgatgttcccctcactgtgcccatttgttctcattgttcaactcccacctatgagtgagaacacatggtgtttggttttctgttcctgtttgtttgctgagaatgatggtttccagcttcatccatgtccctgaaaaggacacgaactcattctttttatggctgcatagtattccatggtgtatatgtgccacattttctttatccagtctgtcattgatgggcatttgggttggttccaagtctttgctattgtgaatagtgccacaataaatatacgtgtgcatgtgtctttataatggaatgatttataatcctttgggtatatacccagtaatgggattgctgggtcaagtgatatttctagttctagatccttaaggaaccaccacactgtcttccacaatggttgaactaatttatactcccaccaacagtgtaaaagcgttcttatttccccacatcctctccagcatctgttgtttcctgactttttaatgatcgccattttaactggtgtgagatggtatctcattgtggttttgatttgtatttctctaatgaccagtgatggtgagatttttttcatatgtttgttggctgcataaatgtcttcgtttgaaaagtgtctgttcatatcctttgcccactttttgatggggttgtttttttcttgtaaatttgtttaggttccttgtagattctggatattagccctttgtcagatggatagattgcaaaaattttctccctgttcactctgatggtagttgttttttgttttgctttgttttgtttttgctgtgcagaagctctttaattagatcccatttgtcaattttggcttttgttgcaattgcttttggcgttttagtcaggaagactttgcccatgactatgtcatgaatggtattgcctaggttttcttctagggtttttatggttttaggtcttacatttaaatctttatcttaagttaatttttgtataaagtgtaaggaaaacgtccagtttcagttttctgcatatggctagacagttttcccaacaccatttattaaataggtaatcgtttccccattgcttgtttttgttaggtttgtcaaagatcagatggttgtagttgtgcagtgttacttctgaggcctctgttctgcttcattggttgatatatctgttttggtaacagtaccgtgctgttttggttactgtagccttatagtttgaagtcaggtaccatgatgcctccagctttattctttttgcttaggattgtcttggctatatgggctcttttttcggttccatatgaaatttaaagtagttttttctaattctgtgaagaaagtcagtggtagcttgatggggatggcattgaatctataaattactttgggcagtatggccattttcacaatattgattcttcttatccatgactatggaatgtttttccatttgtttgtgtcctctcttatttccttgagaagtggtttgtagttctccttgaagaggtccttcacaccccttgtcagttggattcctaggtattttattctctttgaagcaattgtgaatgggagttcactcatgatttggctctctgtttgtctattattggtgtataggaatgcttgtgcatttttgcacattgatttttgtatcctgagactttgctgaagttgcttatcagcttaaggagtttttgggctgaggcaatgggattttctaaatatacagtcatgtcatctgcaaacagataatttgacttcctctcttcctaattgaatatgctttatttctttctcttgcctgattgccctggcaagaactcccaatactatgttgaataggagtggtgagagagggcatccttgtcttgtgccagttttcaaagggaatgtttccagcttttgcccattcagtgtgatattggctgtgggtttgtcataaatagctcttattattttgagatacgtcccatcaatacctagtttattgagtgtttttagcatgagggggtgttgaattttatcaaaggccttttctgcatctattgagataatcatgtggtttttgtcactgattctgtttatgtgatgtattatgtttattgatttgcatgtgttgaaccacccttacatcccagagttgaagccgagttgatcatggtggataagctttttgatctgctgctgtattcagtttgccagtattttattgaggatttttgcatcaatgttcatcagggatattggcctgaaattttcttttttagttgtgtctctgctaggttttggtatcaggatgatgctggcctcaaaaatgagttagggaggattccctctttttctattgtttggaatagttttagaaggaatggtaccagctcctctttgtacctctggtagaatttggctgtgaatccgtctggtcctgggcttttttttggttggtaggctattaattactgtatcaatttccgaacttgttattagtctattcagggatttgacttcttcgtggtttagtcttgggagggtgtatgtgtccaggaatttatccatttcttccagattttctagtttatttgcatagaggtgtttataatattctctgatggtagtgtgtattttgtgtgggatcagtgttgatatcccctttatcattttctattgtgtctatttgattcttttttcttttcttctttattagtctggttagtggtctatctattttgttaatcttttaaaaaaaaccagctcctggattcattgatttttgaagggttttttgtgtgtctatctccttcagttctgctctgatcttaattatttactgtcttctgctagcttttgaatgtatttgctcttgcttttctagttcttttgattgtgaagttagggtgtcaaccttagacctttcttgctttctcatgtgggtgtttagtgccataaatgtccgtctaaatactgctttagctttgtcccagggattctggtacattgtgcctttgttctcattggtttcaaagaacttacttatttctgccttaatttcattatttacccagtagtcattcaggagcaggttgttcagtttccatgtagttgtgcagttttgagtgagtgtcttaatcctgagttctaatttgattgtgccgtggtctgagagactgttcgctttaatttccgttcttttgcatttgctgaggagcgttttactccaattatgtggtcaattttagaataagtgctatgtagtgctgagaagaatgtatattctgttgatttggggtggagagttctgtagatgcctattaagtccacttggtccagagctgagttcaagtcctgaatatccttgttaattttatgtctccttcatctgtctaatattgacagtgagatgttgaagtatcccactattattgtgtgggagtctaagtctctttgtagttctctaagaacttgctttatgaatctgggtgctcctgtattgggtgcatacatatttaggatagttagctcttcttgttgcattgatccctttaccattatgtaatgcccttccttgtcttttttgacttttattggtttaaagtctgttttatcagagactactgcaagccctgctttttttactttctatttacttggttaattttcctccatccctttattttaagcctatgtgtgtctctgcatgtgaagtgggtctcctgaatacagcataccagtgggtcttgactctttatccaatttgccagtttgtatcttttaattggggcatttagtgcatttacatttaaggttaatactgttatgtgtgaatttgatcctgttgttatgatggtagctggttactttgctcattagttgatgcagtttcttcatagtgtcgatggtctttacattttggtatgtttttgcagtggctgttactagttttccctttccatatttagtgcttccttgaggagctcttttagggaaggcctggtggtgacaaaatctctcagcatttgcttgtctgtaaaggattttatttctcctttgcttacaaagcttagtttggcaggatatgaaattctgggttgaatttttttttttttaagaatgttgactattggcccccactctcttctggcttgtagggtttctgcagagagatccgctgttagtctgatgggctttcctttgtaggtaacctgacctttctctctggctgcccttaacattttttccttcatttcaaccttggtgaatctgacgattatgtatcttggggttgcccttcttgaggagtatctttgtggtgttctctgtatttcctgaatttgaatgttggcctgccttgctaggttggggaagttcttctggataatatcctgaagtgtgttttccaacttggttccattcttcctgtcactttcaggtacaccaatcaaacgtatgtttggtctttccacatagtcccatatttcttggaggttttgttcgtttcttttcattcttttttctctaatcttgtcttcattctttatttcattaagttgatcttcaatctctgataccccttcttctgcttgattgcttcagctattgatacttgtatatgcttcacaaagttcttgtgctgtgtttttcagctccatcaggtcatttatgttcttctctaaactggttattctagttagcagttcctataactttttatcaaagttcttagcttccttgcattgggttagaacatgctcctttagctcagaggattttgttattatccaccttctgaagcctactgtcaatttgtcaaactcattctccatccagttttgttcccttgctggtgaggagttgtgatcctttggaggagaagaggaattccggtttttggaattttcagccttttcgcgctggtttttcctcctcttcatggatttctctacctttggtatttgatgttggtgaccttcagttggggtttttgcgttgtcgtcctttttgtttatgtcgatgctattcctttctgtttgttagtttttcttctaacagtcagtcacctcttctgcaggtctgctggagtttgctggaggtccactccagaccctgtttgcctgggtatcaccagtgaaggctgcagaacagcaaagattgctgcctgcttcttcttctggaagcttggtcccagaggggcacccaccagatgccagtcagagctctcctgtatgaggtgtctatcgacctctgctgggaggtgtctccccgtcaggaggtacgggggtgagggacccacttgatgaggcagtctgtcccttagcagagcttgagcgctgtgctgggagatccactgctgtcttcagagccagcaggcaggaacgtttaattctgctgaagctgcgcccacagccgccccttcccaaaggtgctgtgtctcagggagatgggagttttatctatatgcccctgactggggctgctgcctttctttcagagatgccctgcccagagagaaggaatctagagaggcagtctggctgcagtggcttggccgtgctgccatgggctccgcccagtctgagcttccctgtggctttgtttacactgtgaggggaaaaccacgtactcaagcctcagtaatggcgatcacccctcccctgaccaagcttgagcatcccaggtcaacttcagacggctgtgctggcagccagaactttaagccagtagatcttagcttattgggctccatggagatgggctccgctgagcaagaccacttggctccctggcctcagcctcctttccaggtgagtgaacagttctgtctcactggtgttccaggaagcactggggtatgataaaaaactcctccagctagcttggtgtctgcccaaatggccacccagttttgtgcttgaaagccagggacctggtgatataggcacccaagggaatctcctggtctgtgggttgtgaagaccgtgggaaaagcctagtattgggctggatagcattgtccctcacggcacagtccctcatggcttcccttggccaggggagggagttccgtgaccccttgtgcttcctgagtgaggtgatgccccaccctgcttctgctcaccctccatgggctgcacccactgtctaaccagtcccagtgagacggactgtgtacctcagttggaaatgcagaaatcacccaccttctgcattggtctcgctgggagctgcagatcggagctgttcctatttggccattttggccaggaatcctccttacagatgctgtttattctaacaaccattctgtccataacacacacacacacacacacacacacacacacacacacacacacacacacgtgtcacaagtgaaattttgggcaagtcattagatgtctttgaatatcactcacacagcaaatttgtgggtatcccaggattagaaacaatttatctcaattgttaggtcagagctatttctccttatgtctgtgatttctatctaatgtgtatattaatataagaatttcagaaattatgcagtaatttaaaagttcaagaaacctttattgcaaacacctccttctgcatttcacaggagggcctaaagaaaaactttttcatagaaacatgtacacaagacaatattaccagaaatcaacccccaaaatgaaggcatcagggggcacgaagaagagacttaacaaactttttttcttcccttgcaaattctggtatcctaagaagcagtctgaatgatttgtgcatgaaactgccttggagcaggtgcaacttcagggggaattctcttatttttattgcataaaaaatgaatcctatggaaatacagactcctgttctgctgagttttgcattcgcatagctgaattaggagagggagatccagacagtacagtgtactgataccatttgaaatatccccacttgttcttcatgaattcccccatgaggttgtcatcatttaattcaatttaatctttaaaattcaaactcttttgaaactttttatatgtggagtgctctgatctcatttttggcttctatgacacttttcccttaaaagcaaagctgtgatctgtggcgaggaagtttgagtggtgcatcttccagtctcatctctgccatttgttccagtgtctaggaggaaagaatctttgcactatgcatattcagtgcactagggataaagtggccaatgtgtcttcattccccaagctagaatggtccttcatttatcggccagcctttgctgaacacacaggtcctgccattcactgtacaagggaaagatagagattaagatccaggcaggtccctgctcgcagtgctgactgagtactgtacctatttgcccatgtgatgtgtctttctattttccaatgagagtggaggtccatgttttaagactactttgcctcccattgactgaggattgggattagatctttgattgggctagagggagaggtgagacactttgaaggggtacagaaataatctgtggagggagaggaatcaagagggactggacaaagttgtgtctttatcttctggtccccagattcaccactcccctaagagcaacagcactagctcacagctttagcatgacatcctctgtagctttactcacagtgggaccagttctgtcacagtaggaagaaattctgtcaaggactaatgtcattgctccccgggtggcccaaggcatccccagctgatcatgtgaccagccagcctcccattcttccaggtcagagagaaatgatctacttttttatcttggtgtggtggatgggactaaggaaagaaagagttggggtttgtcatattatttctttactttgtactcagtagattatattgacaggcattgagtaaatccagtggaaacatgaactctccatactgtagtagacattgaataatttgagcagaataacagagagaaaaggaaaatgactaaataacattttaggaaataagctacatttcctagacgtgggatttggcaatttgggatggatggagaaatgaactttgtgtatctctctgaaacaggtgaaattgacattctggaacaaaaatctaactatgaaaaagaaaactctttatttcaaatctatacttgggcaacagtttggggccaggaggaataaaagaccttaacaggtcctctgtagccctctctgacttctaggcgtctgagtaatcacagacacccacacattgttttaaaaccctccagagagagaaagggagaaaaaatgtctttgataagatcaggtgcgttcagggtcgtatggctgtagacagaaaaatgtttttgtttccactggttacacattctgatgtccgacctacatcccttctgatgaaattcaaaccaaacccttttctttcccagtccccattggaaacagaaaatagatatgcatttttcacactttaaagaactcatcatgtaaaaaaattgctttttaacacatttcatgccatcatgtcttccttggaaattttcagtgcctttttttctatttgtctaagtagagaagctatctttctattttttttatggcttcttctgaactcctaccgagacctgttcatctcacatcttcaggccccaaattggatacacaatttttaattaagatgtgatccagcgaagtatttgcttagatcttacagatctggaaaaaaatgcccttaagaaaagactaggcaaatagaaataatataatctccttgcctcagtccaaacttgaaggactcattagaggatgcatgcaagtagggaccagaggaccatgaaaatcctgctgggattgagcgtgatttctgctgagatcactgagatgccacaacattgaatgctgaaagttttagcaggaatcgttggtgaacttttcctttggaattccgcaagtgcttcttgttacaggcatagacaaatgtatactaaaaattacatgtataatttaaatttcagcaagaaatactgttgacttcttatgaggaaaaccaggcaagtgatttgtaaactcttgaagcaagaaatgttgatgtcttctccatctctttatcctgtagagcacgttgcactgagatggccccagaagtagatactgagaaagttctagttgaatcatttaatttgaatgaagctgtgagataaaaggaaaaaaaagaggctacttataaaataaatttatagtatggtcacattatccagagtaaggttagttcggtttggtttgaattgtttcatttttagccaggcacagactgctcagaaagtaagcatttaaaaatttgtcgagatgttatttattatttggtaaaagttgcaatgcaccaagatgtaagattttacacccctgagttttatggcatcacccttgctaatttattcatgattaaaccaaagaactctcaatgaggagaagtagattgcaatataaattggtgtcattgtttgtaaatgtgctccactaagcatatatactgctccactaagacagcttctagtaccatgcctggggcttcaatgcaatttgcttacgttgaatcactggctcccagactccccttgtgaactgaacaggcttagaaaatcattctaaagaatgcatggtttgtgtagttgtagaacgaaacttctcttggaagcttattccccctcaccagggaaggagttagtgggagattctcaatctggtctgcagatgagtgccttctaggtaattcacacatataatttacagaagtgggaagaaatgaattcaaaccatttttttttttccctcagaaaactaaatgtcaatctcattccatttccgttggacggggaaattgacgtaggagcagcgtgaggtagagtggcatgctgaccataactagggtcagtcaccatcggaggacccagcagagagctgtggggtgctgcagctggggaggactttctccatctgtttccccttggtaccattgatttgttgtctgatttaaatatagagttcagtatgcaggtgtgtaagtgcagcataaataaaatggcatcctccttcacagccaaggggccttcgtctgggaaactgatataatttatgagagcgaggcagcagcataaatacgtggggtgctttgtcaccggccagtatggaattggtcagcttggaggaggggaaacagagtcagggggaagacagcatgccaggaggagctaaattggggcaccaggacctgaaccctggaagccagtccctaaacaaccagagctgctcagcaactgctctctaattaccctttgtccctggagaattccagaggggatgggattgcctcagtgaacttaatcttagatgggtggctgtcctccttctttttttcccttgacggaggagggagggagggcgtcgagggtgatgcatcaaactgagggtgacaagaagctggcgccttttgctccacttcccagccaggagggctgacagtgctggagtggaccagtccgcggagctccgggggtctgaatgctccaggggtgtgtggatggcaatggccaggatggccctcctggttgcgacccatcagaaagtggataccactgtcctctggtttgcctgctgtgctggtaaggtgtggtgacgtgtgtgtgcctgtgtgtgtgcaaagggcaaagagatggacagtgttaccattattcatttggaattagaattgtggaggcttgcacatttgtttgtcttccaagttctggcctcacccacccttttttgagggagagaggggccaggaaggaggccgttcccagccccatgagtcaaggagggcatcgggggatgctcccactgaggaagctcagagcggggcccggagaaaggggtgctccaagcggtgcttcctggtcgatggcacgtcggggtgggcaggctggagttgaagagcttctcagcgtggataggaaatcatggaaatgaggaatgatctagcctccagcagtgagtcggaggaataaatgaatcccggaaatgcagtttctgtgaactccagattgctatggagattgcattgctttcccaagacttaaaaaacgaagagtcagcgaaagctgggagagcggtgatgtatggaagtcaggcgggccagcgcgccgggagtggtgggaagggggcttcgcaggtcattacacggggatttctccgcgcagaaaaagggattagcgttttcacctggtggggatttcatgagcttttccctggcctgctcttcccctgccctttcccagagagcccagcttcagggacagcgcccgcgaggtgctgctggggtggcggggcttgtgggcggaggagggcggctctctggtgtgcagcaccgggtgtgagtgtgggtgagcgtgtgcgggagagggtgtgagtgtgagtgggtgggtgggtgtgaaaatgggagaaagtgtgagcgtgtcacagtgtgtgtcactgagtgggcgagtgagaaagtgggtgaatgtgtgcgtgactgtgcaagtgtgtgagtgtggggagtaagatttgtgtgagtgtgagtgtgcaagtgtgtgagtgtgggggagtgagtatggggaggagtgagagttgtgtgattgtgtgtacacacacgtgtgcacacagggcgggccgcgcttggcatttgaggaggggctcggaggtcctcctgggctggccgctgtcctgggagcagggcaccagggcaccctgcgagttttcaccttgccaaggtatgccagaagccggactccagcttccttgccaacgtgtgcgggaagcaggaccccagctgcggtccagggaggaaaaggggggtgctcacagctggggcgagtccctggagcccacaggcagtgacttgccccagaatgagcttgagagagtctggggatggagaacactggggatgcttggtgtggtgcagaggtaggaggatgtggatgcctgtgaggtactggtgcgaggtttgccacgtgttatccctgcatgagagagcgtggaccactgttttaggccaggatagggacagcatgtccaattacacagggctctgcccacctgcaagatgcaaggaggccctgtctccaatgtcccctgacctgacagtcctgccacctgccagcctcgcagtggccagccccgcccccagcaagccccacccctaagagccacacccccaacagctcacccccctgccagccttgccctcagtcctgccccctgccggccttgcctctgccagccagagccagtcccccagcaagccccgccccctgctggctctggcccttctaagccccaccctcaggcagtcccgccccctgccagccccaccactgatcatccccgccctcagacagttttgccccttgccagctggaggtgggcctcctccagccagagtgaatctcttagtaagccccaccctcttccagccccaccctcaggcagccccacctgcttccagccttgctgaacagtcccgcccctgccacccacatgggttcctgggtcttgcccctgactaccagggtgaccccaatgcctccgagacatccttctgccctagaacagccaggagagcagagagaacaatttaaatgctcagaaagacaactctttcttactgtttttgctttgcccagggaattgcaatcagtttcaatacacagttaataaaatgagaggcattcagcgtggatgtgggtgtcaagggagagggctcaggcttgcttttgccttttagtaccagttcctattgtttggaaaacacgaggtggcttccgagaacaggtcttggccctcgcctgccctggagccccctgtccaagggccgccgtgcctcacaggcaggtgcattgctcttgttttaatggtggccttcatggcagtgggacccctccctccatgactgtccccaggtattgcctatggtgttatagtgtgggggcctcagggaagggtaggtgacctgtccacatttaacataattgtaaagctcattgaagaaaagaggacgaaggagtgacgtccaagtttattgagctttaggaagagaacggccagatttcgttttgagattttctcttatttgctggaagtctgttcaaatcatatgtctcttctgggttattaaacggtcaaggttgtttctggatccccacaaaaatgtgaggatacaaagtccccttgggatgtgcagtggtacccatagtcctcgtggttagaggataaaggggtccctagaatgatggagtaataagggcaaggtgtttggaagcaaatgccgagaagaaatgctcccttatgccgtaaaggccaggagactgtggtcgtcaggctgagtggatggatgggaaaggaggaagtaaagagcacacaccggcttttggaagcagatagctcatagcatttgaagagggcattgccatgactctggcctgcctctctcattggggaatcaaatattaaaaaaaaaatacttatatatcttttagagtgatcttctttggtaatttttagtatataaaaaagaaaaatagggaagaaaccttcaagtttctacttacatttcctgaattaaatagtttacatccatagaagaaaataaatattcatgcaaagctatacaaattcctttgtaggtttttagtaactattctaacagaaatgtatttgtagctaaaaaatgaagtgttaagcatgttttaaaaacggagcattgattttctacagcagggatatttagagtcttctttcccctggttacactcatgtgcatttgcttaaatccagtggcctctggctgcacctgcctttgcatcatgactttgtccaatcctgcatgtgttaatttagggcccaagggaccagtctggagcacgcagccatcctgagtaattcacagtccattagacagcggtctgtggggtatgtgctgagtccacacactgatgttccaggaggttcttgcaacttccccaccttgcagctgcctctccagcaccttactctcagtccttccccacaactactctccatctttaacttattacactccctgtcttagtccctttgtgttgctataataaaatacctgagtctggataatttataaagcacagaaatttgttttctctcagtcctggggtctggaaagtctgaggtcgaagtgctggcatctggcaagggccatcttgctgtgtcctccatggcagaaggtggaagagaacgaaccttctcctgcaaccccatttttttaatacattaaatgcatttataagggtggagcctcatgatttgaacacctcccaaaaggccccaccccccaaacactgttgcattggggattaagtttccagcacataaattttggggggcacattcagaccatagtacctcccaaatctataaggccacctctactttgctctcagctctatctgttcatttgcaattgtcttttaaaccccacttaaatgtcctatcacattttatcaacaataacttacttcactgggcttccttacacacactagttcctattcctgacttctgatttttattaatatccctgttcttctagttatccatctttgacacttataatatctctttcatttactacatatagtaaagtgaccacattttgacaattctttctccagtgtaagtgtggtgtcctataactaatgcccttttcttcctatagccatcacttgcatcctccatgattggaacagtcccctggtgtgccccacacctgctgttctcctctccagcatctaatccgtcctacccactgccatcagatcactatggagagcccaggcctaatcatgtcaattccaggctatcagatgttcattgtcagtttaatcacagaattggctgaagtcctttatgctctaattattccatcatcctcaccctcttctcctacatgcaattgacactatgactaaatggggtacttgctcttcctccaaaaaagctctaaacgtttttgtttccttgcttctgtaaggcagttcctcaccctataaggggcccattctgtccctgaaattctcatccctcatatttatctcttgaaatactgtccattatttaaaatacaggtcccataccttctttttcacaagattttccaattttcttaacttgaagtcatagctctctccccctacctcctccttccccggtatacttggtaattctatattcacattattcacacacatgcatccaaacatttttcttatccttctactaaatatgaaatatcataagtagaagccactcctgcttcacggcagcagtctcctacataaccacagagtttagacttcactaaaatgtaagctttgtttttgtcaaggttgtatctgaatcagtgtctatatcagggcctgtaacctagcaggggtttcaagagtgctgatgcaatgaacagatgaatgaactcttgtgaagcaatagatctagcacccagattgatcccgtcttcttacaaacacatctttaggctgtccccctgtgtcttcttcaaagttgacactgatattcgtttaaattttatttcacctgaataaaaaaatatagtgtgagaatgatctgctgagagcccagctctccttaaaaaactctgcctcaaagatactttaaattatattcttgatgaaatttgtattcttcgtgatgtatcaacctcggcagcaaatgacaacaaaccacagctggttactgtttgaacccaaggttgtaaaccaaagagtgtgtgtgcatttctccccaccctaccccatacaacctacttcatcctcatgcatgtgtagataacaggtcaaccaaggctagaaatcataatgggtgtgagttctggttccagagttatatcacctcaatgatcttattcatttcattcctctacccttgcttgagtaaagctaatcattttctcatcttccccagatctctttggggttctaaaccaagctgaaaagtagaccacagttaatacgccctctttcccagccacccagtacatctcctgtctttagccagggaagcacctgtatgccccaattctggccaatcttggctaaggtgccaactctaacgattctagaagctgttggttaagtgtgttgcctgatcagggatacttccttacaatgagggagttatgaagaagctattggatcaataagctaatattatagaattacactatccagtactagatctggaagcaaccttataggtacatattctaactccttttataagtgaattaagtgacctctctggttgagtgatataagatctagtccaggctgtgccactaactcccaattcatgtgtatttcaccataccatctgcctttcctctagagtctccaaagaacaaagctacaatgagggaataaaaaagtagaattcacaatgttaagaaggcagttctctcaaaccataccacgtaacagcaactcctctgcctagccatggtgccaaccccatcaattttcaataaaacttcacctgtaatattcaaggagtagtggagtacgtgataatgcactagatttaaagttacccaagggctaatttttaaaaaatcatttttcatatccaatattaaattggttgttagttcttttctatatgtctgtgataacctttgtgccctggttagcagggtctagaaagagccatccatctcaacaacagtggatttagacttgcaggaaacatacagcttgagtgatttggctgtatctttaatgattcctgaacatctgccagaaagaagttgctcatttcaagtaagtcagtgatttaaacttatttttctgttttgtttctttctattaaaagtttctcctaaaattttaatttcatgagaaattctgattagttgggaagtaattttttttagttataatacaagtcaaaattaatattgacttaaggtataaattaagtttactcttgtagtgcctatgaaagactaaaattatgctgttcataaaatgtccctacagataagtttcacttaactggttttagaagatgcttttgggcctttttatttgccctaagcagacatttggactcccttaggtgaaatatgctccagcattagactgctttatttactttgagtttgtcttctcaatatgtgatttttagaaacttcaaaagtacaatgtcttttacatttataagtaaataattgagggaccagcctgcctggagcaaaggaatcagaaaacaagaaatctcagaatgactggtgacatggagtctgtgcttcactgcagttgctagaagtaaaccacagattgagctctgagcttcctaatagccatggcaaggagggaaagccattgaggtgctattcacagtagccactgataaaaacaaagcagccattcactagccatttcctgctagtgaaacataaggacagtttatcccatgagttcttttaagaaggaatgaagggctgggcgcggtggcttatgcctgtaatcccagcactttgggaggccgaggcgggtggatcacaaggtcaggaggtcgagaccatcctggctaacacggtgaaaccccgtctctactaaaaatacaaaaaattagccaggggtggtggcggatgcctgtagtctcagctacttggagagaggctgaggcaggagaatggcgtgaacccaggaggcagagcttgcagtaagcggagatagcaccactgcagtatggcccaggtgaaagagtgagactccgtctcaaaaaaaaaaaaaaaaaaaagaatgaagaaggcagatgcaatgtgacagagatttactagatgatgtgctcgataacacccttcaactagaaaaaaaaattagcttctcttagaatgtgctatcggcatatattggcatacagtaattaagtgtaattgagaaaaggtaattctgagagggaataaaagcaccagatgggagatacggcattcactcttacctaagtcctacctaccttcaagacctggatgaaacatcacttcctccaaggagtcgttgacagacttaggccacagtgatcattgctgcttccaaacatctatggcatttgttgaccaagctatttatgttatactataaggaagcgttgacaaaaacgtggcagttttggtatctgggcaacattccgcaggggctaggattgtgtcatttattgtagtaaatccaatgtctcattcatttcctgtcacccagtaggccctcaggtttgttgccatggatgagttaacagatggcactgactcttggtggcactggagactgcagccatcagatgatgtttcaagagacactccactgtgatgacacatcctgaagacagggaaactaatgtcctttgagaagtacaaatgtctatttttatttcacgtagtattggcttgaaaagatacaaattcacttaggatgaaataaaagtgttctgtatttgaactttatttcaaattattatttcttggaggtttttattaggcaaccagttcctcctgtcttagaaagatgtagggacggagaagttctaaaaattctgggcctatccttcaaggttcaatctcatagtttcttcctcaggaaaacctcctctggccatcctagcagatagacatggcacttccatgtctgtccaattcccccaaaacatgacctaaggctcatctggaataagcaatcttcttctgtgtaaatattttataactatagcctattataaactatttgtttagaaaaaagactggaaaagtacacaccagaatgtagggtgtgtattttcccttcaaactcatttacctttgcagccctcttgaataatgtccttccaagccttttgaataacttttatgttgttgaatatttaaatcgtctccaatagtggtaatttttacagtctacaaacaacaaaaggtaattcaatgtcaagaacaattaataagatagatattcagagtggttgatatggtgagatgaggtttggtttccaaaaaatggttgttctaaaaggaaaccaatcatgtctatgtatgttatatgaatgttgagctctgtttggagttacccccatcatgaaggtgccctcaaccatagcagtgtcactaaaataaatgacaaggcaattttttggaaggtaatattgtctctgaattaaaaaaatggaaaatctttatgcctctctctctctctctctctccatccaatgacactaatgactacttcaggatgtctgaatattgtacttgcttatatatgttcactgcaaccaccatggcaatgaaacatgacaggtcctatagtggaaatcatggcgtggtcctccaaggttaaattggagggaaaccccaccatgaaatgcagtggctagatgctagatcttcactccactccccactcaccagcactgcttctggctttgggattgagcttccttctgggtgaagctcagaagagctcaaacttttctgagccaaggtcaagctgggaaccttgttacgctattttatttttaaatattcacttcccattatgtctgagtcttcagccacatcttgtttatctggtgaacgagtaaataacacacagtttctatgtcagtttcattcatcccatgttttattgagcacctgctgtaagccaggcattcacctggtgatcacttaaggcccatctccttgcttccagcttgcttccctataatagaggatttttttattctctttgagtatgagtgcacagcacacacacacacacacacacacctgttttgtattcaaactgagaatgctcatttatacacagctctcctcttaagcacacaaaaattaaggcatccaacaatcagataaggcaaatgcatttatcaagcatccagcgacaaaaagctcctagacgtctactacatgcagcactgctgttcgggtgctggggttatagcaggctacaagggaggcaggtctgcgttcatgccacctacattttaataagaggagaaaagaatagagaagcactgggcagctgctgaggagtgctaaggagaaaaatcaagggaggaacaaagagtgatgaggagtgttgatttcagaagtgagatcatggaaggtcgccctgttgaagggacatgtgaaagagaacctgaagaaaggtccagcaccatcaggatgtctccacgaaggtgacagtgtcttgtctaggtctgccttgccaccgagtcaccgactgtgagaattggaaggaatatcagcatccttcatttaacagttaggaaaataagaccaaaaagaggttacagtccaagttcagcttcacaaagacgtatctctagatagaagggaaaaaaaggagagcaagaaaatgttaaaagttgactatgcttagaaactgccaaaaatatttaacaaaatgtgccagaactagctgaaaaataagttcctgaatattcaatcaaatattctatatttaatttcatggtataagaatgcagtaatcgaataaatccttgctcttctcagcaaccacttacattgttttataaagttgatccacatcctatctttaggttgtagaaaaggatgctgggggagctgtcatcccagacccttaaatgtagttaatcccctggtaccaagcaaagctcagaatcttcaggacatctgcctctactaccttatgctagaccttagtatctagggagaatgacagcaacatcgtggtcatggttctgaggaaagcagtggaatgcacatcagaggaaaccaactaaacactcacctgtaatgagatgggaagtgattacactatttttcttcatggtatttatagttttaaggaacagctccctgtaagtgacatctacccactgccctttatcctcctattaaagcttttgtaacagatggtgtttatagaattggctactctgactgttagcactgtgaagacatgagtctatgaagaatgtaccccaattttcattacaccccagactaaagtgctaagtagtgatcttttgaatgaatggaatcccattgatagagagtcaattatgcctttgcattaacacacatcatcttttgttcattaactcagaaactagagtgagctggcagcctgagagccaaagagcttctgtgagactctcaagtgacttaacgtggctggccgatgactgattccttccaggtgaagcgctaagccccatcatgcccctgttcagctatggcagggttccaagtgggcagcccagctctcctctgggaggagcattgggcaccacttgagttgagtttgtccaggacctgagctgtattgttctgtgatgtgggacaatcttctcgagcagtatcaatgcttctgagtcacaagggtcaaaagagagttatttccctggggctacaactttctgagtttgcacaacttccagatgcagaattaatttcctgaggtcatctgcagcatggtgcagataggtcacttaccctgcaagcagtatggaaacctgatatctagaattgttgactattctgtgaaacttgtttctcatatcttatttcttcataatatcttgccccatcacatcttcaaggctttgtttgaccttatgggcactgagtaactttttccttttctgaatgcatttggcgtttactgttgaaatctatggcttctttagtgagtacttgccgagtgctcactgtgttcctttgaatggaggtagagtcctatgaaggataagtccttaaggcaggggctatttttatagtttagtatctatctttaacttcagtttggctggagaactaagatacattaaaagaaacttggcagtggggggtggctcacgcctataatcccagcattttgggagaccaaggcaagtggatcgcctgagctcaagagtttgagactagcctgggcaacatggtgagatgctgtctctattaaaaatataaaaattagctgggcatggtggtatgtgcctgttgtcccagctaatttggagggtgaggtggtaggattgcttgagcccggggagggggaggttacagtgagccaagatcgcaccactgcactccagcctgggtgacaaagtgagacccccatctcaaagaaagaaagaaagaaagaaaaaaaaaactcaagctcctcaaaggtggaaaatttatatataagatagctggaaaaataagactaagtaaatttgctttgtaatgtttacaataccgtatgtgtttagtgtctggatgaagaatgaataggttccgggcatgataatattttctttgagcacaaatatgttttatgattgtcagaaccagtgtggaaaattactaaagaaactaaatattcttttgcaaatgcacagtattttgacattttcatttcaaatcaagatgctggaataaggattcccccaaaacctgtaaaactcagcgcagatcccagcaatagatggggttgtgtgtccttgctagctcattgcggattgggggccagctgcactgaggatggccttagctccctgtctgctgagagcaggatgaaatcaatgactgactgatgtctcctaagtgcctgatatatggttgctgatgcagagaggttctggtgacagcccacactgagggatgcttatggagggcccaagtaggcgagagaatgcaccctgcgtatgtatgtggaagccaaggatccagctggcaagttggcaccagccaggctgagtacagaggttccagtctctacatcagaagagccgagtttcctgacctagagaagttattttggctttcaagttttcatctttaataagaagggtttggaataaaagaaggaatactgacaatagctgacgtttcctggatacttatgggtgccagctgctcttcttcgcgtattcatctgtgcaatccaaacagcactctatggctagaggccactgcgacctctcttttctaggcataaacctgagtccctggcccagggtcacagctggcaggctgggcactgacggactccaggctttaagtcacattgctacactgtactcagggtatctgccgcccgggcccagacccagagatccaccctaagggcgaggataaggagacagaggacaggcagatgacaaggtgggggcagttctcatgaagggtttccttcttggacactgatttcttcccaggatgcctgaggatgctgaccagctccttccatccctgtcctcctcacctctttccacatcccctgcagatcagcccagcagtgaggcacagcctagggtcggatgtcccatagatcatcatggaagctcagaagcaatccgttcttcattttagaggctcctctccgtcaagattctggaaacacaggagaacactgtgacctttctcagaggatgttttcctaacatgcctgggaggaagacttgaatggtggtgtgaaaatgtcttttcatgccctaatcaatagcccatcaattatgtatgtacttatgtatgtaaaccctgttaccatcctgtggagaggataggacttggtgatgtccaactattgagctctttcttcaaagtcttaaaggaagttcagtacataaaaccatggcagcgggttggctctggcagagtggagtcagtcagacatctggagcgctgtcctcactctgcctccccaccctcgggcatgcttgttggaactgacagctccactgctggcagtttataaatctttccagtgttttcattgagggttgtcaaaatgttaaggcatattaggccatcatggagcaaggtaacctccaaggcctttacctcttctaaataatgctttattctcttttcttctggtcatgaagatacagttggaaattcctacagattggctttgcttgaaaggctattgtagaccattaatgggcgaaatccctgtatttgaaattgtaagatgcaatgagggaaggcaatccacgtgatttccttgtgttcccctagtggagtgaaaacagatactgacgattgtttcctcattcctggtggcatcttgagatggtttggtaacatccaagctgtgcagatgttaccacggagcatggaggcttttctgaactcctacaggtttcattgtctgtgccactttttggtacttaccatttacgtatttgaactgtgtattgtttcacaggtgtgtgttttccaagttgccactctaccaaccctttttgtatattcctgagttcaaaaagcactttaaggaaacaaactgacaaaaacatgcagtttaagaggaggaaacaggaagatggctcacatgtagcttgagtgaacaatcacatttagcacagtgcaggctttcagtcttttcatgtcatgcgtatttttgtatcctacggacaatgagccttgactgcttttttaggcctcttaccagcttcctcctctgaagtgtagtaagtagcttcctatataatataatttgtagatgactaaaagcaaggcctgatcccacatatctcttttatagacctgctacattgccagaaaggtcttcattgctcaaccttacacccctcaaggataaaagctttctcaaccacaagaattcctgcagaatttggctatgtctcattcattattgtacggggtcagtcgctggcccaatatctaggctatagtaggtatctctaaactattgggaaacctgtagtcatttggtggcttatttttcagtgagtgcagataggagatggaatatgggtggatctagatggatagagttggatcacaaagtgaaaaccatcacttggtgggaccatgttggggaggatcctgaggatgctgaggtcagtccatgacgtctgtgacaggcacatgagggaggggccatgtcatatgtgtctcaatttgccatctctgcttagagcctgagtgactgcttgagaaggtaggcccaagcccagaggacagagcatatgagggtggatttgactgagagagttggtaacacactttctaagtgagaaatacggatgacaggaacaccctgcctctgcccgtggcccagctctgcttgagtctgtcactgtctcctttcctggaaatgtcagtgtcgcttccctcatgcgttttggagccttgagttcaggctaaaacagggccttttgaggggaggagaaaaaaggaaagagggcaaaaggatgaagtgtgatttcttaaacaggtttttaagaaaggagaaaagggccttgcttaattttgagacttccaaaaggttaggctacatgtaaagggaaaggtgaggttgatgctggttttacaagaactgctttgctcagttctacttggttcttatcaacgtcggtgacccgcagaactccttacgaagcagtctagtggctacaggatagcatccaaagtgactgcttagagtttatgaatcttcactaatgtgtgtgtcccagataacaggatggaaggaaaaaaaatgaaacctgtgtagacactgagtatgttagtttggaacagtgaggaaagctttaagagagaaatcagtattatatcagtttagccaggctcacaatcaatagtcatttgataaaagctgagcgtgtgtgacactctcctaacacagagtcctgtgattctttggggatgtctttgctggtgtatcagatagctattgctatgcaagcaccccaagacttagtgggcttaagacagcatcatgttatgaaaatcatgcattttcatctttaataagaagggtttggaataaaagaaggaatactgactattccttctgaatattggatgatctggggtgtgcctcactgtgtgtcagctcactggcttgcttgcttctgcctgggaagtggccttgccaggggcatcttttctgagcagggctgctccatgcatctctccttctctgcctcctgggactgggaggcatggtccttgcatggccatgacaagcgcatgcaagctctcctgagacttaagctcagaacaggccctggaacttccccctcatttctgtggctccaaggaagccccatggccaaagaatggggaaataggctctatcccttttgcagaagtaactgcaatgtacacagactgtaagtaaagggaaccatgaagaattgaggccgttagtgcaattaacatgcttagattactcttaagctcttattgttgctattagtgatctctctggaccctggaaatgtccagcaaggctttaggatggtagctgtagtagaagcatgagtggatagtcatgacctgcttttatcctcactgtcaatgtttttctttccatacattgttgaggttaagtttgctgaatggtaaagaagtataatttttgaaattgttttctgtcgtcagttagtaaatcaatcaacatttactgcacagctactggaggagcagcacctgctacttcctgggttcatggagccataggggtgaggagggtgacatttactgagtaatcacttcgtgtcaggaactgtgccaagaacctcgtaaactccagattaattgagatagacattttggtggggagatatctatgcattgttttattgttagatcaggcataatatatccaaagtgtaaagtctttggaaactctcgatgaaggaaagggattcagtttccaaggtgtgggctagaatgcagaaaataaaaatgtgtaagtgaaggttttctgtggctttggtaatggctgtgtttttgatatatagtaaacaatgataaatcgttgttcttttaactctgaattttttttaaaagaatgtcactgtgcacggtttgaagctgcaaagattgccttcgagagggaggagtcatttctccacgtccctataacattatgtggaatgttgtctgtcagctttggactgtagtttatatgtcagtgactgtagtttatatggagtattttgtttaacttttcatttgttcccaatgttacaattttgctttctcatagatatgcatatggaaccaatgcactaataaggttcatttctcctaatatatgctgtctgtacatttgtcgcctataatagttgttaatggttttaaagagggtcatgatagtccgttatgtcaaaagatgccattgccttctgtctttttctgtgcattcctggttttgaaaatgagggtacaatcagacctgaaaaaaaaaagcatatgactttgtttcatgacctacaaaaagtaatggtaagcaagatgcaaattcttattctccaagggtatatacactgtcaaacaattgaaagaagccaagactatctgaaaaggcctatttttcagatttcatcttggagacctttcatcatagttcctaccccaagaaaataactaatttgctctagccttatggaatagcctggaatggctgcctgggccatctgagaagttggctggtcctatccagggcttccccagttggcctggctttgctcaggggccgggggctgaactttagcaggttccactagtgctgttgggagctccacagagaaaggtcgaacgcttggtggtttgtccttgtggtcagaccccgggatttgacttttaagaatactctgaaaatgaaaatggatttcctgggaaggaagtatgtgaagtcattaacattaattaatagcttatcgaaaaattaggctttcaggctggaagaaagtaggcaggcctgaagaagggagctcaggaaggagagctggagggaccacagcagggagctggcccagaggcaggtgacgtcgcccaggaggctggacctcggggattgtggttctgtcaagaaaggatggttgctggtgggggctggggggctgtgggggctgggggtgctggagcagggaggtgtgacccaccccagggaataggaggagagaagtgggtagggttttcttggactctcacttcaccttccggttggacgagctgcaagcatgagcttctaagctttgcatcccagagtgttggcggctatggagatcctgcgggcctcactgccgccattccccatggccactcagccagcactacctaggcactgagctccgtgagggacttttttcctgctcaccttatctcaatggggtcaggcgggctgaagcttctggagtcttggtgaggctgttgctggattgaatatgagcagctgcagggctggaggaacccaaatctcagtggagcctgttcattgaagaccttactgataggttagtgccaaggggtgctgacaggtacagttatggggaactggcacatacgaggtagcagcatctgccctgaccttggccctataatcatccgtggcattgttgagaacagataaacagtaaccaacagtgggctcacatcacagatgttttcccttggtgcttggtgggccccaagatgttggggttcaaggtttttattatgtctagggagggccagaatcagtcctatctgctcgcattgagatggcctttgttcaagcaagaggtgaaattaagtgtccagaggcagaaatagatttcactctgggttctgttatccatggttctttgtagattctttctgaatgtccacaggtgtgctcaactgctaaattcagctgcctttgaaatcacaaaaagggctcaacaagtggaggtctcttccaccagcaaagcaaaggattgtgtaattcgatcactagggtaggctctgaggctgcgtggcccgagttgaaagctgagctctgcacggacagctggtgggtctctgcctaagttattttacctatctgtgctctgcttcctctcctcaccagaaaaccgaggctatggttgtatttgcatcataaggttaccaagaaaatgcaataagctaatgtacagggagcacttaaaagactatctgcacgcaggaagccctcgataactaattgtttgctgtaattattaatggtcaccccacatataggtgaggaaatcttgaattgccctggttggtgctgctgggtatttggctcaggtaagagtggtatagcagcttggctttttttagatgagaagctacctccccctgaaagggggctgagtttttgtctcctacagctgctcccctgagaagatattcagctcttcccaaactactggttgtttagaaggtggctgtgtacagagcctggtcatgctatgggtcacagagacacagggccactgcctgcacccacctggacagcacccttctgtgtgacttccatggggaggactgtgagtggtgccccagtgttgggatagggaccagatgactgcagaggaaacaccattaacatttgtctattcagcaaacactttactctcacatgaatgtcgatgtatctttgggcttcttataaaagaatcccacattcactcaacgtctgtgagtatagacattgttatttgttcctttcactttttaaagtgaattaatttgtacaatagtggttttcaaagtttgttgttcttgaaaaatcaccgatcaagcattaaaaatgcacacactggggtctcacccctgagaagctgctctgcttggtcattcaggaaaactcaggtacctacattttaaaaaaaattctcagatgagctgccaggcaaaatcacctctaattgcttctcttgttttagttctcccaacaacctgtaagagaaaattggacagatattcctgtccccattttagatgaggccgcaagtacttagagtgaaaatttgtttgaggtcacataattagttaacatattattccagataatcacagatttcttttttagacaacgctccctacatctcaatagcttaaccaaagaatgtgtcagagggccatctttttgcatctctgggttctgcagggcctgctgcaggaattggtgtccacagggggttctggagccaattctccacagatagtgaggtagttctcctgtggtcacacacctcgggatccttcacagccaggtgtgtgggcagacgagagagtgtggtcatgctacagatagcctggcattgacgttcatcactttagcccgtattccgttggcctgaactgaggcataccatgccgtgaggctcagcgagatgcaacggagtgtgggcagtgtcctcccggatgttcagaagaaaaggaccctgctgaacacatgcagtagtttccaccactattaatgaccgtaaggcaatgaatctaaatagtgaaaatctttgcatgaaacctatgcttttactgacattgtattgttgcaacaatccagggatgtagttatgtatctccctattgtttaaggatgataaaacagattcagagaatttaagtgacttgcaaaagtccacacccctgagaaacaagagagccagagaacccgtgggcagctctcagctctggcgccagggctgtgtggttgggacatacccattgaccttggaggcagaacaaagctggtatcaaaactcagatttcttgactgccatttcagtgtactttttccactacaagatatttcttactgttttgagcatgctgtattaccacagggactagcgacataggtttaagcaagtcttcagtgactgaaggagaaaaacatgtagtaaatattgcttaaatcttttctcattaccacatagaaacacatttctatgtagaagtagaagacatttctacttacctatcctgagaaccttctctctgaaaagctcacagcagagtccatctctcccgcttggcagctgcaataagtacagtaattaggaatattatttcttttctttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgccactacgcccggctaattttttttttgtatttttagtagagacggggtttcaccgtgttagccaggatggtctcgatctcctgacctcgtgatccgcccgcctcggcctcccaaagtgctgggattacaggcgtgagccaccgcgcccggccaggaatattatttctaactcacaagagttcttctgcatgttagccaccccccagagaaaatagtctccattgttgttctctcttcagcatatcccaggtatgtttccaagcaagttttgctccactataagttgatgaggacctttttttttggaagctgatggcctggcaagagttagtcttaataggttgtgtttcttctcactttagctggctctccctaatgataatgtctgttcaagttgagcccagtttcagccagtttctctgggagtcaaaagcctgtagcacacccagagagccaccacctgtccacagcatatggtctgaaggcatctctgctgctctagcctgaccagccagcccaggatttccaactgtgagctcaccctccttgtaaggcaaacagggtttagccagcgctcaccttgacctggtgacctttgaagattgaggttgcaggagaatgcaattgagaatgcagcgggtttccagaccccatgtgagccatccctgatgcttcaccctggctccatgggaaggaacccagagccctgcctggctggtctcctgctaatgagatggaaagcaggggtcctggccacaccatgaaactcatgatgttctccactcttgtgtccctgccatggctcacattcagtaattagataccagctcattaattcctgctattctttcagaagggaaaggatggtgccctttgttctgctctgctgggccctgagccctcacagcatgaagtagctagattctgcctcactccagaggcggctgccactttctcaccccacagtcagcccctcaaccatgaaaagatgtaaggatgtagctaaattacataacccaagcatgaaagcacctgacgtgtatgaaaccatgttctcagacacttgtaggcagtgacaactttataattaggcatttcatccaacttatgtatcttacatagggaaattgacatcttagcaaaatttatttgcctaaagtcgcataggtaattaaaagtagatacagctgagactagttgctataatgcccagctaggagggagtcggtggaagaggtgtcatctattttcctttgaaggtttgtaagtatttgacttttcctgccctgagactgacttgcctctgaggaggcccatccgacttagcttgaacaacccggattcttgtctttagtcaaaagcctctaaataaagaatacaaatcagcttaacttctccaaggtctggcaaagctttatacacctttcagaaacagaacacagcaaatctgcctcagcaaacatgtgcatacgactttcatctgagctatcaggaaggcatcttatagacacatacaacggaagcccagagggctctggcatgttgcaaaatcaaacagtccagaaaactttccaccccagaccactattcagttgtcatctgaaataatggaagtcagagtcaaactcatcaattaaacgagaattatttatttatcataatctctactgcctgctgcttcaaatgctttctcatgaattaatgagctcatctacgtgcatgtcaatattttgttttaaactacaaaataaaacacaggattaggttttgttctcagtgtctacctttctgtggcattgatgcagatagcaactaaggattaaatcacagaatggttccctttttaatttatttatagaaatgggcttttgcttttattagtgatgaatgaagagagcttgacttggggaaatttagactgagattattgaagtggcctagagtttggaaatttttataaaacccaactgtgcaagtggattgaaattgtgcttaagaacaggctttcatgccagacttgtgccgaattccatttggttcctggcagaaaacccttgaagaatggtatttggttttgtttatttggcatttcaaatactggttcatctggcccccatcctgatcaaaaatagtcagaagtagaaatgggtacttgagtggcagcagagtggattcatctgggcatggcagcacctagcgtaggtctccaatatgccattgagaatgttgttgagtgcaggataacctttaacataatacccctatccctctcctgtttccttgctggttgatcatctgccctgggccacaaatagctctccctctccactctcccaaggaagaaagtcctgacaaattactcccttaacccagctctgttcctgaaggcttgcatattccatcacagaacttcctcttgggatggagagtaatgttgggacagatgactgtcctactttctagcaatgaaaaatgattgcatgaagcctcacattcctgatgctaatgagaatctgtcctttcagctggcgtttgcatcaggagatgccactgcttgatttgtaatgttttgcactaacactctgagtgaaccctgtctttgggccgttccattgcacaataggcagttgaaatctatgcttttctcaatagggagtacaaaaaattcatcattttaaagtgggctgtcagatctaagaaataaatctcagttcataaacttgaaaaactcagaagtgttaaaaattttattcactaagaacataacatccaagacgagagatcaattttgcatattattatttctacctgaagtattccatctcacttaaaagaaatatttgtttggaagcattggttggtgctggtagccaaggctgtccaacaaaaaaagcgagtttttaaagaaaatgttattccctaagggtgaatcttaaaaaattgccaaatgtattcttgagatgaataacaggaagcttagttctagaaagggcctgagtgattatcgaatccattcttcatttcacagacgagaaaatgagtttcagagatgcaaacattcctactatcacagaactagtaagctggagaacagacattaagacctgtaatagtgattcccgtgtgaatgtttttatgatgaaactgtacaaaatgatagaacaataacaatgtcaaaacacctatcactaagcactttcatatgtaatatctttttttaattataacaaaatggcaaagtaggtgttatctccatttcacaaatggtacaactgaggctcagaaacattaagcaactgtcctggggtcacaaagaagacactattagagccaggtttagtccacatattcaatttctttgtttatttccttcactttgcatgagaattcctttttgctgtctttcatttttaagcagaaacctttctttaaagacactaatgatcaaagatctaaattaaaaactaaaactattaaatttctagaggaaatcatagccctacatctaatatataatagaaccagatggaaattctagaaaattctgaaaagtacaatatctgaaaaggaagacaatacttagcttggattaggcaatttgtttcttagatgtgacaccaaatgcacaaagaacaaagggaaaacaagataaattgggcatttttgaaattaaaaacttttgtgcatcaaacaccattaaggaaatgaaaagacaattcatagaatgggagaacacttttgcaaattgaatatctgacaagagacttgtatctggaatctattaagaatgctatataattcaataacaaactgacaagtaaccctattgaaaatgggagtaccaagtataccttttcatttaaatcattgaacagttcacaatggctgttgtaaagtttttgccttgttactgaaaccatcatctcttggtctatttctatggagttattttttcctagttattggcagtttgcttatcttttatgtgtctaataacttttaattgaatgtagaacattatggatcttatatttttgagaatctgaatgtttaaaattcctttgaagagtttgtgttttcttctggaggcagtttacttactggctgtgagctcagtcctgttgaggctgtttcacgacaggctgtggctttgtcagggtgggtgtggatcagacatctggtcatcaaccctgcatattccagcctctttcacaggctcactcgctgatttctgtttctcccacattaaggccactgctctctgatagtctctgcctctcccaggctggaaaacagccttaagcagagagcccttgcaagtgaggagccccctcatgcttcccccttcacctccagggtcatagtcctgtagcgtatgtaatccccttcctaaaaacacttgctttatatatttccctagttgtgtaattgtttatagtgagagaggaagcctggttactcatgactctattatgagaagaaccacaaatctctcctacttcattttaatcattcgatgttagatgtatttaaccactttgttgccatgtttaaatttttatggggagaagcccaaggtaaataataaaattaacaaaacttttagtccagtgtgtattcctcagagaaacctcaggtttcttttcttttttttttttttttaacaaattcaggtctttgttctagaagttaaaaaaaaacaacatacaaccaaatatagttaaaacaggaaaatctatttgtgtttacttcatatctttctgttgggtcagatgataatgtttagaaaaatactgtaacattcttactttatgtggacaaacctttagaggctggcctctctgtagaaggattgcacagggaaataattttgagcctactttcttgtctttatcttctatgttctcttctcagcttcctgtcttgattggcatggaacttgctctgctcctcatgtttctatttgtttaggaaattcactaggagtgtacaagggacagattgtcagctgtcatccaagtccctttcaaataaccccactatcctttgccttaggaagtctgagcctccatcagatcccggtcacattgtgagggaggagtgaccagccaccgagggccacctcctgctcttctttcctctctcccctttgcccttgaggtgccctcaactcccaggctctctaatcatgctcttcccagcccaggattgccctggccagtgcagctcttccttaggttctagaaccactacctaatacctaattccaatagggtccttttgactgaagctgacttaatgtgtttgagaaagcagggctaaaataaaaagaccctaatgtagcagaggccttgataaattctaccgaagtgatgagaactgtgggaatttctgactgagcccaaaagttattagaggcaagaatacttctctctccagtaaatgcctccccacctccacccccatttatagaaactttcaaatttatactagcataaggccaaccttatctgtgaccatgaataagctatttcactacctcgttgttctggtcaaaataatgcatggggctgggctcatgcctgtaatcccagcactttgggaggctgaggcaggtggatcacttgaggtcaggagttcgagaccaacctgcccaacatggtgaaaccccagctctactaaaaatacaaaaattaaccatgtgtggtggcacacgcgtgtagtcccagctacttgggaggctgaggcacgagaatcgcttattgcttgaacctgggagacggaggttgtagtgagccgagattttgccactgcactcgagcctgggtgacagagtgagactctgtgtcaaaaaaaaagaagaaagaaaaaagaaaaaaaaatcatgggctagctactctgcttgtattttttgtttctgtccatcctcttacttgatacccctccacgttctaaaaacaaagcctcccttcacattttgagtgtgtctgctatggataatgaggcagcaatcctggttctaaagaattgtgataaagcagtcactaaggatcccattaaaggtcaaaccatctaattcttaatctcacggcacctgcttgataatgatggatacttattaaactcattccttctgggtctcagaataccctttagaatgatccaatttttcattcaggcacttgaagttcattaaatgaatgctggagaaactgttttctcattgacgtacttgctttaatgaaatgagaaagtaagaagtgcctgaatattggtggtggttctcaaacccaaggaaatctaggggtttgtggagatccagaatctcctctctcctcaccacttttatggcctttatctaattttacttttcagccacgtttgatgtagctgacttccatctcgaaacactctcttctgattttccctttgattgcactatccactcctttttccatgtcctcgaccggttctgtcttcccgcgtgacctctcagcattgaagtcttatctgcctgccctcttctggatgcattgtattcctggatgagcttctcaatgccctagtctcatatactggccatatgatgaggattcctggttttacatgtcaagccttgtctccgtaagtgaactgcaaactcagttttcaaagtgcccatctgaccactccactctgatgtctaacatgtgctcgcttacatgtggccagaagagagctcctcatccccatggccatcgctcctccaccagtgttccatctcagtaaatggcaccaccaccaacccaggtgctcaagccacaagccctggagttgtcgttcgttcactttccatttcacctcatctaaccattcagcaagcctcatcgatcccatctccaaaatatacccctaatccatgcagtacacccacctccccactggggctgcaccagtccagccccagccactgttgtctctcactggaatctctgaagtcactcccaagaggtccctgcttccactccccctcccacacccattctccctaagacagccacagggatcctgttgaaacaagtcagatccatcaccccctggagtacctggcctcctttgcacatctcagaccgaagctccttactgacctctaatggtgtgcacgccctgttcctcggcccttataagaccccttttccctgcacactccatgctctggccatatcggcccacgttctattcctcgaatatatcacattccttctgcatcagtgcctttgctcctctgccccgaaggctctctcatagatcttcccgccattcaagtcagccccatgatacctccgcagtgacgcattccttgaccactctacctaaaatctctctccccccgccacacaatctctttgtcttgttttatcttcttctcaacacgtatcactatcaagacattgaacaaggaaatactgacggattttcatttcagtttcccccttagagaaggacattgtctattgttttttgctatatctgcaatgtgcttggtagttaggaagcattatataacaattttaaaaatggaaacattcagtttttaaagtaggtttattttttttttttttcagagaagccaagtaactggtatgcgtagtaataaaacatctcaataaagaattacaagacttgaggatctgggcatggtggctcacacatgtaatcccagcactttgtgaggctgaggtgggaggattgcttgagcccaggaattcgagaccagcttgggaaacatagcaagaccccaagtctacaaaggtttttggaaaaaaattagctgggtgtgcagatatatcttcaacatactgatttgctctattttggatatatacccagctgagagattgatcatttggtagttttagattttgggggaactttcatactgttttccacactggctgtactaatttaattcccaccaacagtgcacaagtgtttccctttctacacatcctctccaataaaagccacttcattttgagccattagtgaactgagagaaaacagcactatggagggagaaagtggattgtttccaagaagtaggtgggcaaggagcaatgaaggaaagataataccaaggcaaatacctggaggatgttaagccaagagcatcagaggagaaaaggaatcatcaagaggttggttagtgggtacaaacgtgcagttagaaggaataagtaatagtgttccacagcacagtagggtgactatagttaacaatatatgttttttttgagacagggtctcactctgtcacctaggtgggagtgaagtggtgcaatcatgtctcactgcagcctcaacctcctaaacacaagtgttcctcttgcctcagcctcccgagtaactgggaccacagcatgtgcccaccaagcccagctaattttttgagtttttgtagagatggggtttcactgtgttgccctggctgagcttgaactcctgggttctaagtgattgtccctcctcgacctcccaaagtgctgggattacagatgggattacagactgagccaccgtgcccagtcaacaataatttattgtatatttcaaaatatctagaggaggctgggcatggtggctcacacttataatcccagcactttgggaggctgaggattgtttgaggtcaggagtttgagaccagcctggacaacatagtacgggcctgtctctacaaaaaaagaaaattcaaaaacttagttgggcatggtggtatgtgcctgtagtcccagctactcaggaggctgaggcatgaagattgcttgagcccggaattttaaggttgcagtgagctatgatggcaccactgcactccagcctgggtgacagagtgagcccttgtcctaaaaaaaataaaaaaaaaataaaaaaataaaaaaaaaaaaaagaaaaatataaagaaagaattagaatacttgaaacctagccaaaaccttatccttacttagggtgatcctgtgcttccatttgctaatccatagatactcctaatatcttccttctcttcttcataagtgaggagataagatgaaataaggaattcgtaaatacaaagagagtcataaagcatcacataaatgttatgtttattttatattgaaatgtccacctgaaaaactttctctggcagagtgcagggccagatgaaattcacatgaaggaggaacacctgatctgtatggccctgtcattattatgcatacccatggaaccagctgggcactcagggttatatgtggtagccacagcagggtgatttgcaacccccactcctatatccatcaagacaaggccaccacgaggccccctatcctgctgtagatgacctgaaatacgctgtccccttagaggttgctttctttggaattgatcatgaacatctgtttggtttattgcagaacccacagaggccaacacagtgcctggcacattctaattgctcaatgatcttgagatcaataagggggtgaaaaatggctgctggtgtaaaaagcaggagaaaggcactgaaaggggatgagagtggacaccggagaccattttttgcccatttgttagtatttcatccactctgcaactagtctcccagtcattcctttatttttcccctgtatgagttgaagacgactctttgtggagtctaggaacaggcaagtgtccctatatatggaaaggaaggaacagttcacaagctttctaagctcacaacccagcttgtctgggcttttcaatagagtggttgccatgacattacataggagagcctttcaggcagttcccattgctaagggcaaagggtgactgtgatattaaaagaagcatttgttgctctttatactcagaggaaatcaaggtgaacttgaactcattaaaagcaaggctgagcacatttgcatgagcagaatgtaaatacaggaggcttcttgcagatgagcttctctcttgcagaagaagagacccagggcctcctgagcctgtttgttcttaattaagagagatccttttgggatgagagtgagtttgtaatggcatttctaccacaatgtacaacttctcaaatatctccttcccccatatcttcaaagttttaagtacagcccttagtgcaagtttgtaggggaaatatggaaaaatgcaaaacaaatacaataaacagagaaaacaatttaaaatgattctacacacaaatgaataatttaaacctccatcatgtttgctatctgtgatgcatctatttaatattaataacttgtgaagaaaaatgactgtcaccatttttaacaagcctagtctattctggctacaaaccttagatgactgactattcctaacagggccctgcttattaagagtctgttatcttctttaaatttaatttcatgaataatgaaatgtttataagaggaaaacaaatatcctgtctaaagccagcctctccttactcccttccacctctgtcaaatatttatctgcctctaccttcttcctttttcttttcttttctcttttctctcttctctttctatttcttctttctttctcccttccttcccttttttctttatctatctatttcttcctctctctcttccttccctccttccctcccttcctccctccctatctctctatccctctccctttctttcttttcttagttttcaacaccaggctccatatttaatgcacacagtgtaactagcttcaatagctgatcattctttctccagagatgtcttattacgaagcaaggagcacatacaaagcagttgtattgcttttcaaattccctcttcagtgaacatagtcattaaagaattgtatcaagaagaaacacttttataatgtggctgtccccaaattctaaagatggtgttattattgatttagtaatagcttacaaatcatgacccaaaattagttcttctgcacttatgccccaacctttgtaaaatctttattgaacaaccatggccagtaaccataacagataatgttctattaagtgcagtttttccatgggtcatataaagtctttttcttggagctcatataagagtccatggaaccttcattcactttggtgtctgcagggaactcttttcctgtggagtctgagtgatcacgtggaatctcaccccatgctgcccacagaactgtccatctaggtgtctcttgctgaccagactctgggtgtacagcagagctgacagcccaggtttcaaataaaactttccagaatttcacacacacacaaacacacacacacacacactcatacagcagctctgctgtctaagatgtcaagatgtcgttttgggttttatttgtttacattctgaattctgtgtccatgtgttttaaattttcctctagataaaagcgtgatagagcatctctgtggggaattgctgtgaagaagtcccactgtgggatgtggtgcagggtgaagatgcagatgagagaaggaaggagaaagctcagggagagggaagtagaaagaaggggaagaataaacggttggagaagctgcctgatgactttgagcttttgtagatcagcggatccaaacctcttgttgtgcaggaagtgttagagaacattaaaagattagcctagagtctcaggtagttcaagagtcagagttgggaccaggtcttctggttctgatccagagctttttctcctacttagctgtcattcccatgccattcatgtcatgttttaagcagttcagcaagcattcttgccgtgctgacttgtctctagcatgatgttcaagctctgaaaattgcaagtgaatttaaatagcctctgacctcagtgagctcaaattctcactgtggagatgacctccagccccaaaacagatcagagacctgctatgtaacacatggggcaagtgcaagagtgaaaggaggaggatttggggatctagaaaggtctggggcaaagcggcaagagaaacatgaggcatttaggggtgaacttggtggaagggggaaggcagagctgggaaaagggcaagactccttggtgaccaaatgggtagacatgtgacaaatcactgcccccattgtggaggatacaatgtggaaagagctgtgagcctctccccaggaagctgtggtccacatggatgatgatggggagatgtgggaaacgccaggcagagaggaagagagctgccggggaatagcatcattccaccaacggaggaccacagggcttggtgtaacacccacatgcagagggtaagacgaggacccatcccatcatcagcggtgccaacgcttacattgcagcaccttaccactcagagtgaggcttcagcactctgcgaacgtttgctgctgttattcattgatcacccatgcacctcacaacagccgtgcgagactgattgggctgtcaccactttctccatttagtggacgaggacaggaagtcacaaaatgggcctgagatcttagagtttgccaagtcctgcagccatatgtaagtttccctgatgccggtactcaggggtgctgtgctacttcagtgtctgctcctcccagagtgctgtagcccaggagaagaggcctttgtgccatgctttttacagcagcacctccagaagtcacgtaagagacctggcacttccagaatcctttccagcctacaaccattttcacataaaaatgggaaaaatggaggcagaggaaaccatatatcccaaacgagggccagttatcccctgtgtatgtggggctgaaggctcatgatgcagtgaaggaccaccatttccctccttccagtgtattaagaagacatctgggtgttccagttccatcagctcactcatccttcagtagagacaagtgagcttggcacgtggatatgtgaagtgctgtgtgcattcagcctcagtctcctatggtgtcccagctcctggactctaagcctccctgtttcatttatcaaagagattggatgacacccacctatgttggtgagaatggatcttcttcatctacccattcaaatgctcatcttttctagaaacaccctcatggacacaatccagaaataatgtcctaccagctatctgggcatcccattggccggtcaagttgatatccagaattcgctatctcagctgttaaggccaactcagatctaaggggaggagaattcaactccccctctcaatgggaggaatcctagaactgctagagtttcctgccaaccaacattcttaccaagtaaaataaaacaagaataaactttacattcggctacagaaggtgatggaagaggtagagcaagaggatctacaaagatgctaatttcatttataattattttgtgatggaaaaagtaataaattattatgagttgtcaccagactctttcttaaccagagaattctctttctttggaaaaatattttgaaaagctgcttgaccatggcaagtgagacattgaggacccaagcaacagatagatggtttatggcatgctgagtggagagtaggggacacttgcatttgcctttgggagggaaggagagaggaagaaatagaaaaaaaaggggaagaaactggagaatgtgaaagatgtgaagcatcatgggaaagtagaggccgggaaaaacatcctagtgataaaggtagaagaaaagagttttaggcaatgcctaatatgtgattgaaagatgcatgtcccccttcctgccatggatgctcccccctgaaattttaaggcaaattttatagactaacggttgccctgtgcaagtgttgtcttgtgtgtatgtgtggagtgtgaagttggggttgcagctgaattgcacctccagttcatcatgacttcgtatctcattgcatagtctggaaaaaggacaggcatagacaaaggaactcaccagcagaggtggccagaagaagaaatctttcctggcaattgaaagaaatcttagtgcagattgtggtcttgcactaggatgagacagaggttggagcttgtcttcctcagacatcaaagagcggggagaacccaactgccaactggtttgcatgtggcttgtggtttgacagctgactctttcttaacttctaatccaagggtcagtacaaagccaattccccttctcctccaggaggaagaaccttctacagcctgaggtacccagtacttgtcctgagtgtaagctaggatgacctctggatccatcatgctatatttagtctctgtttcacctaacactcaggattccatgaatgtacctttagtgagtccaggacaccttgtgaagattgcacgaaccctgcctgggaagtgacaaaggtgcagacttacccttggcatcttttgtacctttaaccacagagttcacatggagttgtgaccccagctcatgtaacctaatgcaaggtgaataatacctcctacagcaggctctggaaatgtttcttgtctgcacacacacacacacacacacacacacacacacacacacacacttcttaagtctgcattccccaaataataataaggggcatgttgctctataacaatcagcatcacgaaagcctacaggactttgccattcggtttaatggaattggtatatttgaaatactgcctttggaatttttttttgacagagtttcactcttgttgcccaggctggagtccaatggtacgatctcagctcattgcaacctccgcctcctgggttcaagtgattctcctgcctcagcctcccaagtagctggaattacaggtgcctaccaccatgctcggctaattttttgtattttaatacagacagggtttcaccatgttggccaggctggtctcgaactcctgatctcaggtgattcgctcgccttggcctcccaaagtgctgggattacaggtgtgaaccactgcctctggtctgcctttagatattttacataacagattgtattacaaagacctacacgcctccaaaaatactttggaatgttttaattatgcaaaaattgagaaaatagttaggaaagatgcatctgtctctgttaagaataaattcaattattagaatttaggggtgcccaacagcttacctgcagcaagattaggttgagttctactaccttcaaatgcttacctatgacctttgaagttctgattattctgggagcttctggtgctacatccactcaatctgccaggagaggaatttatcctacaggctgcataatttccttctcagctgtaaaatatctctttataagaggtgtgggcgagaaggaattatgggagcaaatacagtatttatcacttgaattaaacgactaaacctggcaaatagttcagctatcgatccacaaatagtatcaatccacaaattagcagcctgattcagataatctgatcagtagatatagttatatgtgagcatcataagcatcaaagccacttttatgtgtattatttttcttgtcacccacaaatcatgttgcaaagattgatagtaattgaataaattgccatgtgtacttaaagactgggcttgttggagacacaacacatttattagatgatcagttttttttttcctgttatgtcaatgctcactggaacacttcttttcaaatgtaggaaaaccaagctaactagatctagaaaaacaagcagaggtttcaagggatgcctttgaaaggtggtgtggtatcagggagcacgttgaattggaagtcagatgtccatgtgtggattcctttcatggcactccctgattgagacaatctgtaaaatccctttaacgtgcgtatgttatgattgcataatgtaattcttgtttagggtttattgtgtgactctttgctaagtaactgtactgtcataaatggagtccgagcagcggggcttgtctccccgtgagtgtgagatctgcatgctgccacctttctcctcctacttttctcgccaggtaccacagtctgtgtaagatgcaccaggctgatattttgtaaaatcaaggtcttcaccttccatttatgtggcacgagctggaatttgccagggtcaaatagtcaaccaggagttctttatggattcagccacatgggagaacttgagggaccttgcatgtcttatattctccaaaactccatccccacaggcttgccagtgtccaaaaggcctgatttttgggggaggaggcagctctaaaatagtgtcaattctagaactccttttttaaatgtcccaggaggagtaactattggcatcatcagtatttaaaactttgggctaattacatcacctgattatttccctcctttgtgctttctagagggatataaaccaatgagagtcttgagaggtggagtcagttcagctcagaagacactatcttgagggaaaaggccatgatgagtgggtttgtatgttgaattggaaagaggagaagggagatgaagagaaatagggtagggggagtactgagaggaaggatctgaagggtgatagagagaatgctgcctttggttaaaatttcaccagtgtagactgtgtttatgtagcttagtcagaatctcccttcatcctgtagtgctatgtttttgtttatttatgcaatactcttcctgtcaactatcacaattaagaatccctagtgtagcacagttatgaatgtggctgacctttcttaaaataatgtcctcgagctctgtagcactttaaacatttcaactcttttgcatatttggtttttcataatgtaggttgtaacacgatagaaggttagggaattaattgagtgggccatgatcagcttaagaaaataaaatgcaatagaaatatacctagtgcataataactagtagaatgaactaatatgaaactttgtccattatctatgtatgtagtatgtgtttactgtattgctatataaaatatatttctcatagtagattgcagtcacaaaagtttgaaagcctttgaaccccctttgaccatggaaaggaagagggattctgtacaggaaatggttaactcagcaggcctgggttgctcaaaccgtgcacattctcagaaagacctgctttgggactggcccttggatggtcctgggaaattagccaccaacctttggaatagtgtgcccaataagaatttttttggatgccttaggcttcagcccacatgaaaccagtttgatgactttatcctaacaatgtaatttatgtatggtgaatgcctgcttttgctttggggtggtgtgaggatctgaggtcaggtacgcaggtgccacatgcctgcatgactaacccccagtaagaaccctggacgccaagccatgggtgagcgtccgtggttggtaacatggtttctgggaaaattaatagagcccgtgagactccactagcaaagaacacctggaagctttcacctggtttctcctggactctgccccatgtaccttttattttattctgatttgaactcatatccttttgctgtaatatatcagaacagtacatctaattcagaaaagtaagcttttctgagtcctgtgaatcctagtgaatcatcaagctttagagtagtctcagggaacctggcgcagatgcagagattagacttgagacctagagaagttaagggctttctagaacatgtagctcaagcctgggcctggagtgtgatgaggtcatggacattaagctggaatgaaggtctgtaccaactcagtccttttctggtgaggcagcatggaaagacattggccttttctccatctgtgatgacagtgatccctggacgtgacttcttcaagtgtccttagtgagtttaactgggtaagagcaaaagaaatgaaatattttattcctttctcagtcccccatcaaggacatcaatagcataaaactgctataaaataacaaagcttattataaactttgcctccaaaagtggttctagcctttctgtaatctttcatatgagcttgttgttctgttgatcaatgaattcggtaatattctatttttaaaattattttaattatgatataaacaaatgagatacctcttcagagtccacatgaatggaaatgaatataaaatcagaatccaacacataaaaagaaagttcagcaaatgcaggactccagtctccactgcttcacagtagggtttgtccttgtgttttcttgttttgtttgggaaaataatgcaaaagagatttgttgtaaaagctttgaaatttaattatgatcagggagttctaaaggaaattaaacatagcatgagtacttttaaaaaatatgaatttaatatagcatcttatcaaataattcatcccacacggctagctcacttcccaccaggaaatagaaaagaatttttgaggactcttaactaataataatttctgaatttctctgacaccttcactgtttctaaacattttttttggtcatgttaacttacttgattcttcagagtttgcttattatagccatcactttctaatagtacatagtttgaaaagcacttggccgtcttctgcattctgggaacatgtggcttcctgacccacagaggatggcttctcgctgtgtcctcatgtggtggaaggggtgaggggtctctctgaagtgtctctgctaagggcgctagtcccattcttgtgggctttattctcaccacctaatcactcccaaagtccacctcctaacaccatcgcttcaggggaaaaatttcaaagtatgaatttggggagggggcggcattaaatagtcgatgccactccccatgctttcttttcctctgttgtggttttcagatgaacagagacttctggagttgatttgctgtcttatttgttctccctgcttgttctcgctcatctgggcaggtggtttgtcccttcttccccttatccaaatgataaattcctctccctcctctcctttcctcttccagtatcttccttcagctcctcctcttaggagctcaggaaatctgtctgcacctatcatactgacagcatgagcccaaatgtttttccgtagttcatcctggatcccggaaacatgggtggctgcctgcctgccagcctcagtttatttcccagccttactggtttgtaagctttaattttagaaaagaggacagagccatgcagtccacagaccactgcatggtgcttcgtcaccaccggccggtgctcccatgggctgcccaggtgcccaggcgtcctgggtccccaccctcgcatggctgtggagccgggacagctatgacatttgtgtggggttcttaaaaatgtgagaagctcctaatatgttgttgttaaactcatcctctctgatagaatttaattttaaacacaattcccccgaatacaccctaatgtgcttgtttcatttctggagactgtatgcatcactttccttgtctggccaaggccacaacagcgtttgcgttagccactgtgtccctgagtagatggggccctgtttactcttggcctgctccgtgggatcccagcccggccctactggacctcccagctcttttacaagtaacgccttctttcccaggtagccccattttctcctccttcatgacacgcctgtgggtccctgctttcctgggactgtcatcgatgtgcacgctggtgcctatgcacatgctccccctgcatcctcctcggtggggctgacacgcagggacttgcccacatcttctcatcttgatagaaaggatccctgtggcaagccctcttcctttcttcacaaagctgcgttcctcctttcccctctcctttggatatctgccctgaagaagctgatagaagcagatactgcttctggtaggccccgctctgcctgctccgatctttcacttctgcccactccatgctatggccttctctgtctcttcccttgttaactccctcgtctgcatccaattcctgatgcctctgacccctgacactgtgtgctgcccgcagccagaggaaaccacgttctggagtttggcagacctgaaatgcccacaactctggccttacttatgggaggcccttttcttcctcttccaagctctgagcagctccgaccacaccatcctcacactgccacctcccctctgtcctcgaggcccacagtcctgcaggtgcctctgagagtccggcacggtggggagtccacagggctactgtcacacccatactaacctagggagcctgtctctgaaacactgccacatacttgttttctcccatgttccatgtttccgatttaaatgagagacatgaccatttctatctggctctatgtccatgtcttccttgagacagtgcagtggtggattagaaattgtcttatgtcagctgggcacagtggctcacacctgtaatcccagcactttgggaggctgaggcgggtggatcacgaggtcaggagatcgagaccatcctggctaacatggtgaaaccccgtctctactaaaaatacaaaaaaaatagctgggcgcggtggcgggcgcctgtagtcccagctacttgggaggctgaagcaggagcatggcgtgaacctgggaggcagagcttgcagtgagctgagatcgcaccactgtactccagcctgggtgactgagcgagactccatctcaaacaaaaaaagaaagaaattgccttatgtcaaaaattagcaattttatgctgggcatggtggctcacgcctgtaatcccagcactttgggaggctgaggtaggtggatcatgaggtcaggagatcgagaccatcctggctaacatggtgaaaccctgtctttactaaaaatgcaaaaaattagttgggcatggtggcgggcgcctgtagtcccagctactcgggaggctgaggcaggagaatggcgtgaacccgggaggcagagcttgcagtgagctgagatcacgccactacactccaacctgggtgacagagcgaaactccatctcaaaaaaaaaaagtaaagaaaaaagaaaaaaagaaaaaaattgccttatgtcaaaaattagcaattttaggccaggcacggtggctcacgcctgtaatcccagcactttgggaagctgaggggggcagatcacttgaggccaggtgtttgaaaccagcctgggcaacatggcaaaaccccatctctactaaaaatacaagaattagccaggcgtggcggcgcacacctgtagttccaagtactcaggagattgcagtgggaggatcactccagctcaagaggttaaggctgaagtgagccatgttagcaccaccgcattccagcctgagtgacagagcaagaccctgtctaaaagaaattaaataagtagcaattttggcccctggctatttctctgcccctgacctatgtttttctgaaatgttatagacatcttccaaactgatttcacctaaatatcagaaatcgctcatcatggttcctttgtccagtgctgtggaaggccccagaggaggcttctgtggggtggtgagggcaccaggtgtgagttgggacctgagacctggtccttgttcttacagccgtgatgctgatgattaggaggccctcccagagcctccagacaggcttacaccatctggagcatgggcctgggtgaggcctcgtgagctcctgcatcataacggtgcttcctgctgctccaaagctgtggaatgtgtggtctgggaacagccctggctgaggtgagcgcatctttgcttgccttccacgtgacagacctggacctcagttcttgggaaggcgtccacgttcctttcccagcttccccattggatctgacgctctcctcttgtgatacctttacctgaattgctgggagattcagcgtctggacttccccactcccagccataggaaaaccttccccccagaagtccctggtgaccactcacacagcctgatctgctgccaacatctaccccttctggaagcagctgtcactgtttccagcgtgccagcctgacatatttcagagtgtctgcatgtctctgagctattaatacacaaaataacgtaagccccctcttctggactccccagtgtgtctgagaatgcctagtaagcatccatctggttacttttagctctaaacgttggttactagctcagcccaccaagagctcacatgcccaagctctccctggttgtcttatcctccctggctattacctctccctggctattatctcttactgaccattatcccccagggcgaatacaatcccttcttcttcacactgaaagccaccactaacacaatgatgatgtgtgtttaatgagtttcacccgctgaagttttagataaactatttttttaattctaatcttgcaaacaaggcttctgtgttcctctggtttctgggtcttcctcatgccaagaggccctccctaacaccttagccccagacctcttctgtcatctcagactctaaagcaaggtttcttaacgtggggtcccaggggcctgtgaacttaaagaaacaaaaaggtcataattatttttattaaagtctcactaaaaaactgctgcccttcagcatgtctgtaggcaaaatacacagtagttttggcattacctgtgactaaaaaaaatcacagatattcccatatcacagtggcaattgcagatatcttgaaatacaacatactctcaccattatttcaaagtcatagtaggttttaggcatacccctatttgataagctttgagactctaggcagacactcaagcaacagagctggtcagtctctggagattcccttctcaagagtcattcaggggcacgacctaaaggaacgagctttagagtgcagtttaactcaacagcctttggagaatctagcatttctggagtccaggctgtcttttccttacaaagtaaattatcaaatttgcattgtttatcattgggtatccttgctaaacaggagtctcattcttttttccttttttttgttttttttttttttttgggggacggggtctcgctctgtcacccaggctggagcgcagtggcacaatctcggctcactgcaagctctgcctcctggcttcatgccattctcctgcctcagcctcccgagtagctgggactacaggtgcccgccatcacacccgcctattttttttttttttttgtatttttagtagagacggggtttcaccgtgttagccaggatggatggtctcgatctcctgaccttgtgatcctcccgcctcagcctcccaaagtgctgggattacaggcatgagcaggagtcccattcttataagcatcagaattaaaaactcaaaattggatatctgatttgacaggcaagtcaagggagtgagctaggcagataactgggacaaggacgttgcaggtggaggtcagctggcataaacaacctgaagcaccgagtgttgctgagaaagagcaaggaagcctgtgtggctggggcctgaatgaaggaatgggaaggaaattagcttagagaggtagcaaagcgtatttatccttgtataccgttgggagcactgattttattttatttaaagcatgccttcttgtccaagacaattccccagtaaaatgttactagtttatctaagcccagacagccatttccctgatgtatctttaaaaataaaaaatctaactcctgtgttttaaatacattgtgaatcattaataaagcaatataaatacattttatttttgtatatttataactatgtttcaaaataatgcattttctttgcaatctgacatattttatcttatatatttaaacagaagattctgacaaatgaaatgctggcatcaccagattgttctaggagttcattttttttctgtctcatttttgtctaaagagacaaaaaagatctagaaccttttctaaattttagggcctgaatcccctctctctttaaaatgtgtccgcaccccccaccgaccccatcccccatccccccctacccccttgttgtgtggggcaattcagccttttcaggtggctttatatacctgtgactgcctttaaaggtggctttatatacctgtggctgcctttgaaggtggctttatatacctgtggctgcctttgaaggtggctttatacacctgtagctctggggccttccaagctaagcaacagtactgctaaacagttaagtctacatagttcctgggtggtaagtgatttccctgtattatttcacaaaatcataaaagcatttatttgcccagtaccccacaagtgatagaatctgagtccagaggttcggccaccagggctccagggcctgaggttttactgtgttgtgtgctgtggatgggttactatatcctttgacataaatatatacatacttggcttatgtctgctttgtccccagaatgcacacatatctgtggttaagacagtgttccttctttctttctctctcttttcctttctttgcccctctgcactggcattgaactctggggagaagacacttgcgttctgaggctgtttctctgtctctaaatgaagacagtcaaactgaatcgtttccaagtccccgtccagcatttaaattcagtgtaagaaggaactcctggctacgctgccttcctaacctggtcaaggaatgttcattctttgtattgactgcagtgtcattgaatttgctgcaaggctttacatcctcctcatgaagaggtgaccttgtatctagagtcccttcgtctctgtctttgatgcagtgatatttctcattgtgagtgattccataagctagaccagcagttgcccatattccatggttgattagttttctagaaaagaagaggacccttcacaatcacagttcttgtttggaaacccaacaggaccttaacatgtattcaaagtgctgataccaaatgcctcttcttacttggtgcccactcctctgcacacaagaacaagtgtttttttcttacaaataaccacttttcagttcattctagtatcacatggtttctagacttctttgcaatttgagtggaactaaactacagttcattgacaggcatcacacagcacgtgtttatagagattaacagaatatctctgccctggtgacattggtagaaggctcattgagatgattttactgtgaacgacgtgaatgccactattctagtaatagtgttcacagctgtatcaatttatggcttattaagtgtagggccaactaaataacacatatttttctacacaactgttgtcaagctgaatttgttccttctaggaaatagtacaacctaatttttcatctaaagatagaggtatacctggtcaaatccttcatagcaagaaagatactactgctagtatgaatcttgacttagaagatgaaagaagctcaaatgttcagttgttccaatcctttgaatttatagctgagggaatggaagtccatcaggagggcatgaagcctgttcaagttcacacagaggatgtggagcctctgatgctcatcgctgtggatccttcccatgcctttatcccccctctgcacacctcacatagtgtcatgagttcctgttctagagctgtggtcccctgaagcaaatctacgggtctcccttctcctgtcttttccttcctttgtgtgtgtgtatgtgcgtgtatgtttgagatcaatgatttctcttttgcctacttttgacttaagataacatttgttttggagctcgacaagcatgactcagcagtgtaacactctttttaattttaattattattattttatggttattcttttgtgattatcaagttgttcttgatgatatctgggcactgtgcaagacttccttcactgcatgggagtatgtgaggttcatttcaattgcacttgtgtttccatcttcttcccttctatcactgactcactcaaagcttgcttttgtttcataaaggatcaaccaacagaaaattgagaaagtcagtccattaatttgtttggccagttttagtcattggttggattcaaaataccccatctattcaacccagatggaaagaactgaccttttctgaagctaaaacatatgcaaaatggacaaagcccatggcttgacctgacctattcctaggtcatggtatcctgatagagcattctccccatccgaccctgaggcacctgaacccagcaacctctttatgcactcacattttcagccttaagggtcttccctaagctccgctttctgagggtaaagcctttaactttcctttgtggacaaattgctcactagctcatcattggggttcagtggacaaggtatccttacatgccatctcttcatgagggcgtgaaggctccgttcgtaaagaactatgatgtggtcatgtaatgggttcactttaagacttgaaaataagtaaagcgaataagttacactataattcatcatctttcatatatagcagtaatgcaataatacaataattactttggtttttgttggtaaattatataaatcattctattcattagagataatgaaaaagtaacacaaacatgatgtgatgtctcccttatgctactgatttactttatttcagtcccgcctcacttcagaatgcaattttttccttgcaggaattacttgtaatggcagtggtagaaccaggggatcaagatatccagcttctgatgcaggaaatccatctctctttattgatagcccagcatcatgcttttatctagagaggcatttatccatctaaacacccctagaaaagctatgtggaaaatgtaaaagcatcaggaagctcaaagttacagccaaggcacagactgaatgctttaaaatcttgtctcatccacagaaatccacaaagattatttccatagatcaaggacatagtaatgctgtttgccctttttacatagtagtaccgtatatttattagctctattgatgaaaataggagagcaactctccttgatattagagaccttggcaaacgtaaagtacttaaaaaatgaatagactgccttccgaatgtgaactcactgactaagcccagtgaaaggagagtatggcatgaaatcagagaatgatgaatggccaggattacgcgcgcgcgcttgtgtgtgtgtgtgtgtgtgtgtgtgtatgtgaaaataaacaatatgattagtgtttattctttttaacaatccacaaattgcctgcttttctctacttttttttttgagatcaagcctcactctgttacccaggctggagtacagtgggtgtgatctcagtgtactgcaacctccgcctcacaggttcaaatgattctcctgcctcagccttgccagtagctgggattacaggtgcccaccaccacgcctggctaatatttatatttttagcggggggttgggggcggggggattcaccatgttggccaggctggtctcgaactcctgacttcaggtgatccgcccacctcagcctcccaaagtgctgggattacaggcatgagccaccttgtctggcctctactttctccagttagaaagtggaagaaactgagcttcaaatgtcttgcttacagctattttggggctctgagttgagatttttgttgtaccatttgtgaagccatccaggtgctgggtctaatcattcctgggcaactgagatacagaaggagccccagctcagatggtgcacgggcacatcataccctgggcattatttttgccctttttctggaagtacgattggaaatgggcagcagatggaccacttcgcattttacccgttcaagcaaggggtatttttcttctaggaagtgggatttccaagcaaaactgccgctttggtagtcacttgccatacttcagtgtccatggaaaaacaactgcgtataggaagagggaagggggacatagcgtgccaactctaactctgatgtctgcaccactcatccataatccatgtcccagtggggaaggtgatattccctggcatctacagacccagcaggcacacggtgggtgagtgggcctggtcacctgcaaccgcagtagaaactctatcccaaggcaaaaggaaattaagaaatccatttgtgaataatattcacaactacaatactgttttgttggatctttcttagtttcttcagttcaaggttgatttgtggcccatgagtctctgatccagacatttgaaaatctctagactcagtgaaagtcatgttaattataaaatcagtaagtacactatacaagagcagctttgagcttggtaggaagacggccttcccaggaaccagagaggagagagccagctttgaccctgcgaggcacatgggagaaaagagttcagttggtttatattctatgaatttactttccccattggtattccgaagtgttcactgaaacacagctgctcctggcactctaatagacatttcccaggacctcatggcagccttatccacagtctccagcctgcagtcacatgtatttttcaggggttcactgttagccctttgagcaaatatttatagagttgtttttaaaaaattactgatgctgtaattaaaaagaacacttaatccaaattacttaatagacgaataaatgagtgaataatcaaaacatttaataccactggtatatataagaaatgaattaatttcaaagtgtggaaaaattatgtgggcttcttatcagtggtattaatctatttttgatacataaaccaccctaagaggttttcctatctatcccaagtgtcattttgcagtattagtttctctaggatgtgttttcattagcctcttagatataaatggctataccactaaaatgtaggaaaaatcccaaatgaaagccctttccctattcaccctgttaagcttcctcttgatggaagctctcttcacccttgaaagctgctaggaggtaatggagggcactgtggccacccagccctggtgcactgagtacctttccttaataaatcaccgttggagtcctatggcaacaacctaacttgataacacatatatctagatgtcttgcttcattgatatgacagtgatttctcttttcatactcaccttgggaatctaagatgttagaagctaataaatcccccacacataaaacatataatgatacattcagagaaagattctctaaactgatttcagcagttcttacatataatagaaacacagacttgcctaccatgattttgttacttttgttgtcatagcctcattcattagtttgacaaatacttgttgcccatctcgagtgttccaggcaccgtgacaaacactggttatgaacagcaaaggagatggaagtagtccctcctctcaaggagtctgtcctctactggggagatacagggaggtatccagcagtacagcctgtctgtctggaaggagcccaccccacatgcagttgaaaaacacagcatggcagatttttcaattttaaaaaaaaatcacgtgctgattttataacagattttaaatatgacctaccagtagattatagttcatcatttttgaaaggcactgttgttaacgatgtagcaccttcccgtcactggtatctcagtagccaccagtcagagcagctcctagcagactccagaatcatgttaatatcttccatccgatcacctctctgaagactgtttgtagataagtgtgtcttaagtgaactttattcgaatgaactcctaccctgtagatgacagtttttgcatgaaccgtaatcagacatagatcttcttagggaacatataatggggaaaataggacttggccagtcatggcagatgttcattgatgtgtgtcatatgaatagatggatgaatagcacaaggtaaagagtggtgtgttttataaggcaggcacatgcagatgttatgaggacttggcaaggctagtagtaactccttaaagaatcatggaagacctcaaaagccaggaggtggtgtgtgagctgggctttaaagtaagcctatggttgtgccatctggaaatttaatttcacaacatcctggaatgtgtttccagtgaatgagtcaatgaaatgacagaagtcagtggacaaagattactgggaattttcctgcaagatgcagcactcagacctgggtttgaacccaaactctctcctacttttaccccaggacttttcccttataagacaatgcatgtgaaacgtatggttataaagctaccccaaagtagaatcttttattattcttcagtaaaacccttcatgggatgagagtttacgaataaattcagagttcatctggaggtgcccggtggatctcttgatgtcctagcttcccaggtacattgccagtttacaggaaaatatgcctttttgaaactgattgaaaacaaattagctgggttttcttggacgatgaatctgtagtttttcaaagatcagaaaattcctgttctccaagaagacaggtgcagaagtgatcatctgaggctgctctccaaggtcctcagtgtatttgcaatttcctcagagtctgtcagccatcacagcatagcctctttcttttttctggatttcttttttattccatgataggtggaataaggcaatctgggcccagtaatgcttgttttttaactcagtgtcatcactatctctcagccagtgttgtgtcccacccaccaatggcccagtgaaaagtgatccagaatcccttctgaatcactgaattatttgcacacaaactcatctatctgatctgtccatcctccatgataaacggaaattagtttcattttctgccctccccttcctcctggaatatctgactcttcaataaatgagaagacagagttatggttcatttactgacttgattttaatatttcggagagcatttaaaacatttatagcgcagcagtcttccttttcataggaaacaaaagtcttctaaaaggcagtctcatttcccgtgtggttagttgaatacagaaaccgtgtagtcagaaggaaggggctgccctgagtcagcccgggctcccggggctggacggagcttgcatttctgagctcccagggcgcccccaagtggcgatgtcaagctccaagttgttctcagtgtgctcaacagcagcgcttttataaggttctttttgttttgttttgctttggctttgctgttgtttgttcggctgcttttatttttgcagttggctgaattcatccgagggttatacaaatcaaaaactgtaagtggagaggatctaccagttgttttgcaaagatagaggtgctatcacggaggatgctgttggtgtggcataggtgggaaagagaagcagtaagaagaaaggagaataaaagagaaatccatgaagctgtaagaagtgtttttttgtcactttttaatgctgatttattcacctggatcaaaataaggaaaaacacacgaggtctaaatcatcaaaataagttgcaagataaggcagcacgcttcatgaggctgtttctcttgctttctgttctcaacaccagttctgtgtaagatgacctgcaacatagactctgcatgtagaatctgttagtggctgacccctgccttatataaacaaggctggtaaatatggagcgaggctcacattcaaacaacaattctatgggctggattaagactcaaagtccctaaacactcatcaaatcatgttgcctctcccatatgcaattccagaaggataatttattttgttaactaataaaagcaatatcatgtgtgctgaaagtattttttcccacatattctgtgtacagaattctatatatgttcctaggggctggaacatttttcctttaactgtgattcttattctgattactagtgttctgaatgcacacttagcctgcgtgctacatggcctgtgcagctctttcctcctgccccgggaagaggatttcaagcctgtcatcttcaactcatagcagccttggtggagtgggttccaaactggctcttatgatgccagctcaaagtcagcctcttgggagtctctttagggcaacagggttttgcctttcaacacaacttaagtataaagtgcagataaacataagagtgttattttaaaataaatttgctaaagcattatttctcttttcccctctccctcctcctctgtccttcctctaccctcctctttcagactcatactcctcctctgtggctttacaaatcctggatagaaaacatctcacaaaacatgttctcttctcttcacatatttaagaggccttcgagcattgacacacatttgcctccagattttctagttgaagaaatgtgcaaaaatcaataaaaagcccaaatacagtggtatttttccccagagttatggacaataacaaataatcaggtgggaaggcttgatgattttctttttagattgtgagctacaggcggccatatgtgttttaaaggttaggtacataaaagaagttttgaggtttcccctctgtaacaactgattggccctctcgggaactctgtgcttaaataaagctgataggattggcctctcttagcatgcttatgccatagatgagcgtctgatgcttagcgacctatcctggtgcaagagccaggcagtggaagaaccaggtgtgcagtgtgtccaacaggaatgcttttggctgtgaaacaattcctggctgaaagggcctaagcccgggggattttatctgggtgggaagaggattctggttttagttcagtacctgcatgctatcagggctcaaggtgtgcatccttgcaaacactggccccttcttctcatgtttgttttttttgttgtttgtttgtttgagacagagtctgtctctgtggccaggctggagtgcagtgagtggtgaaatcctggctcactgcaacctctgactccctggttcaagtgattctcctgcctcagcctcgcgagtagctaggattacagtcatacgccaccaggtccagctaatttttgtatttttagtagagccggggtttcaccatgttggccaggatggtctcgatttcccgacctcgtgatccgcccacctcggcctcccaaagtgctgagattacaggcgtgagccacggcgcctggcctcttctcatggtttcaaaaaggctacagcagctttgagcatcaaatcctcacacaactatgttcaaagacagaaaacaggaggaagtgatgttggcaggccaggggaggggtccctcctctgaccactctctcttaccagagagaaaaataatctttgccacagcctcccagaaaactttttatttctgcttcatcaagcggacacccttaacttgtggatattctatattggcaggtaaataagtgagaagggatatgggtgcagcacgggggcaaccaatgaaaggttggccatacaagcaggtgttccaataagacagaagaatacatgaaccatgctcacaggaaaatttatatagtttcctcttggaaaacaacaacaaaaaccttctggtcttatccaaagcattaattggatgaaaaatgtcaagcttttctcagtgttcggtgcagtacaaacgtaggattatttctaagtggaggagcaatagaagatagcactgtagaactcttccgtcatgccaagagaagttagatatgaccaatacgatgaagggaaatgataaggtgacattatccctgagctaaaagtcaccgaatctgtgacaaggtatgggctagtcaacttgtggagctctccagcccccttctcaatgaagattttaaggcaaactagaattgcattacatttagtgattatttttcctcaaagaccaacgacttcaatgggagatagaagagtctgtggatcacttgcttttattctcttcctatagctgtgaaaattgattcaagaaattgccaacattccactttaatcagggtagaaaccaagagttgggtgtagtttatccattgagatgctctatgcattggcaatgccatcatttaaaaacatcatggagactgtttttagtcatatggacaaatccaagcaggctgccttcccaggaaatcaggagcaacctatgaagttctaggcttgaagttttttgattggtggacttaataaaatgtagatataatcagtagattaaaagtgagtactggctgggcacggtggctcacgtctgtaatcccagcactttgggaggccaaggtgggcgaatcatctgaggtcaggggtttgagaccaacctgaccaacatcgtgaaaccccgtctctaccccagctaaaaatacaaaattagccagctctggtggcgcatgcctgtaattctagctacttgggagtctgaggcaggagaatcacttgaaccgggcaggtggagtttgcagtgagctgagatcatgccattgcactccagcctgggtaaaaagaatgaaactccatctcaaaaaaaaaaaaaaaaaaaaaaaaaaaaaaaaaaaaaaaaaaaaggacctattccaagattttcattaaatgctcagataagtataccacccgaggatcagtattataaccaggtatcttattggaagtcttgtgttttatcttggaatactcatgagttcggtattccatctcctggtatatttggattggataattttatgttatttgataaaattgcctactcaaggaagatagttatcctagggatttgaatatctcaattgggaaactcagcattcattgagaccacaatcaaccatttacatctcattttgagttggacttgaagttgtggatgatatcagagccctgagagagagaaatttaaaaaggaatcctgaaaggcagatgtaaatatcgccttacactgcttcttcttttaccccaagatggctaagaaagccttcaaagtcctttgaaagcattaatttatccaacttttcccacaaagactgaaatgggtctgcatcaatgatgtaatttgggtattgctgggttatacaggagcacaatggtgatgattatgggtgcgctgcagaggactgagttaatggaatcccatcagggactcagagcacaaattcggggcacaaacaggacccacctcatcccgctgcagctgagagtcactgttgttgctgctgtgagtgagggaaaaggctgatcaaattgcaggctcatgtgactggtggatttatttagccaatgggcaatttcggtgtacctctcaagcaaaatataagtaattgttgagagaattacttttttgattaccaaattactatgatttgaaatgcaattagtagtatagacaaacctatttttcccctttatgagaaggaaattgttcggaaatgggtatagtggtgctgataaagttacagtccacagtgaattaaattacccacaagaagcagatacatggtttcatttcagttttattgctcctaatgcaatttgttttcattaatgagaacccacatgtatgcatgaatcagggttttgcactgatacctcctgtgtggggtatttctttttccaggttaggtttcattctccatatttaagatctattgtgtgtatattgatatttgcctataaatattaaagatgcacctgtggttcagagaatatgttaaaattcaagaaaagctaccgatctacctaaagtagcatcaactcgttttttaaatttgtagatatttccatttgtacatggaaatttagagggaatcttaagtgacggtgaaaaataaaatggattttataatgaaccctttaacatgcttgaaaggagtggattcaggagaattaagttcatgaaagtcaggtttgaactttaaatgtttattaactttattgatttttaattaaggacaggatttttttattgcattgaaaaagcaatgagtccaaactagaggcacggaagattttttttatgaaatcagtgtttgaaagtaaggcttttttttctttgcagttctgcagagttcttctgccaaattgcatatgttctggcaagatgggaaaaggctctctgctaaggtacaaaatcagagtatctcagataagccacaacagttgtggtatgatagtttgaccatatctttgcctttgctttgacaattcccttttgatttctaccttcttcctgacatgaaacttaaacatcagttcaagggcgaaacagcatctgaaaatgtcctgcaaagactaaatggactgcattcttttttgattctgaataaagtcttagaaaagataaaaaaaaaaaaaacactccctccctcatttaaatggtttcttttttttattcttgaaaaatccttacccttaggagaatccttgtccaatcctttaaatgtataagctgttatctgagacctgagcaaacatttgagaaatcttccaggtcaccttggtgccgtgaagaaaattgctctagtacattgctctagtgcagtggttctcagacttgtgcatgcatcagaatcatctggagagcttgttaaatgcagcttgcccggccccagccctgagtttcagctggtctgagacagggcccacgaatctgcatttccaacaagtccctgaatgatgctttcgctgttggtccagaaacaactctttgaaagccactgtatgagtagattaaaaatgctacttggtgctgctataataaataaatcacagctttattgtgaacacatttgcaagctagtggtttctaacagtccttttgtagtaagactagcagtgctccaaatgtaccaaaaggagcaagaaattgagaaaacggcatctattcacaaaagtaaagcattatcagtcggataatttgtagtatcagtcttgcttcactttgaggagtactgatgatcatctgcatgaaagcaagttcactgtagttcatgatttcatccttagaacgtagcgcaatgaatggcacatagtcagtgctcaggtgttaactgaataagtgaaatgcctacaagaagcatggacttgaccatgccattttttcatgcattgatttggctttaatgacacaagcatgctgtttaaccaattatcctcagtgacttacccaacaagtatttatttcaagacccacatttctgctggttaactgtgattcagctggtctacactgggctcggctaagagactctgctttgtgctccccaattatctggcttagccccaggctgtgggttgtattgaggtcttctccaagtgtgtttgttctggggccaggctaaagcatcggctgttaatagggacatgtttttgtatggtggatcatcagagtgcagaagccagctagggtatgcaagcagctgcaaggcctctgcctgcatcatgtccacgcacatcccattagtccaagtaagtcacatgaccagtctcaaagtcagggtggcagtaggtgtcaggggacaggttaagatgcttccctgcagggggcatggggtggagagtagtatttgctgaacaacattccagtctgttacagtttacaatatggcaataatggcttattccatttagaactcaaagatgagtgttcaggagctggatatttataggttggaaatgcaatcacatgctccgctatattatgctcttgaaagaagatgctgctactcagactgtcccactgaacatctgaaaagggggtttgtcacgtaaaggaagactctttcctcttccctccttatgtttcacagtcattgtgttgttggaagaagagatggaaagatacactggaatctgcagtacttggacctgggggccaacttgctgggcttttcttattttgttatttctggccgacaagccttctctttcgggggtgaattaagttgtgctcacactcaaccctccctaaatcttagtccagatgcacattttagaaatacactatacccccttcctttatttgtaactgcagtaatttttagtgaagtcaagttttccactctctgtaactgtttctattagcctgcaggagagtaccaatttacgtggcaggatttattgagttgacactggctctgtttgttttgctgtcaggaaaagacgttgcatttgactgaccctatctttatccattttggttttgctgttgctttgaagtcaaagcctgagaatgcctctgggctgatgccaatgtccccagaagacagtgtaagcccttgttccctgtggctcacagtcagttctaaggctgaccataccgcaagcaggacttggtccttcacaaggcatgccagtggtcagcagagagaacagacacaagctttctcttctttctgaatgcaaccatcacctctcctggttacaaaattaaagcactgaagtgcagagactcattcctatcactttaacattgaagggaatcatatttaacttaattcacctgaccctaagaagtgtgtggtttgaaaagggcaaggcgctctaggggcactttggagcagaagtcatatctcgtttaatctaatacagtttgatctatgaactaagacgttttggagaacaacatggttatggtcaaatgatcaccagggacaaacagaaagagaagagagtcttctataccccatgctccaaaaacctaagagccttgggaagcactgtggaaacgatcattgtgtcaccagaaaataggaaatgacaggagttcgtgcctcctccagggtgagaggtgattatttggataatttctgaggcaatgttggtagcacaaggcaagatttgataaatattcagagggcagcaaggaagttttagagaaaataatatatattctacgtatagcctacagatattgatccagagaagggacatgcatgaaggcaagacaacagaagtgaagaaaggtagttagaaagtgggaggagaagagtcgattatggttcaatgtagaaaggcaagatgaagaactaggggagaatcctagaggaaggtggtaaggttgtgagcagccctccgaggggccacagagaaaacatgggatgaggttggcaccagccatttgcgtaggatcaaaagcttgtgcagctcacctggcgataaaccttaacactcgtgttaatcaaccactgtgtttgtgtacatgacactagtgtagttagttgtacgtatgttttgaactgtgtaagatccaagcagtgacacaatggtagggctaaaatgcagagacatgtgctattgggagattgaagcttaactttactgatgttagagaaaggctatttattgggttacaacaaatgattttacataaaacataatttttaagtattaagttgaaaagcccaaattgacccaattcatactttaactctgtttttcaaaagcctgaaatagcaattattgtgtgtgtgtgtatgtgtgtgtgtcctggatatttcctgtttgaaggtgtgtaaaaggtcttactacccagcccctagtggagagttctcttgcaaaaaacaaaaacggaaacaagaaaccaaacatgctttgagagatagagagtgagaaacagattttcagagtggagaatatgccttctatttatgcatttagcattgtgttttctcaagctacccagattttttaaaatttctccccgtttatgagttcaagctgataatatgtaaaagacagtgatgcccactgttttagggaagaccttccttcagagtatgctaacttagccatttcatttcttcaaatattagtatttggaaaagaaaaaacagtcttaaatatggttctgtcctccctcagcacccagagaaaagggaagtcaactacaggatataattctctcagaaataagaaaacctcttagctaataaaaatcatgcttaggctgctaaactcaatggatgtacttttgttattcctacaatgcttagcttgcaggtagaccaaaaatttgccttcattgtcattttaaaaatgactatccaacatattttgcagcatctgcctaatcccaatgacttatatttgttttgtaaatttgttctagggaaaataaacacacacccacacctttgtaataaatagggaagcactaatcatatgaaactagatagaaaaatgggttgggggcatttggtttggagcagcatggaagaattaaactcgacattaaataatttgcaaaatattttcaaaaatattttctcacacttacccaataagtaggaataaaaatctgcttcatcgccacagtgtacttcaggcgttcaaggagaaattgagtagagggaaatattgacatgtttccttccgaaccactacacctattttgaaatgcccattgggtacttttgctcctcttcggggtatctttttccttgtttgtgtgtgtgtgtgtgtgtgtgtggataaggggaggtgaaaggtgattagagacaagaattgaattaattatacatcataaacataacatgccatagcttgccagtctttaaaattgtatcacttcacttattctaacatactaaccactttatttttttatatgtgggaccacagtgtcctcacaccctcgactgcaatgtgtgtatccgtgcttaacacaaatttggatgtgtgggtgcataaacgtgcatgcacatacacacgaggtatagaacatttatttatttatttatttatttagagatggagtcgtgctctgtcgccaggctagaatgcagtggcgcgatctcggctcattgcaacctccgcctcccgggttcaagcaattctcctgtctcagcctcctgagtagctgggactacaggcgccaccatcacacctggctaatttttgtatttttagtggagatggggtttcaccatgttggccaggatggtctcaatctcctcacctcgtgatccacccgcttctgcctcccaaagtgctgggattacaggcgtgagccaccgcgcccggccagaacattctttaaaatgtccctagaagcaccgcgttcagtgtgcaaggtgcaagagtatagccaagcgcttttcaatttgggtaaagggcgctccatctggatcatccttgaggaacatcctcgtgttcatccatgctgtttccagtcctccccagcattccggctcctttcacacctgcatctttcagacgctcgctctttcctgccctccgtttcttctgcttaattgtgagatttgcttcccagcacaaatttttacttcaactctttcccctgttgcttatgagttttatggtgatttcattttataattttaagcagaaatcgcttatcatattttcttagataatttaattgagattttaaactttagttagattacagttacctacaatgccttgagaatatagtttttaaaagtggcacatatgctttatcccaatagtattctatctatgattaatatgcacacatctatcattgtattttgtataaactatattagtatgacatttagtttgtgtaaaaatatgcatgcatatttcatagatagcgtatgtatattacataagtgggaccctaactgcatctatatttagtgaaatgtcaggatcgcgatgctgcggtgaatagcatgagctttctttcatgtccatgttaggagaggcagcttcctcccatcaaaagcacagctggggcagaggagggggttgagagcaaggttttctatctatctaattgtggtgacttttaaagtttagttttatggctctgttgcctctgtcttcaaagtcaaatggagcagctgaagctctccccaccccagacccacctgcctggcctctcccatgcagcaagtttcgcttagctgttgcaatcctggttttacttggttttgtatttgctattttttaaagtgtttttaaactcatgtttcttcatagtaaagggtaactactgtggagtaaacagaagatgagcgtggtacaaattttggttaaaccaaaaactacacactggattgaaagcttggggaagggaggcaggtggaagggactgaaggaggtctcttcccaggagacttgttcaccggcatccagtattctcccccgcagttagggaaacagagggagcatgcagtttcaggcccaggcaggcctctctctgggcttggggcaatgccagggctgggggcgagcctgcagtcagccttgtgagtggcagccgaggctgttattttgaaaccctaagtggaaacaggcatggaaacccggaaggagcagggagccttaggcagtcctgggagatgaagccaacgccctacctccatgtggaaggaggcggcggaatgggcagggtcgggtctcacaggttcccccctctggagttggggtttcccggcccacgttcactctctggatgtgataggtccttcccggccgggaagggctggaaggggcgcgcaaggaggacgtggggacgagacgagagagacgcgtgcccagcaactccagaaggacggagaggagtgcagaagggagccggggaggacgcgggagggccgggaggggaagagaagccaggccgggcctggagcggaggagcggagcccgctggtgcgggtgtccacacaggggcgctggagcgcgccttcctgcggctgggcaggaggcaagcccgagagcgcgcggcgagtggagccatgtcgccctccctcgctctcggcgggcacagtgaggcgcaggctttggaaaagttgcgggcagccggagagccgagcctccgcctgcgttcatgataatgagaatggagtcgcggtcacagccgggctctctgcggggcgcatcgcccgcgaggggcgcctgggcctctgggcgtcctctgccgccccgcgacctttcctgccctcctccggagagaggcgaagggaaggggcggtttcggagggagctgggctgtggagggagggcggcctcttcaccagcgtcgtccgaccaccccgcgccctcctggtggctctcccacgccccattcgcaccccaggtcctcggggtgtctctggtgttgcttcaagttaggcaagaggagctgggggcgcggggagcccggcgccgcagcgcgtgcgtggctggggcgccccggggccggctgcaccttcagtcgccccctggccggcctgcctgcctcgacctccgcatccccttgcaccgtccgctcgcgtgctgcggggcactcgcagcactaccttcggtggggccgcagcaccctgagctcccgggactcccccaccgcccccgcacccacgacccgcgtggtcccagcccctccaccctcttcacgcaccctcgcacccttttgtgcgaccccgtgccctctccgggctgccaacccctgccacccaggtgccagtcccgggcgcggggaggaggccggtggggaagggggcggaggggccggggtggaggaggagctgcgcgaggggcctgggggcggggagcgaggagagcgctcggaatgtgtgccggtctctaggtggtgccaaattctggggcctaggcatttccctcgctttatgtttttggttttttttcttccttcaatctctttgattaggccgtacgtggctgtggcaaggagttggggaaaaaaattataaaaacaggaaagagagaaagcacagccagagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgtaagagcttctcgggggcggggggcggcggcgggttctccgggctgagcgcgcagcgagacgcgtcggcaggggaaattttttttggggggggaatcaggcgccctccccccgcccacgactctccgggcgcccccagacaggctccgtggcgccagatcgcggtcaccgcgtcccggagggagcgggtctgtgtctgcagccgcggcggccgggagttggtggctggagagagcggggtttgggtactgcgcctgctgggatctggaattcgccttacgttccctgggtgcgcggatgtctgtttttaacagcatgctgctatggttcctaaggagagaattcgatcggcctgtgcttacgagttggtttattttttatttatttcgtgctccgggaacacagcctcaggcaccttctctccctcccacctgtgtctggaatctctccatcgtgcccctcctctcctactcactctgtcccttgactcaaatgcctctccttcgttcctcttcttacttctcctagacactttttccccccagcggtggtgatggtgattatcctttccggaaaaaaaaaataccaaaatactggcatctgagccccaaccctctgtcccagggcccagctcttttgctgagagccctcaggccgtgtctgtctcccctcccagccctggactagcacctctgccttagaccgtgttcagtgaaaacttctccgagagcacatttcctactcttcatgggggctggaagcctgggtttcaaaggttggatttgcacatcgccctagtaaccaatgactcatgcaggacaggagccggaccttagatggatgcgtttaaccacctcctgtggatccctttcaaggatgcagagggctgctaggacttagaagggaggaaactgtgctttttctttgaggccttcttttcccagggaaaagagaaaaatccccgacaggctctcagagaaacaggtctggcttggctggtacagctcttataacagctaggctgtgttggtttgtagaaattactatgtatgcctttgaggagtttcacaactgctcaacctgggaaccgcaggggtcccaccggcctctcacttagtctaccctgacatacccagggcagtacattgccgggcactgagtaggtggttttggtcattacctctctgcagcctccagccacgctggttccctgtttcgtatttctttagtgcaagagttgtgtttgggtcgagggaggggtgagacattgagtgatttcccagggacaattcctaattgccagatactatgaaatcagtgaggttttgctgttgttattggtagtttttgttttatgaatgaaggatgtggaaactttaatggagatcacaaaactttgtgggagatgtggtttgcacacacacaggtacacaccccctacagccctgcgtcagattttgcatgaggttttgtgattttctcctgcatcgtttccagactcccctggttaaatagtcattcaaaggcatgtccctcactttggtgggccaagccctgagggaaatagacagatccttcagtcatctggttcaagtctttggcaaatggtttaattgggggagggtgaagagttctggaggattaaactaccgagaatcttggggaagacagttaagctgcaatgcaaacaggaaaaatgtactttttaccttaaatctgacttaaaattgttgaattgtggatgtttggaatgagaacaatgtgcagtttttttctcaacaggctctaggtgtcgctaggagaaaggaaaggcaagagctctgaattttatttcagatgatctccatctttttttaaaaaaatcttaacttggagtatacatgtccttctttttattgtgacatgtgtctagaaatgattctcagataaacacaggtgtcctgagaaacaaatcagggatataacatgtacatttgttaatggggttctaaacagcatctctaacttagatgtaagtcctgacatgctttttttttttttttctggaaaatacacaatgtgtgtgggtgggcgtgtattgtgtgtttatatagtgtactcccgatatatatatgcacacatatatacttgcccattatctgcacatatatatctggcacacatctgcaaaatgcattgcacatatgtcctttaaattgtataattaaactcatgacacaggctgaatgttgcatcctttaaaaacaacaacaaacttttatgcactcttcttagaaaagttcctcagaataggaaaagttatgcccccaaatttactaaaagatagatgaacatatcaaaccacttttcctccaggaacaaaagcttcaatttgcttaaagtgtattgaaaaacaaaaacaaaaaaagagattaggtagaaaaactgctttttaggtacagatacttgccaaggcaaggctgaagaatctagagtaatcattttgctacccaaatttaaagctgaggatatgcaatgaattaggaacacattgcattttattacgtgtcttgcaactgctgacaacctcaagacaaaccgaggctttccttttccacatctgcaagcagctgggagcgccgctacttcggtgggagctgtctgaggtgctgaaaccttctcttggcttagcgcaggagaaatctccatcactcttgccttttcagtcctgatcccaaggctggtggctttatcgctgttctctggcttgtcagggaagactgttccaaggtacagaaacagcttcgctgccttggtcactaagatgatggcaagcagcatacctttataatccttaggactttgtacctgttgtccttctgtctggaaattgagaaatatagttcttggcttctgtgcatgtgtgtacacctacatgcctgagcatgactgagaatgggcaattacccagccacaacccaaataaaatttatggtagtctaacaaggctaacacagagaaataaaatgcggagatagaatggctagaattaataatgcatggtctaaatgcacaaactacacaggcaacaaagggacttcccaactgtgtggctccacaggaaagcctgttttgggtgggtcagtactaacatgcaaagtctgacttcaaaatagaaataaaaccagagggtcttctctatccacttccttgtaaatcttagatttatttaaatataaagtcaattacttgggcaactcctctgaggaatcaatagcccttctgatttaaaattcattgtgtaggtttaaaaataagttgactcttaaaggaattgttgctggaagtgacttttagtggaatgtattaactttcatttggattaactgtggctaattttaaaatactgaactttgtcatccgcctgcttgaacatttctttttagttttttaaagggctttggaggccttctgtaccattagagcagtagtttttttaaggttatacagtgtgttcctgtatccttcattttcagtgacacgtggcttcttagcaatacaaatgtgatgacaacaggattttaaagcagcaaattggttaaaactgggatagatgggcaaatcaccacccatgatgtccaccagccttggaagggccaatttcatcatccgctatgtcttcggc
